United States Patent 12,569,549 (FLAVIVIRUS VACCINE) - sequence listing, part 37

SEQ ID NO: 14150 - RNA, 9879 nt, synthetic construct
  misc_feature 1..9879: note = derived and/or modified CDS sequence (opt3) from DENV-1__KC762623__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactcttacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaagcagagattttgtggagggtttgagtggcgcgacttgggtagacgttgtgctggagcacgggtcctgtgtcacaaccatggcaaaggataaacccactctagacatcgaactcctgaagacagaggtgaccaaccctgccgtgcttaggaaactgtgcattgaagctaagatctctaatacgaccacagatagccggtgtccaactcaaggagaggccaccttggtcgaagagcaggacgcaaacttcgtttgccgccgaacatttgtggatagaggctggggtaatgggtgtggactcttcggcaaaggctccctgataacttgcgctaagtttaagtgcgtatcaaaattagaggggaagattgtgcagtacgaaaacctgaaatatagtgtcatcgtgaccgttcacacaggagaccagcatcaagtgggtaatgagagcaccgaacacggcactacggccacaattaccccccaggcgcctactaccgagatccagctcacagactacggggcccttaccctggattgttctccaaggactggattggacttcaacgaaatggtcctactgacaatgaaggagaaatcctggctcgtgcataagcagtggtttctggatcttccgctgccctggacgtcaggcgcaagcaccagtcaagagacttggaatcggcaggacttgctcgtaacattcaaaaccgctcacgccaagaagcaggaagttgtggtcctgggttctcaagagggggctatgcacacagccttaactggcgcaaccgaaatccagacgtccggaaccacaactatttttgccggccatctgaaatgccgtctaaagatggataaactcaccctgaaggggatgagctatgtgatgtgtacaggatcgttcaaacttgagaaggaagtcgctgagactcagcacggtaccgtgttggttcagataaagtacgagggcacggacgcgccttgcaaaatcccattctctacacaagatgaaaagggggtgacccagaacggacgcctgattactgcaaatcccatcgtaacagacaaagagaagcctgtcaacatagaagccgagccaccctttggcgagtcctatattgtgatcggtgctggggaaaaagccctcaagctgtcatggttcaagaaaggcagtagcatcggaaagatgtttgaggcaaccgccagaggcgctaggcggatggccattcttggggatactgcatgggacttcggatccatcggtggcgtttttacctctgtggggaaactggtccatcagattttcggaacagcgtacggcgtgttgtttagcggtgtatcatggacgatgaagatagggatcggcgtgctcctgacctggttaggactgaatagtcgatccactagcctatctatgacatgtattgctgttggcctcgtcaccctgtaccttggggtgatggtgcaggccgattcaggatgcgtcatcaactggaaaggccgcgaattgaagtgtggtagtgggatcttcgttacaaatgaggtgcacacttggaccgaacaatataagtttcaggcagacagcccgaaaagactgtccgccgctattggaaaggcctgggaggagggcgtgtgcggtataaggtctgcaacgcggctcgaaaacatcatgtggaaacagatttcgaacgagctgaatcatatcttactggaaaacgacatgaagttcacagtagtcgtgggcgatgttgctgggattcttgcccagggaaaaaagatgatccgccctcaacccatggagcacaaatacagctggaagtcctggggcaaggcgaaaataatcggggccgacgtgcagaataccacttttattatcgatggaccaaacacccctgaatgtcccgacgatcagagagcttggaatatttgggaggtcgaggactatggcttcggtatctttacaactaacatatggttgaagctcagggattcatacacccaggtgtgcgaccaccgtctgatgagtgcagccattaaagattctaaggctgttcatgccgacatggggtattggatcgaaagcgagaaaaatgaaacatggaagctagcacgggcgtccttcattgaggtgaagtcatgtatctggccaaaaagccacacgctgtggtctaacggagtactcgaatccgagatgataatccccaagatttacggcggtcctatcagtcaacataattatcgaccaggctacttcacccagactgccgggccgtggcacctgggaaaacttgagttggattttgacctgtgcgaaggcacaaccgtcgtggtggatgagcactgcgggaacagaggacccagcttaaggactacaaccgtcacgggcaagattatccatgaatggtgttgccgctcttgtactctccctccactgcggttcagaggtgaggacgggtgctggtacggaatggagataaggcccgttaaagaaaaggaggaaaatcttgtgaagtccatggtatcagctggcagtggtgaggtggacagcttttcgctgggcttgctctgtatttccatcatgatcgaagaggtcatgcgctctcgatggagccggaaaatgctgatgaccgggacactagccgtgttctttctgctcattatgggacagctgacctggaacgatcttatccgtttgtgcattatggttggcgcaaatgcttcagacagaatggggatgggaactacatatctggccttaatggcaaccttcaagatgaggcctatgtttgccgtgggcctcctgttccgccggcttacaagtagagaggtcctgctactcactataggtctgtccttggtggcttctgttgaactgccaaacagcttagaggaactcggggatggactggcgatgggcatcatgattcttaaactgttgaccgactttcaatcccaccagctctgggccacgctgctatcactgacattcatcaagaccacttttagccttcattacgcatggaaaaccatggctatggtgctcagtattgtctctctgttccccttgtgtctgtccacaactagccagaagaccacgtggttaccggtactcctgggctcgcttgggtgcaagcctctgacaatgtttttgatcgccgagaataaaatatggggaaggaagtcatggccactcaacgaaggtatcatggccgtgggcattgtttctatcctgctaagttccctgcttaaaaacgatgtgcccctcgctgggcctctgattgcaggaggcatgttgatcgcctgttatgtcataagcggttctagcgcggacttatccctggagaaggctgccgaggtgtcatgggaagaggaagcagagcacagtggggccagccataatattctcgtagaagtgcaggatgacggaaccatgaaaatcaaggatgaggagcgagacgatactctgacaatccttctgaaagctaccttgctagcagtctctggcgtttaccccctgtccattccagccactctcttcctgtggtatttctggcaaaagaagaaacagcgctcaggcgtgctttgggacacacctagtcccccagaagtggagcgggcggtcttagatgacgggatatacagaatcatgcagaggggactgctcggtcgtagccaggtgggcgttggggtatttcaagaaaacgtgttccacaccatgtggcacgtcacgcgcggagctgtgttgatgtatcagggcaagcggctggagccgtcctgggcctctgttaaaaaggacctcatttcgtacggtgggggatggagactgcagggcagctggaatactggcgaggaagtgcaggtcatcgcagtggagcctgggaaaaaccccaagaatgtacaaaccgccccaggaacatttaagacccccgaaggtgaggtcggcgctattgcccttgatttcaaacctgggacatcaggatccccaatcgtgaacagggaaggcaagatagttggtctgtacgggaatggagtggtcactaccagtggcacgtatgtgtctgcaatcgctcaggccaaagcgagccaggagggccccttgcctgagattgaagacgaggtttttcgaaagcggaacctaacaatcatggatctgcatccggggtccggaaaaactcgcagatacctcccagccattgtgagggaagcaatcaagcggaagttacgaaccctgatacttgctcccacaagagtcgtggcctcagagatggctgaagcactgaaaggtatgcctattcgctatcaaaccactgccgtaaagtctgagcacaccggcaaagagatcgtggacctcatgtgccatgccacattcacgatgaggttgctgagcccagttcgtgtccccaattacaacatgatcattatggatgaagctcactttactgaccctagttccatcgcggcacgggggtatataagcaccagagtgggaatgggcgaggccgctgccattttcatgacagcaaccccgcccggttctgtggaagcctttccacagtcaaatgctgtcatccaggatgaggaaagggacattcctgagcgctcctggaacagtgggtacgagtggatcactgatttccccggaaagacagtatggtttgtgccaagcataaaatcgggcaatgacattgcgaactgtctccgaaagaatggcaagagagttatccagctgtctcggaaaaccttcgatacggaatatcaaaagactaaaaacaacgactgggactacgtggtcacaaccgatatctccgagatgggggccaatttcagggcagaccgcgtgattgatcctcgtagatgccttaagcccgttatcctaaaagacggaccagaacgggtgattctggctggtccgatgcctgtcaccgtggccagcgcagcccagaggcgcggccgagtagggagaaaccataataaggagggagatcagtacatatatatgggccagcccttgaacaatgacgaggatcacgctcactggactgaagccaagatgttactggacaacatcaatacaccagagggtattatccccgcgctctttgaacctgagcgggaaaaatcagcagccatcgatggggagtacaggctgcgcggcgaggctagaaagaccttcgtggaacttatgaggcggggagacctgccagtttggctcagttataaagtcgcctctgagggctttcaatactccgatcgtcgctggtgcttcgacggggaacgaaacaatcaggtgttggaggaaaacatggatgtggagatttggacaaaggagggagaaagaaaaaagctgaggccccggtggctagacgctcgcacttatagcgaccctctggcactcagagagtttaaagaattcgccgctggtaggcggtcagtcagtggcgatcttatactggagatcgggaagttaccgcagcatttgacgcagcgagcccaaaatgcactggacaacctcgttatgctgcacaatagcgaacagggaggcagagcgtaccgccatgccatggaggagcttccagataccattgaaacactgatgctcttggctctgatcgccgtgttaactggtggggtaaccctatttttcctgtccggcaggggactcggcaagacatctattgggcttctgtgtgtgatggcaagctccgtcttgctgtggatggcttcagtggagccccactggatcgccgcatctataatcctcgaatttttcctgatggttcttctcattcctgagcccgaccggcagcgtaccccacaggataaccaactggcctatgtggtcatcggattgctgtttatgattttaactgtagctgcgaatgagatgggtctactggaaacgaccaaaaaggacctcggcatcgggcacgtggccgttgagaaccatcaccatgcagctatgcttgatgtggacctgcaccctgccagtgcctggacattgtacgcagtcgctactaccataattacacccatgatgagacataccatcgaaaacactacagccaatatttcgctgacggcgatcgctaaccaggccgcaatactcatgggactggataaaggctggccaatcagcaagatggacattggtgtgcctcttttagccctggggtgctactcccaggtcaatccgctcaccttgactgctgcagtgctgatgctagttgcccactatgcgatcattggccccggactgcaagctaaagccacaagggaggcacagaagcgcaccgccgctggcatcatgaagaacccaaccgtggatgggatagtagccattgacctcgatcctgtggtctacgacgcaaaattcgaaaagcagcttggacagatcatgctgttgatcctgtgtacatctcaaattctcctgatgcggactacgtgggctttatgcgagtcaatcacccttgccacaggccccctgactaccctctgggagggtagcccagggaaattttggaatacaaccatagcggtttccatggccaacattttccgaggaagttatctagcaggcgctggtctggccttctctttgatgaagagcctgggcgggggaagaaggggcactggggcacagggagaaacgctcggcgagaaatggaagcgccagcttaatcagctgtcaaagtccgaatttaacacatacaaacggagtggtatcatggaggtggacagaagcgaagctaaggaggggttgaaacgtggagagaccactaagcacgccgtctctaggggcaccgccaaactgcggtggttcgtggaacgcaatctcgtaaagcctgagggtaaggtgattgatttaggctgtgggcgaggaggctggtcctattactgcgcggggctgaaaaaggttacagaagtgaaaggatatactaagggcggtcccgggcatgaggaaccgatcccaatggctacctacggatggaaccttgtcaaactgcactcaggcaaggacgtgtttttcatacctcccgagaaatgtgatacactactctgcgacatcggcgagagctcgccaaatcccacgattgaagaggggagaaccctgagggtcttgaagatggtggaaccttggctgcggggaaaccaattttgtatcaagattctcaatccgtacatgccctctgttgtagagactcttgagcagatgcagcgcaaacatggtggcatgctggtgagaaacccattaagtaggaattccacacacgaaatgtattgggtcagctgcgggaccggaaacatcgtgtcagcagttaatatgacttcccgaatgctgttgaaccggttcacaatggcccaccgtaagcctacctacgagagagatgtggacctcggcgctggtacgcgccatgtcgccgtggaacccgaggtagcaaacctggatattatcgggcagaggatagaaaatattaaacacgagcataagtctacctggcactatgacgaggataacccttacaaaacatgggcctatcatggaagctacgaagtgaagccaagtggctccgctagctctatggttaatggcgtcgtgaagctacttactaaaccctgggacgtgatccctatggtcacccaaatcgcgatgacagatactaccccatttgggcagcagcgggttttcaaggagaaagtggacacaagaacccccaaggccaaacgcggaactacgcaaattatggaagtaacagcaaggtggctgtggggttttctctcacgaaacaagaagccgcggatatgtaccagagaggaattcactaggaaagtgcgcagtaatgctgccatcggcgcagtctttgtggacgagaaccagtggaattccgccaaggaggctgttgaagatgagcgtttctgggacctggtgcaccgggaaagagagttgcacaaacaggggaagtgcgccacctgcgtctataacatgatgggaaaaagggaaaagaagctgggcgagtttggtaaagcgaaggggagccgcgcaatttggtacatgtggctcggagcccgattccttgagttcgaagctctgggctttatgaatgaggatcattggttctctcgggaaaactcgttatcaggcgtggagggggagggactgcacaaattgggttacatcctcagagacattagcaagatccctggcgggaatatgtatgccgatgacacagcaggatgggatacgaggataaccgaagacgatctgcagaacgaggctaaaatcactgacattatggaaccagagcatgccctacttgctaaggccatctttaaactgacataccaaaataaggtagttcgcgtgcagagacccgcaaagaacggcaccgtcatggatgtgatttcccggagggaccagcgtggtagtgggcaggtgggaacttatggcctcaatacattcaccaacatggaagcgcaactgatccgacagatggagtctgagggcatatttagcccttccgaattggagacaccaaacttagccgaacgcgtcctggattggctcgagaaatacggggttgaaagacttaagcggatggctatttcaggagacgactgtgtggtaaaacccatcgatgacaggttcgccactgcactgaccgctctaaatgatatgggtaaggtgcgcaaagacatcccgcagtgggagcctagtaagggctggaacgattggcagcaagtccccttttgctctcaccacttccatcagctgattatgaaggacgggagagagatagtggttccatgtcggaatcaggatgaactcgtgggaagggcccgagtcagccagggcgcaggttggtccttgcgtgagacggcctgcctggggaaatcatatgcgcaaatgtggcagcttatgtactttcacagacgcgacctgcggctcgctgccaacgcaatctgtagcgccgtgcctgtagattgggttcccacctctaggacaacttggtccattcatgctcaccatcagtggatgaccacagaagacatgttaagtgtgtggaatagagtctggatcgaggaaaacccatggatggaggataagactcacattagctcgtgggaggacgtgccctatctgggaaaacgcgaagaccaatggtgcggctccttgatcggcctgaccgcccgggcaacgtgggctacaaatatacaggttgccatcaaccaggtgaggcgactcattgggaatgagaactaccttgattacatgacctctatgaagagattcaaaaatgaatcagaccctgagggagcgctgtggtga

SEQ ID NO: 14151 - RNA, 9879 nt, synthetic construct
  misc_feature 1..9879: note = derived and/or modified CDS sequence (opt3) from DENV-1__KC762632__SS-prME
  source 1..9879: mol_type = other RNA
agcgtgaccatgctgctcatgcttatgcccacagcactggctttccacttgactacgagaggcggggagcctcatatgatcgtctccaagcaggaaagaggaaagtctttactgtttaagacctcagccggtgttaacatgtgcacactgattgccatggacctcggcgagctgtgtgaagatactcttacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatgcagcgggtggaaacttgggctctgcgccaccctggattcaccgttatcgcactgtttctcgcccatgctattggcacatcgatcacccagaaaggcattatcttcatattactgatgcttgtgacgccatcaatggccatgagatgcgtcgggatcggaagcagggattttgtggagggtttgagtggcgcgacttgggtagacgttgtgctggagcacgggtcctgtgtcacaaccatggcaaaggataagcccactctagacattgaactcctgaaaacagaggtgaccaaccctgccgtgcttcggaagctgtgcatcgaagctaaaatttctaatatcacgaccgatagccgctgtccaacacaaggagaggccactttggtcgaagaacaagacgcaaacttcgtttgccgaagaacctttgtggataggggctggggtaatgggtgtggactcttcggcaagggctccctgataacatgcgctaaatttaagtgcgtaactaagttagaggggaaaattgtgcagtacgaaaacctgaagtattcagtcatcgtgaccgttcacacaggagaccagcatcaagtgggtaatgagagtaccgaacacggcactacggccacaattactccccaagcgcctaccaccgagatccagctcacagactacggggcccttaccctggattgtagcccacggactggattggacttcaacgaaatggtcctactgacaatgaaagagaagtcttggctcgtgcataaacagtggtttctggatcttccgctgccctggacgtccggcgcatcaaccagccaagagacttggaatcgtcaggacttgctcgtaacattcaagaccgctcacgccaaaaagcaggaagttgtggtcctgggtagtcaagagggggctatgcacacagccttaactggcgcaaccgaaatccagacgtctggaaccacaactatttttgccggccatctgaagtgccgcctaaaaatggataagctcaccctgaaagggatgtcctatgtgatgtgtacagggtcgttcaaacttgagaaagaagtcgctgagactcagcacggtaccgtgttggttcagataaagtacgagggcacggacgcgccttgcaagatcccattctcgacacaagatgaaaaaggggtgacccagaacggaagactgattactgcaaatcccatcgtaacagacaaggagaaacctgtcaacatagaagccgagccaccctttggcgagtcttatattgtgatcggtgctggggaaaaggccctcaaactgtcctggttcaagaagggctcaagtatcggaaaaatgtttgaggcaaccgccaggggcgctcggcgaatggccattcttggggatactgcatgggacttcggaagcatcggtggcgtttttacctccgtggggaagctggtccatcagattttcggaacagcgtacggcgtgttgttttctggtgtaagctggacgatgaaaatagggatcggcgtgctcctgacctggttaggactaaattcacgcagtacttccctaagcatgacatgtattgctgttggcctcgtcaccctgtaccttggggtgatggtgcaggccgattctggatgcgtcatcaactggaagggcagagaattgaaatgtggttcagggatcttcgttacaaatgaggtgcacacttggaccgaacaatataagtttcaggcagacagtccgaagaggctgagcgccgctattggaaaagcctgggaggagggcgtgtgcggtatacggtccgcaacgcgcctcgaaaacatcatgtggaagcagatttctaacgagctgaatcatatcttactggaaaacgacatgaaattcacagtagtcgtgggcgatgttgctgggattcttgcccagggaaagaaaatgatcagacctcaacccatggagcacaagtactcgtggaaaagctggggcaaggcgaagataatcggggccgacgtgcagaataccacttttattatcgatggaccaaacacccctgaatgtcccgacgatcagagggcttggaatatttgggaggtcgaggactatggcttcggtatctttacaactaacatatggttgaaactccgtgattcctacacccaggtgtgcgaccaccggctgatgtcagcagccattaaggatagtaaagctgttcatgccgacatggggtattggatcgaatctgagaagaatgaaacatggaaactagcacgagcgagcttcattgaggtgaagacgtgtatctggccaaagtcccacaccctgtggtcaaacggagtactcgaaagcgagatgataatccccaaaatttacggcggtcctatctctcaacataattatagaccaggctacttcactcagacagccgggccgtggcacctgggaaaacttgagttggattttaacctgtgcgaaggcaccactgtcgtggtggacgagcactgcgggaataggggaccctccttacgcacaaccacggtcactggcaaaattatccatgaatggtgttgccggagttgtaccctccctccactgagattcaggggtgaggatgggtgctggtacggaatggagatacgccccgttaaggaaaaagaggaaaaccttgtgaagtccatggtatctgctggctccggtgaggtggactcatttagtctgggcttgctctgtattagcatcatgatcgaagaggtcatgcgatcgcggtggtcccgtaagatgctgatgacagggaccctagccgtgttctttctgctcattatgggacagctgacttggaatgaccttatcagattgtgcattatggttggcgcaaacgcttctgataggatggggatgggaacaacctatctggccttaatggcaacattcaaaatgcgccctatgtttgccgtgggcctcctgttccggagacttactagcagggaggtcctgctactcaccataggtctgtcattggtggctagtgttgaactgccaaattccttagaggaactcggggacggactggcgatgggcatcatgattcttaagctgttgacggattttcaatctcaccagctctgggccacactgctaagcctgaccttcatcaaaactaccttttcccttcattacgcatggaagacaatggctatggtgctctcaattgtcagcctgttccccttgtgtctgagtactacctctcagaaaacgacatggttaccggtactcctgggctcccttgggtgcaagcctctgaccatgtttttgatcgccgagaacaagatatggggacgaaaaagctggccactcaacgaaggtatcatggccgtgggcattgtttcgatcctgctatcatctctgcttaagaatgacgtgcccctcgctgggcctctgattgcaggaggcatgttgatcgcctgttatgtcataagtggttccagcgcggatttatctctggagaaagctgccgaggtgagctgggaagaggaagcagagcactccggggcctcacataacattctcgtagaagtgcaggacgatggaactatgaagatcaaagacgaggagcgcgatgacacactgaccatccttctgaaggctactttgctagcagtcagtggcgtttaccccctgagcattccagccacactcttcgtgtggtatttctggcagaagaagaagcagcggtctggcgtgctgtgggataccccttcacccccagaagtcgagagagcggtgcttgacgatgggatatacaggatcatgcagcgtggattactgggtcgcagccaggttggcgtaggggtgtttcaagaaaatgtcttccacacgatgtggcacgtgactcggggagctgttctcatgtatcagggcaaaagattggagccgagttgggccagcgtgaagaaagacctgatttcctacggtgggggatggaggctccagggctcttggaacaccggcgaggaagtccaggtgatcgcagtagagcctgggaagaatcccaaaaacgtccaaacagccccaggaacctttaagacacccgaaggtgaggtgggcgctattgccctggacttcaagcctgggacttcgggaagcccaatcgttaatcgagaaggcaaaatagtgggtctttacgggaacggagtcgtgaccacgtcaggcacatatgtttccgcaatcgctcaggccaaggcgagtcaggagggccccctgcctgagattgaagatgaggtgtttcggaaacgcaatttgactatcatggacctacatccggggtctggaaagaccagaaggtacctgccagccattgtccgggaagcaatcaaacgaaagctcagaacattaatactggctcccacccgcgtggtagccagcgagatggctgaagcacttaagggtatgcctattaggtatcaaactaccgccgtgaaatccgagcacacaggcaaggagatcgttgatctgatgtgccatgccacgttcactatgcgtctcttgtcaccagtccgggtgcccaactacaatatgatcattatggacgaagctcactttaccgatccttctagcatcgcggcaagagggtatataagtacaagggtgggaatgggcgaggccgctgccattttcatgaccgcaactccgcccggttccgtcgaagcctttccacagagcaacgctgtaatccaggacgaggaacgcgatattcctgagcgatcttggaactcagggtacgagtggatcacagacttccccggaaaaaccgtgtggtttgttccatccataaagagtggcaacgatattgcgaattgtctgaggaagaatggcaagcgggtgatccagctcagcaggaagacgttcgacactgaatatcagaagacaaagaacaatgattgggactacgtcgtgaccaccgacatctcggagatgggggccaacttccgcgcagatcgtgttattgaccctagacggtgcctgaaacccgtgatccttaaggatggaccagaaagggtcattctagctggtccgatgcctgtgactgtagcctctgcagcccagcgccgaggcagagtggggcggaatcataacaaagagggagaccagtacatatatatgggccagcccctgaataacgatgaggaccacgctcactggacagaagccaagatgttgttagataatatcaacaccccagagggtattatccccgcgctgtttgaacctgagagggaaaagtccgcagccatcgacggggagtaccgcctcagaggcgaggctaggaaaacattcgttgaactgatgcggcgtggagatcttccagtctggctgagctataaggtggcctcagagggctttcaatacagtgaccgccgatggtgcttcgatggggaaagaaataaccaggtgctcgaggaaaatatggacgtcgagatttggactaaagagggagaaaggaagaaattgcggccccgctggctggatgctagaacgtattctgaccctctagcactgagggagtttaaggagttcgccgctggtcggcgatccgttagcggcgacctcatacttgagatcgggaaactgccgcagcatttaacccagagagcccaaaacgcattggataatctggtgatgctccacaactcagaacagggaggccgcgcgtacaggcatgccatggaggagctgccagacacaattgaaactcttatgctgctcgctttgatcgccgtactgaccggtggggtgacattatttttcctaagtggccggggactgggcaagaccagcattgggctcctttgtgtcatggcatcctctgtgctgttgtggatggctagcgttgagccccactggatcgccgcatccataatcctggaatttttcctcatggtgctgcttattcctgagcccgatcgtcagagaactccacaggacaatcaactcgcctatgtcgtaatcggactgttgtttatgattctgacggtggctgcgaacgagatgggtttactagaaaccacaaagaaagatctgggcatcgggcacgttgccgtggagaaccatcaccatgcagctatgctcgacgtcgatcttcaccctgcctcagcctggactctgtacgcagtggctaccacaataattacccccatgatgaggcatactatcgaaaatacaacggccaacatttctttgaccgcgatcgctaatcaggccgcaatactgatgggactcgacaagggctggccaatcagtaaaatggatattggtgtccctctgcttgccttagggtgctacagccaggtgaacccgctgactctcacagctgcagttttgatgctggtggcccactatgcgatcattggccccggactacaagctaaggccacccgcgaggcacagaaacggaccgccgctggcatcatgaagaatccaacagtagacgggatagtggccattgatctggaccctgtcgtttacgatgcaaagttcgaaaaacagctcggacagatcatgcttctgatcttgtgtactagccaaattctgctcatgcgaacgacctgggctctgtgcgagtccatcacattagccactggcccccttaccacactgtgggagggttctccagggaagttttggaacaccactatagcggtgtcaatggccaatattttcagaggaagctatctcgcaggcgctggtctagccttctccctgatgaaaagtttgggcgggggaaggcgcggcacgggggcacagggagaaacactgggcgagaagtggaaacggcagctcaaccagctttctaagagcgaatttaatacctacaagagatcaggtatcatggaggtcgaccgttccgaagctaaagaggggctgaagaggggagagactaccaaacacgccgtgagtcggggcacagccaagttgcgctggttcgtagaacgaaacctggtgaaacctgagggtaaggttattgacctcggctgtgggagaggaggctggagctattactgcgcggggttaaagaaagtgactgaagtcaagggatataccaaaggcggtcccgggcatgaggaaccgatcccaatggctacatacggatggaatctggtgaaacttcactctggcaaagatgtctttttcatacctcccgagaagtgtgacacgctgctatgcgatatcggcgagtcctcaccaaaccccaccattgaagaggggaggactctccgggtgctgaaaatggttgaaccttggttgcgcggaaatcaattttgtatcaagattctgaacccgtacatgcccagcgtagtggagacactcgaccagatgcagagaaagcatggtggcatgcttgtcaggaatccactgtcgcgaaactctacccacgagatgtattgggtgagttgcgggactggaaatatcgtttccgcagtgaacatgacaagccggatgttactgaaccgtttcaccatggcccacagaaaacctacgtacgaacgcgatgtcgacttgggcgctggtaccaggcatgtggccgtagagcccgaagtggcaaatctcgatattatcgggcagcggatagagaacattaagcacgaacataaatcaacatggcactatgacgaggataatccttacaagacttgggcctatcatggatcctacgaggttaaaccatctggcagcgctagttccatggtcaacggcgtggtgaagctgctaaccaagccctgggacgtcatccctatggttacacaaatcgcgatgactgataccacaccatttgggcagcagagagtgttcaaagaaaaggtagacacccgcactcccaaagccaagaggggaacgacacaaattatggaggtgaccgcacgatggctttggggttttctgagccggaataaaaagccgagaatatgtactagggaagagttcacccgcaaggtccgttctaacgctgccatcggcgcagtgtttgttgacgaaaatcagtggaactcagccaaagaggctgtggaggatgaacggttctgggacctcgtccacagagagagggaactgcacaagcaggggaaatgcgccacatgcgtgtataatatgatgggaaagcgcgagaaaaagttgggcgaatttggtaaggcgaaagggagtcgagcaatttggtacatgtggctgggagcccggttcctcgagttcgaggctcttggctttatgaacgaagatcattggttctccagagagaatagcctgtctggcgtagaaggggagggattacacaagctgggttacatcttgagggacatttcgaaaatccctggcgggaacatgtatgccgatgacacggcaggatgggatacccgcataactgaggacgatctccagaatgaagctaagatcacagacattatggagccagaacatgccctgctagctaaagccatctttaaacttacctaccaaaacaaagttgtgagagtccagcggcccgcaaagaatggcactgtgatggatgtgatttcaaggcgtgaccagcgaggtagcgggcaggtcggaacatatggcctgaacaccttcacaaacatggaggcgcaactcatccgccagatggaatccgagggcatatttagtccttctgagctggaaactccaaatttggccgagagagttttagattggctggaaaagtacggggtggagcggctcaaaaggatggctattagcggagacgactgtgtagtgaagcccatcgatgaccgcttcgccaccgcacttacggctctgaacgatatgggtaaagtcagaaaggacatcccgcagtgggaaccttccaaaggctggaatgattggcagcaagtgcccttttgctcacaccacttccatcagctaattatgaaggacgggcgggagatagttgtgccatgtaggaaccaggatgagctggtcggacgagcccgtgtgagtcagggcgcaggttggtctctcagagaaaccgcctgcttgggaaagagctatgcgcaaatgtggcagctgatgtactttcaccgccgggaccttaggctggctgccaatgcaatctgttccgccgtacctgttgattgggtgcccacatcaagaactacctggagcattcatgctcaccatcagtggatgacaactgaggacatgctctctgtctggaaccgcgtgtggatcgaagagaatccatggatggaagataaaacccacatttccagttgggaggacgttccctatttaggaaagcgggaggaccaatggtgcggcagcctgatcggcttgacggccagggcaacatgggctaccaacatacaggtggccatcaatcaggtccgaagactgattgggaacgaaaattacctcgattacatgacttcgatgaaacggttcaagaacgagtccgaccctgaaggagcgctttggtga

SEQ ID NO: 14152 - RNA, 9879 nt, synthetic construct
  misc_feature 1..9879: note = derived and/or modified CDS sequence (opt3) from DENV-1__KC762637__SS-prME
  source 1..9879: mol_type = other RNA
agcgtgaccatgctgctcatgcttatgcccacagcactggctttccacttgactacgaggggaggggaacctcatatgatcgtctccaagcaggaaaggggaaaatctttactgtttaagacctcagccggtgttaatatgtgcacattaattgccatggacctcggcgagctgtgtgaagatactcttacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaagcagagattttgtggagggtttgagtggcgcgacttgggtagacgttgtgctggagcacgggtcctgtgtcacaaccatggcaaaggataaacccactctggacatcgaactcctgaagacagaggtgaccaaccctgccgtgcttaggaaactgtgcattgaagctaagatctctaatacgaccacagatagccggtgtccaactcaaggagaggccaccttggtcgaagaacaggacgcaaacttcgtttgccgccgaacatttgtggatagaggctggggtaatgggtgtggactcttcggcaaaggctccctgataacttgcgctaagtttaagtgcgtaaccaaattagaggggaagattgtgcagtacgaaaacctgaaatattcagtcatcgtgacagttcacaccggagaccagcatcaagtgggtaatgagagtactgaacacggcacgacagccaccattactccccaggcgcctaccacagagatccagctcaccgactacggggcccttactctggattgtagcccaaggacaggattggacttcaacgaaatggtcctactgacgatgaaggagaaatcttggctcgtgcataagcagtggtttctggatcttccgctgccctggacctccggcgcatcaactagccaagagacatggaatcggcaggacttgctcgtaaccttcaaaacagctcacgccaagaagcaggaagttgtggtcctgggtagtcaagagggggctatgcacactgccttaaccggcgcaacggaaatccagacctctggaacaactaccatttttgccggccatctgaaatgccgtctaaagatggataaactcacactgaaggggatgtcctatgtgatgtgtactggatcgttcaaacttgagaaggaagtcgctgagacccagcacggtacggtgttggttcagataaagtacgagggcacagacgcgccttgcaaaatcccattctcgacccaagatgaaaagggggtgactcagaacggacgcctgattacagcaaatcccatcgtaaccgacaaagagaagcctgtcaacatagaagccgagccaccctttggcgagtcttatattgtgatcggtgctggggaaaaagccctcaagctgtcctggttcaagaaaggctcaagtatcggaaagatgtttgaggcaactgccagaggcgctaggcggatggccattcttggggataccgcatgggacttcggaagcatcggtggcgtttttacatccgtggggaaactggtccatcagattttcggaacggcgtacggcgtgttgttttctggtgtaagctggaccatgaagatagggatcggcgtgctcctgacttggttaggactaaattcacgaagtacatccctaagcatgacctgtattgctgttggcctcgtcacactgtaccttggggtgatggtgcaggccgattctggatgcgtcatcaactggaaaggccgcgaattgaagtgtggttcagggatcttcgttactaatgaggtgcacacctggacggaacaatataagtttcaggcagacagtccgaaaagactgagcgccgctattggaaaggcctgggaggagggcgtgtgcggtataaggtccgcaacacggctcgaaaacatcatgtggaaacagatttctaacgagctgaatcatatcttactggaaaacgacatgaagttcaccgtagtcgtgggcgatgttgctgggattcttgcccagggcaaaaagatgatccgccctcaacccatggagcacaaatactcgtggaaaagctggggcaaggcgaaaataatcggggccgacgtgcagaatactacctttattatcgatggaccaaacacacctgaatgtcccgacgatcagagagcttggaatatttgggaggtcgaggactatggcttcggtatctttactaccaacatatggttgaagctcagggattcctacacacaggtgtgcgaccaccgtctgatgtcagcagccattaaagatagtaaggctgttcatgccgacatggggtattggatcgaatctgagaaaaatgaaacgtggaagctagcacgggcgagcttcattgaggtgaagacctgtatctggccaaaatcccacactctgtggtcaaacggagtactcgaaagcgagatgataatccccaagatttacggcggtcctatctctcaacataattatcgaccaggctacttcacacagaccgccgggccgtggcacctgggaaaacttgagttggattttgacctgtgcgaaggcactacagtcgtggtggatgagcactgcgggaacagaggaccctccttaaggaccacgactgtcaccggcaagattatccatgaatggtgttgccgcagttgtacactccctccactgcggttcagaggtgaggacgggtgctggtacggaatggagataaggcccgttaaagaaaaggaggaaaatcttgtgaagtccatggtatctgctggctccggtgaggtggactcatttagtctgggcttgctctgtattagcatcatgatcgaagaggtcatgcgctcgcgatggtcccggaaaatgctgatgaccgggactctagccgtgttctttctgctcattatgggacagctgacatggaacgatcttatccgtttgtgcattatggttggcgcaaatgcttctgacagaatggggatgggaaccacatatctggccttaatggcaactttcaagatgaggcctatgtttgccgtgggcctcctgttccgccggcttaccagcagagaggtcctgctactcacgataggtctgtcattggtggctagtgttgaactgccaaactccttagaggaactcggggatggactggcgatgggcatcatgattcttaaactgttgacagactttcaatctcaccagctctgggccaccctgctaagcctgactttcatcaagaccacattttcccttcattacgcatggaaaactatggctatggtgctctcaattgtcagcctgttccccttgtgtctgagtaccacgtctcagaagacaacctggttaccggtactcctgggctcccttgggtgcaagcctctgactatgtttttgatcgccgagaataaaatatggggaagaaagagctggccactcaacgaaggtatcatggccgtgggcattgtttcgatcctgctatcatctctgcttaaaaacgatgtgcccctcgctgggcctctgattgcaggaggcatgttgatcgcctgttatgtcataagtggttccagcgcggacttatctctggagaaggctgccgaggtgagctgggaagaggaagcagagcactccggggcctcacataatattctcgtagaagtgcaggatgacggaacaatgaaaatcaaggatgaggagcgagacgataccctgactatccttctgaaagctacattgctagcagtcagtggcgtttaccccctgagcattccagccaccctcttcgtgtggtatttctggcaaaagaagaaacagcgctctggcgtgctgtgggacacgccttcacccccagaagtcgagcgggcggtgcttgatgacgggatatacagaatcatgcagaggggattactgggtcgtagccaggttggcgtaggggtgtttcaagaaaacgtcttccacactatgtggcacgtgacccgcggagctgttctcatgtatcagggcaagcggttggagccgagttgggccagcgtgaaaaaggacctgatttcctacggtgggggatggagactccagggctcttggaatacaggcgaggaagtccaggtgatcgcagtagagcctgggaaaaaccccaagaatgtccaaaccgccccaggaacatttaagactcccgaaggtgaggtgggcgctattgccctggatttcaaacctgggacctcgggaagcccaatcgttaacagggaaggcaagatagtgggtctttacgggaatggagtcgtgacgacatcaggcacttatgtttccgcaatcgctcaggccaaagcgagtcaggagggccccctgcctgagattgaagacgaggtgtttcgaaagcggaacttgaccatcatggatctacatccggggtctggaaaaacacgcagatacctgccagccattgtcagggaagcaatcaagcggaagctccgaaccttaatactggctcccactagagtggtagccagcgagatggctgaagcacttaaaggtatgcctattcgctatcaaaccacagccgtgaagtccgagcacacgggcaaagagatcgttgacctgatgtgccatgccactttcaccatgaggctcttgtcaccagtccgtgtgcccaattacaacatgatcattatggatgaagctcactttacagacccttctagcatcgcggcacgggggtatataagtaccagagtgggaatgggcgaggccgctgccattttcatgactgcaacaccgcccggttccgtcgaagcctttccacagagcaatgctgtaatccaggatgaggaaagggacattcctgagcgctcttggaactcagggtacgagtggatcaccgatttccccggaaagacggtgtggtttgttccatccataaaaagtggcaatgacattgcgaactgtctgcgaaagaatggcaagagagtgatccagctcagccggaaaactttcgatacagaatatcaaaagaccaaaaacaacgactgggactacgtcgtgaccactgatatctcggagatgggggccaatttcagggcagaccgcgttattgatcctcgtagatgcctgaagcccgtgatccttaaagacggaccagaacgggtcattctagctggtccgatgcctgtgacagtagcctctgcagcccagaggcgcggccgagtggggagaaaccataataaggagggagatcagtacatatatatgggccagcccctgaacaatgacgaggatcacgctcactggaccgaagccaagatgttgttagacaacatcaatacaccagagggtattatccccgcgctgtttgaacctgagcgggaaaaatccgcagccatcgatggggagtacaggctccgcggcgaggctagaaagactttcgttgaactgatgaggcggggagaccttccagtctggctgagctataaagtggcctcagagggctttcaatacagtgatcgtcgctggtgcttcgacggggaacgaaacaatcaggtgctcgaggaaaacatggatgtcgagatttggacgaaggagggagaaaggaaaaagttgaggccccggtggctggacgctcgcacctattctgaccctctagcactgagagagtttaaagagttcgccgctggtaggcggtccgttagcggcgatctcatacttgagatcgggaagctgccgcagcatttaacacagcgagcccaaaatgcattggacaacctggtgatgctccacaattcagaacagggaggcagagcgtaccgccatgccatggaggagctgccagatactattgaaacccttatgctgctcgctttgatcgccgtactgacaggtggggtgaccttatttttcctaagtggcaggggactgggcaagactagcattgggctcctttgtgtcatggcatcctctgtgctgttgtggatggctagcgttgagccccactggatcgccgcatccataatcctggaatttttcctcatggtgctgcttattcctgagcccgaccggcagcgtacgccacaggataaccaactcgcctatgtcgtaatcggactgttgtttatgattctgaccgtggctgcgaatgagatgggtttactagaaacaactaaaaaggacctgggcatcgggcacgttgccgtggagaaccatcaccatgcagctatgctcgatgtcgaccttcaccctgcctcagcctggaccctgtacgcagtggctacaaccataattactcccatgatgagacatacaatcgaaaacacgaccgccaatatttctttgactgcgatcgctaaccaggccgcaatactgatgggactcgataaaggctggccaatcagtaagatggacattggtgtccctctgcttgccttagggtgctacagccaggtgaatccgctgacactcaccgctgcagttttgatgctggtggcccactatgcgatcattggccccggactacaagctaaagccaccagggaggcacagaagcgcacagccgctggcatcatgaagaacccaactgtagatgggatagtggccattgacctggatcctgtcgtttacgacgcaaaattcgaaaagcagctcggacagatcatgcttctgatcttgtgtacgagccaaattctgctcatgcggaccacatgggctctgtgcgagtccatcactttagccaccggcccccttacaaccctgtgggagggttctccagggaaattttggaatactacgatagcggtgtcaatggccaacattttccgaggaagctatctcgcaggcgctggtctagccttctccctgatgaagagtttgggcgggggaagaaggggcacaggggcacagggagaaaccctgggcgagaaatggaagcgccagctcaatcagctttctaagagcgaatttaacacttacaaacggtcaggtatcatggaggtcgacagatccgaagctaaggaggggctgaaacgtggagagaccacaaagcacgccgtgagtaggggcactgccaaattgcggtggttcgtagaacgcaatctggtgaagcctgagggtaaggttattgatctcggctgtgggcgaggaggctggagctattactgcgcggggctaaagaaggtgaccgaagtcaaaggatatacaaagggcggtcccgggcatgaggaaccgatcccaatggctacgtacggatggaacctggtgaaacttcactctggcaaggacgtctttttcatacctcccgagaaatgtgataccctgctatgcgacatcggcgagtcctcaccaaatcccactattgaagaggggagaacactcagggtgctgaagatggttgaaccttggttgcggggaaaccaattttgtatcaagattctgaatccgtacatgcccagcgtagtggagaccctcgagcagatgcagcgcaaacatggtggcatgcttgtcagaaacccactgtcgagaaattctactcacgaaatgtattgggtgagttgcgggacaggaaacatcgtttccgcagtgaatatgaccagccgaatgttactgaaccggttcacgatggcccaccgtaagcctacctacgagagagatgtcgacttgggcgctggtacacgccatgtggccgtagaacccgaggtggcaaacctcgatattatcgggcagaggatagaaaatattaaacacgagcataagtcaacttggcactatgacgaggataacccttacaaaacctgggcctatcatggatcctacgaagttaagccatctggcagcgctagttccatggtcaatggcgtggtgaagctgctaacaaaaccctgggacgtcatccctatggttactcaaatcgcgatgaccgatacaaccccatttgggcagcagcgggtgttcaaggagaaagtagacactagaacgcccaaggccaaacgcggaacaacccaaattatggaagtgactgcaaggtggctttggggttttctgagccgaaacaagaagccgcggatatgtaccagagaggagttcacaaggaaagtccgctctaatgctgccatcggcgcagtgtttgttgacgagaaccagtggaactcagccaaggaggctgtggaagatgagcgtttctgggacctcgtccaccgggaaagagagctgcacaaacaggggaagtgcgccacgtgcgtgtataacatgatgggaaaaagggaaaagaagttgggcgagtttggtaaagcgaaggggagtcgcgcaatttggtacatgtggctgggagcccgattcctcgagttcgaagctcttggctttatgaatgaggatcattggttctcccgggaaaacagcctgtctggcgtagagggggagggattacacaaactgggttacatcttgagagacatttcgaagatccctggcgggaatatgtatgccgatgacaccgcaggatgggatactaggataacagaagacgatctccagaacgaggctaaaatcaccgacattatggaaccagagcatgccctgctagctaaggccatctttaaacttacttaccaaaataaggttgtgcgcgtccagagacccgcaaagaacggcacagtgatggatgtgatttcacggagggaccagcgtggtagcgggcaggtcggaacctatggcctgaatacattcactaacatggaagcgcaactcatccgacagatggagtccgagggcatatttagtccttctgaactggagaccccaaacttggccgaacgcgttttagattggctggagaaatacggggtggaaagactcaagcggatggctattagcggagacgactgtgtagtgaaacccatcgatgacaggttcgccacggcacttaccgctctgaatgatatgggtaaggtccgcaaagacatcccgcagtgggagccttccaagggctggaacgattggcagcaagtgcccttttgctcacaccacttccatcagctaattatgaaggacgggagagagatagttgtgccatgtcggaatcaggatgaactggtcggaagggcccgagtgagtcagggcgcaggttggtctctccgtgagacagcctgcttggggaaaagctatgcgcaaatgtggcagctgatgtactttcacagacgcgaccttcggctggctgccaacgcaatctgttccgccgtacctgttgattgggtgcccacttcaaggaccacatggagcattcatgctcaccatcagtggatgactaccgaagacatgctctctgtctggaatagagtgtggatcgaggaaaacccatggatggaggataagacgcacatttccagttgggaggacgttccctatttaggaaaacgcgaagaccaatggtgcggcagcctgatcggcttgacagcccgggcaacctgggctactaatatacaggtggccatcaaccaggtcaggcgactgattgggaatgagaactacctcgattacatgacatcgatgaagagattcaaaaatgaatccgaccctgagggagcgctttggtga

SEQ ID NO: 14153 - RNA, 9879 nt, synthetic construct
  misc_feature 1..9879: note = derived and/or modified CDS sequence (opt3) from DENV-1__KC762620__SS-prME
  source 1..9879: mol_type = other RNA
agcgtgaccatgctgttcatgctccttcccacagccctggcttttcacttgactacgagaggaggggaacctcatatgatcgtctccaagcaggaaagaggaaaatctttactgttcaagacctcagccggtgttaacatgtgcacactaattgccatggacctcggcgaactgtgtgaagatactatgacctacaaatgcccacggataacagagaccgaaccggacgatgtggactgttggtgcaatgcgactgagacatgggtgacctatgggacgtgtagtcaaactggagagcaccgccgagataagcgtagcgtggctcttgcaccccatgtcggcctgggtttggaaaccagaacagagacttggatgtcctctgaaggggcatggaaacagatccagaaggtggagacctgggccctcaggcaccctggatttacagttattgctctgttcctggcacatgccatcggcacctcgattacgcagaagggcatcatatttatcctcttaatgctggtgactccatcaatggctatgcggtgcgtcgggattggaaaccgcgacttcgtggagggtcttagcggcgccacatgggtagatgttgtgttggaacacgggagttgtgtcaccactatggcgaaagacaagcccacactggatatcgagctactcaaaaccgaagtgacgaatcctgcagtgctgcggaaactttgcattgaggccaaaatctccaacaccacaactgactctaggtgtccaacccaaggagaagctacactggtcgaggagcaggatactaattttgtttgccggcgcaccttcgtggaccgaggctggggtaacgggtgtggattgtttggcaagggcagcctcataacatgcgccaagttcaaatgcgtaaccaagctggaagggaaaattgtgcagtacgagaatttaaagtattccgtcatcgtgactgttcacacgggagatcagcatcaagtgggtaacgaaacaattgagcacggcaccactgcaaccatcacaccccaggctcctacctcagaaatccagctgactgactacggggccctcacacttgactgtagtccaagaacgggactggattttaatgagatggtcttgctaaccatgaaagaaaagagctggctggtgcataaacagtggttcctcgacctgccgcttccctggacttctggcgcgtccacatcacaagaaacctggaacaggcaggatctgttggtaacatttaagactgcccacgcaaagaaacaggaggttgtggtcctcggtagccaagaaggggctatgcacaccgccctgacgggcgctaccgagattcagacaagtggaactaccacaatattcgccggccatttaaagtgccggctgaaaatggacaagctaactctcaaaggggtgtcttatgtcatgtgtaccggatccttcaagctggaaaaggaggtggcagagacgcagcacggtacagttcttgtgcaggtaaaatacgaaggcaccgatgccccttgcaagatcccatttagctcgcaagacgagcgtggggtcattcagaatggacgcttgatcactgctaaccccatagtgacagataaagaaaagcctgttaatattgaggcggagccacccttcggcgaatcttatatcgtggtcggtgcaggggagaaagccctgaagctctcctggtttaagaaaggctcaagtatcggaaagatgttcgaagctaccgccagaggcgcaaggcggatggccattctgggggacactgcttgggattttggaagcatcggtggcgtgttcacctccgtagggaaacttgtgcatcagatttttggaacagcctacggcgttctgttctctggtgtcagctggacgatgaagatagggatcggcattttgctcacctggctgggattaaactcacgaaatacaagtctgtccatgacatgtatcgcagtgggcatggtgaccctatacctcggggtcatggttcaggcggacagcggatgcgtgatcaactggaaaggccgcgagctgaagtgtggttctgggatttttgtgacaaacgaagtacacacttggaccgagcaatataagttccaggctgattcaccgaaaagacttagtgccgcaataggaaaggcctgggaggaaggcgtctgcggtatcaggagcgctacgcggttggagaatattatgtggaaacagatctccaacgaactgaatcatattctcctggagaacgacatgaagtttacagtggttgtgggcgacgtctctgggatcttagcccagggcaagaagatgatacgccctcaacccatggaacacaaatactcgtggaagtcctggggcaaggcaaaaatcattggggctgatgtgcagaataccactttcatcattgacggaccaaacacccctgagtgtcccgataatcagagagcctggaacatctgggaggttgaagactatggctttggtgtgttcacaactaatatatggctgaaacttagggattcctacacccaggtatgcgaccaccgtttgatgtcagcggccattaaagatagtaaggctgtccatgcagacatggggtattggatcgagtctgagaagaatgagacatggaagctcgaacgggccagcttcattgaggtgaagacgtgtatctggccacgatcccacaccctgtggtcaaatggagtgctagagagcgaaatgataatccccaaaacttacggcggtcctgtctctcaacataactatagaccaggctactttacacagaccgctgggccgtggcacctgggaaagctcgagctggatttcgacctttgcgaaggcactacagttgtggtagatgagaattgcgggaacaggggaccctccttgcgcaccacgactgtgaccggcaaaattatccacgagtggtgttgccggagttgtacactgcctccattaagatttaagggtgaagacgggtgctggtacggaatggagattaggcccgtcaaagaaaaggaggaaaatctcgtaaagagcatggtttctgccggctccggtgaggtggattcattcagtctgggccttctgtgtatcagcataatgattgaggaagtcatgcgctcgcgatggtccgggaaaatgttgatgaccggaactctcgcagtgtttctgctactgacaatgggccagctcacctggaacgacctgatccggctttgcatcatggttggggcgaacgcctctgacatgatgggaatgggcacaacttatttggctctgatggccaccttccgtatgagacctatgtttgcagtgggtttactcttcaggcgcctgacgagccgggaggtccttctgctaacagtagggctctcactggctgccagtgtggaattgccaaattccctggaggaattaggagatggcctcgcaatgggcattatgatgctgaaacttctgaccgactttcaatctcatcagttgtgggccactctcctgagcctaaccttcgttaaaacaactttttccctgcactacgcttggaagaccatggcgatgatcctttcaattgtgagcctcttccccctgtgtttgagtacgacatctcagaaaaccacttggctgccggtcttactcgggtccctgggatgcaagcctcttacaatgctgttgataaccgagaacaagatctggggtagaaggagctggccaattaatgagggcatcatggccattgggatcgtgtcgatactcctgtcatctctactgaaaaacgatgtaccccttgcaggacctctcatcgctggcggtatgctgattgcctgttatgtgatcagtgggtccagcgccgacttgtctttagaaaaggctgcagaggtcagctgggaagatgaggccgaacattccggagcgtcacacaatattctggttgaggtgcaggacgatggcactatgaaaatcaaggacgaggaacgagatgacacactcaccatactgcttaaagctacgctgttggccattagtggcgtgtaccccatgagcatcccagcaactctatttgtctggtatttctggcaaaagaaaaagcagcgctctggggtgctgtgggataccccttcacccccagaggttgaacgggccgtactcgacgatggaatctaccggattctgcagaggggtcttttaggccgtagccaggtgggggtcggagtgttccaagagggcgtttttcatacaatgtggcacgtgacccgcggtgctgtcctgatgtatcaggggaagcggctcgagccgagttgggcaagcgtgaaaaaggacttgatatcctacggaggcggctggagattccaggggtcttggaacacaggagaagaggtacaggtcatcgccgtggaacctggtaaaaatcccaagaacgttcaaactaccccaggcacgtttaaaacatcggagggggaagtgggagcgattgctctggacttcaagcccggcactagcggttcacctatcgtcaatagggaggggaagattgtgggactctacggcaacggcgttgtgaccacatccgggacctatgtcagtgccatcgcacaggccaaggcttctcaggagggaccactgcccgaaatagaggatgaagtgtttcgaaagcggaatcttactatcatggacctgcaccctggtagcggcaaaacccgcagatacttgccggccattctaagggaggcaatcaagcggaaactgcgaacactcgtattagctccaacgagagtggttgcctccgaaatggcggaggccctgaaggggatgcccattcgctatcaaactaccgcagtcaagtcagagcatacaggaaaagaaatcgtggatcttatgtgccacgctaccttcactatgaggctgctctctcctgtgcgtgtcccaaactacaatatgataattatggacgaggcccattttacagatcccgctagcatcgcagcccggggctatatcagtaccagagtaggtatgggggaagccgctgcgattttcatgacggcaactcctccgggatccgtggaggcctttccccagagcaacgctgttatccaggacgaagagagggatataccagagcgctcttggaactcaggctacgactggattacagatttccctggcaagaccgtgtggtttgtcccctccatcaaaagtgggaacgacattgccaactgtttgcgaaagaatggaaaaagagtggttcagctgagccggaagaccttcgatactgaatatcaaaagactaagaacaatgactgggactacgtggtcaccacagatatctcggagatgggtgcaaacttcagggccgaccgcgtgatagatccacgtagatgcctcaagcctgtaattctgaaagacggccccgaacgggtgatccttgctgggccaatgccggttactgtcgcgtctgccgcacagaggcgcggacgaatcggcagaaattccaacaaggagggtgatcagtacgtgtatatggggcagcctctaaataacgacgaggatcacgctcattggacggaagccaaaatgctgttggacaatattaacacccccgagggcatcattccagcattatttgaacccgagcgggaaaagagcgccgctatagatggagagtacaggctgcgcggcgaggccagaaagacattcgtggaactcatgaggagaggggacctgcctgtctggctttcatataaagttgcgagtgagggatttcaatactctgatcgtcgctggtgcttcgacggtgaacgaaataaccaggtgctggaggaaaatatggatgtagagatctggactaaggagggcgaaaggaagaagctcaggccacggtggttggacgcacgcacctattccgaccccctggccctaagagagtttaaagagttcgctgccgggaggcggagcgtgtcaggagatctgattctcgagatcggcaaacttcctcagcacctgacacagaaagctcaaaacgcattagacaatttggtcatgctgcacaacagtgaacagggtgggaaggcctaccgacatgctatggaggagctcccggataccatcgaaactctgatgcttctggccctcattgcagtgttgacgggcggagttaccctgtttttcttaagcggcagagggctaggaaagacatccataggtctgctctgtgtgatggcgtctagcgcccttctgtggatggcttccgtcgagccacactggatcgccgcatcaattatcttggaatttttcctgatggtactcctgattcccgagcctgaccgccagaggactccccaggataaccaacttgcttatgtggttatcggcctcctgtttatgatattgaccgtggccgcaaatgagatggggctgttagaaacaaccaaaaaggacctaggaatcggccatgccgctgcggagaaccaccaccatgccgcaatgctggatgtcgacctccacccagcttctgcctggactctttacgccgtggcaacaacgattatcacccctatgatgcggcatactattgaaaatacaaccgctaacatcagtctgaccgccatagcgaatcaggctgccattttgatgggtctggataaagggtggcccatctcgaagatggacattggcgtcccactcctggcacttggatgctacagccaggtgaaccctttaacactgactgccgctgttctcatgttggtggcacactatgccatcataggcccggggctgcaagcgaaagctacgcgtgaggcccagaagagaaccgcagccggaatcatgaagaatcccacagtagatggcattgtggctatcgacctagatccagtcgtttacgacgccaaattcgaaaagcagctgggtcagattatgctccttatcctgtgtacttcccaaatattgctgatgaggaccacatgggcactctgcgagtctattaccctggctactgggcctttaacgacactttgggagggatcacccggcaaattttggaacaccactatcgccgtgagcatggcgaatatcttccgcggttcctatctggccggcgcagggctcgctttcagtctaatgaagtctctgggaggcgggcggcgaggaaccggcgcccagggtgaaacattgggggagaaatggaagagacagctgaaccagctcagcaagtcagaatttaatatttacaaaaggtccggaatcatggaggtcgaccgcagtgaagcaaaggagggccttaaacggggtgagactaccaagcatgctgtgagcagaggcacagccaaactgcgttggttcgtagaaaggaacttggtgaagccagaggggaaggttatagatctgggatgtggcagagggggatggtcttattactgcgccggcctcaaaaaggtgacggaagtcaaaggttataccaaagggggacctggccacgaggaacccgtgccgatggcgacttacggctggaatttagtcaaactgcactccgggaaggacgtgtttttcacaccacctgagaaatgtgatacccttctgtgcgacattggagagtcaagccccaacccaactatcgaagagggtcgcacactacgagttctcaagatggtagaaccctggctgagaggcaatcaattttgtattaagatcttgaacccttacatgccgtcggtggtcgagaccctggagcagatgcagaggaaacatgggggaatgctcgtgcggaatcccctttctcgcaacagtacgcacgaaatgtattgggtttcctgcggcaccggtaacatagtgagcgctgtcaatatgacatcaagaatgctgttaaacaggttcactatggcacatcgaaagccaacctacgagaaagatgtggacctgggggccggaacacggcacgtagctgtggaacctgaggttgccaatttggatatcattggccagcgtatcgaaaacattaagaatgagcacaaatccacttggcattatgacgaggataacccctacaagacctgggcatatcacggctcttacgaagtcaagcctagcgggagtgcctccagcatggtgaatggagtggtcagactcctgacaaaaccatgggacgttatccccatggtgacccaaattgctatgactgatacgacaccttttggtcagcagcgcgtattcaaggagaaagtggacaccaggactccaaaggcgaaacggggcaccgcccaaatcatggaagtcacagcaaagtggctatgggggtttctttctagaaacaagaaaccccgcatatgtacgagggaggagttcacccgaaaggtgcggtcaaatgctgccattggagcagtttttgtggacgagaaccagtggaatagtgccaaagaggctgtcgaagatgagagattctgggacctggtgcatagggaacgcgagctccacaagcagggcaaatgcgccacttgcgtatataacatgatgggtaagcgtgaaaagaaactgggggagtttggaaaggcgaaaggctcccgggcaatctggtacatgtggttgggcgccagattcctggagttcgaagctctcgggtttatgaatgaggatcattggttcagcagggaaaactctctttcgggagttgagggtgagggcctgcacaagttagggtacatcctgcgcgacatttcaaaaataccgggaggcaatttgtatgccgatgacacagcaggttgggatacccgaatcactgaagacgatctccagaacgaggctaagattacagacatcatggaacctgagcacgccctgctagctaccagcatttttaaacttacataccaaaacaaggtggtccgggtgcagagaccagccaagaatgggactgtgatggatgtcatctccaggcgcgaccagagaggaagtggccaggttggcacctatgggctgaacacgttcaccaatatggaagcacaactcatacggcagatggagtctgagggaatctttagcccctccgaactggagacacctaacttggcgaaaagggtgttagattggctggaaaagcatggtattgagcgtctcaaacgaatggccatctcaggcgacgactgtgtagtgaagccaattgatgaccgcttcgctactgcccttaccgcactgaatgatatggggaaagtcagaaaggacatcccccagtgggaaccgagtaagggatggaacgattggcagcaagtgcctttttgctctcaccatttccaccagctaataatgaaagacggccgggagattgttgtgccctgtaggaatcaggatgagctgatcggtcgcgctagagtcagccagggggccggatggtccctccgggaaacagcatgcttgggcaagtcatacgcccaaatgtggcagctgatgtattttcacaggcgagaccttcgtctggcggctaacgccatctgtagcgcagtgccagtagattgggttcctacttctagaaccacgtggtccattcatgcccaccatcagtggatgacaaccgaggacatgctcagtgtgtggaatcgcgtctggatagaagagaacccctggatggaagataaaactcacgtgagctcgtgggaggacgttccatacttaggcaagcgggaggaccaatggtgcgggtccctgatcggattgacagctagggccacctgggcatctaatattcaggtggctatcaaccaggtcagacgcctgattggtaatgaaaactatctcgattacatgacttcaatgaaacggttcaagaatgagagcgaccccgaaggcgccctttggtga

SEQ ID NO: 14154 - RNA, 9879 nt, synthetic construct
  misc_feature 1..9879: note = derived and/or modified CDS sequence (opt3) from DENV-1__KC762631__SS-prME
  source 1..9879: mol_type = other RNA
agcgtgaccatgctgctcatgcttatgcccaccgccctggctttccacttgactacgaggggaggggagcctcatatgaccgtctccaagcaggaaaggggaaaatctttactgtttaagacgtcagccggtgttaatatgtgcactctgatcgccatggacctcggcgagctgtgtgaagatacccttacgtacaaatgcccacggattaccgaggcggaaccggacgatgtggactgttggtgcaatgctactgatacatgggtaacctatgggacgtgtagtcaaactggagagcaccgccgagacaagcgtagcgtggccctggcaccccatgtcggcttgggtctcgagaccagaacagaaacttggatgtcctctgagggggcctggaaacagatccagagggtggaaacctgggctctgcggcaccctggattcacagttatcgcactgtttctcgcccatgctattggcacctcgatcacgcagaagggcattatcttcatattactgatgcttgtgactccatcaatggccatgcgctgcgtcgggatcggaagcagagattttgtggagggtttgagtggcgcgacatgggtagacgttgtgctggagcacgggtcctgtgtcaccactatggcaaaggataaacccacactagacattgaactcctgaagaccgaggtgacgaaccctgccgtgcttaggaaactgtgcatcgaagctaagatttctaataccacaactgatagccggtgtccaacccaaggagaggccacattggtcgaagaacaggacgcaaacttcgtttgccgccgaacttttgtggatagaggctggggtaatgggtgtggactcttcggcaaaggctccctgataacctgcgctaagtttaagtgcgtaacaaaattagaggggaagatagtgcagtacgaaaacctgaaatattcagtcattgtgaccgttcacactggagaccagcatcaagtgggtaatgagagtacggaacacggcacaaccgccactatcacaccccaggcgcctacaaccgagattcagctcactgactacggggcccttacactggattgtagcccaaggacgggattggacttcaacgaaatggtcctactgaccatgaaggagaaatcttggctcgtgcataagcagtggtttctggatcttccgctgccctggacttccggcgcatcaacaagccaagagacctggaatcggcaggacttgctcgtaacattcaaaactgctcacgccaagaagcaggaagttgtggtcctgggtagtcaagagggggctatgcacaccgccttaacgggcgcaaccgaaatccagacatctggaactaccacaatctttgccggccatctgaaatgccgtctaaagatggataaactcactctgaaggggatgtcctatgtgatgtgtaccgggagcttcaaacttgagaaggaagtcgctgagacgcagcacggtacagtgttggttcagattaagtacgagggcaccgacgcgccttgcaaaataccattctcgactcaagatgaaaagggggtgacacagaacggacgcctgatcaccgcaaatcccattgtaactgacaaagagaagcctgtcaacatcgaagccgagccaccctttggcgagtcttatatagtgattggtgctggggaaaaagccctcaagctgtcctggttcaagaaaggctcaagtatcggaaagatgtttgaggcaaccgccagaggcgctaggcggatggccatccttggggatacagcatgggacttcggaagcattggtggcgtttttacgtccgtggggaaactggtccatcagatcttcggaaccgcgtacggcgtgttgttttctggtgtaagctggactatgaagattgggataggcgtgctcctgacatggttaggactaaattcacgaagtacctccctaagcatgacatgtatcgctgttggcctcgtcactctgtaccttggggtgatggtgcaggccgattctggatgcgtcattaactggaaaggccgcgaattgaagtgtggttcagggatcttcgttaccaatgaggtgcacacgtggacagaacaatataagtttcaggcagacagtccgaaaagactgagcgccgctatcggaaaggcctgggaggagggcgtgtgcggtattaggtccgcaacccggctcgaaaacataatgtggaaacagatctctaacgagctgaatcatattttactggaaaacgacatgaagttcactgtagtcgtgggcgatgttgctgggatccttgcccagggcaagaagatgattcgccctcaacccatggagcacaaatactcgtggaaaagctggggcaaggcgaagatcataggggccgacgtgcagaataccacatttatcattgatggaccaaacactcctgaatgtcccgacgatcagagagcttggaatatctgggaggtcgaggactatggcttcggtatttttaccacaaacatctggttgaagctcagggattcctacacacaggtgtgcgaccaccgtctgatgtcagcagccataaaagatagtaaggctgttcatgccgacatggggtattggattgaatctgagaaaaatgaaacctggaagctagcacgggcgagcttcatcgaggtgaagacttgtatttggccaaaatcccacacactgtggtcaaacggagtactcgaaagcgagatgatcatacccaagatctacggcggtcctatttctcaacataattatcgaccaggctacttcacccagactgccgggccgtggcacctgggaaaacttgagttggattttgacctgtgcgaaggcacaaccgtcgtggtggatgagcactgcgggaacagaggaccctccttaaggacgactaccgtcacaggcaagatcattcatgaatggtgttgccgcagttgtaccctccctccactgcggttcagaggtgaggacgggtgctggtacggaatggagatcaggcccgttaaagaaaaggaggaaaatcttgtgaagtccatggtatctgctggctccggtgaggtggactcatttagtctgggcttgctctgtataagcattatgatcgaagaggtcatgcgctcgcgatggtcccggaaaatgctgatgactgggacactagccgtgttctttctgctcatcatgggacagctgacctggaacgatcttattcgtttgtgcatcatggttggcgcaaatgcttctgacagaatggggatgggaacaacttatctggccttaatggcaaccttcaagatgaggcctatgtttgccgtgggcctcctgttccgccggcttacgagcagagaggtcctgctactcacaattggtctgtcattggtggctagtgttgaactgccaaactccttagaggaactcggggatggactggcgatgggcataatgatccttaaactgttgaccgactttcaatctcaccagctctgggccactctgctaagcctgaccttcattaagacaactttttcccttcattacgcatggaaaaccatggctatggtgctctcaatcgtcagcctgttccccttgtgtctgagtacgacatctcagaagaccacttggttaccggtactcctgggctcccttgggtgcaagcctctgacaatgtttttgattgccgagaataaaatctggggaagaaagagctggccactcaacgaaggtataatggccgtgggcatcgtttcgattctgctatcatctctgcttaaaaacgatgtgcccctcgctgggcctctgatcgcaggaggcatgttgattgcctgttatgtcatcagtggttccagcgcggacttatctctggagaaggctgccgaggtgagctgggaagaggaagcagagcactccggggcctcacataatatactcgtagaagtgcaggatgacggaaccatgaaaattaaggatgaggagcgagacgatactctgacaatccttctgaaagctaccttgctagcagtcagtggcgtttaccccctgagcatcccagccacactcttcgtgtggtatttctggcaaaagaagaaacagcgctctggcgtgctgtgggacactccttcacccccagaagtcgagcgggcggtgcttgatgacgggatttacagaataatgcagaggggattactgggtcgtagccaggttggcgtaggggtgtttcaagaaaacctcttccacaccatgtggcacgtcacacgcggagctgtgttgatgtatcagggcaagcggctggagccgagttgggccagcgttaaaaaggacctcatctcctacggtgggggatggagactgcagggctcttggaataccggcgaggaagtgcaggtcattgcagtggagcctgggaaaaaccccaagaatgtacaaacagccccaggaacttttaagacccccgaaggtgaggtcggcgctatcgcccttgatttcaaacctgggacgtcgggaagcccaattgtgaacagggaaggcaagatcgttggtctgtacgggaatggagtggtcacaacttcaggcacctatgtgtccgcaatagctcaggccaaagcgagtcaggagggccccttgcctgagatcgaagacgaggtttttcgaaagcggaacctaacaattatggatctgcatccggggtctggaaaaacccgcagatacctcccagccatcgtgagggaagcaattaagcggaagttacgaactctgatccttgctcccaccagagtcgtggccagcgagatggctgaagcactgaaaggtatgcctatacgctatcaaacaacggccgtaaagtccgagcacactggcaaagagattgtggacctcatgtgccatgccaccttcacaatgaggttgctgtcaccagttcgtgtccccaattacaacatgatcatcatggatgaagctcactttaccgacccttctagcattgcggcacgggggtatatcagtactagagtgggaatgggcgaggccgctgccatattcatgacagcaaccccgcccggttccgtggaagcctttccacagagcaatgctgtcattcaggatgaggaaagggacatccctgagcgctcttggaacctcgggtacgagtggattacggatttccccggaaagactgtatggtttgtgccatcaatcaaatccggcaatgacatagcgaactgtctgcgaaagaatggcaagagagttattcagcttagtcggaaaacattcgataccgaatatcaaaagaccaaaaacaacgactgggactacgtggtcactacagatatcagcgagatgggggccaatttcagggcagaccgcgtgatcgatcctcgtagatgcctaaagcccgttattctgaaagacggaccagaacgggtgatcttggctggtccgatgcctgtcaccgtggcctcggcagcccagaggcgcggccgagtagggagaaaccataataaggagggagatcagtacatttatatgggccagcccttaaacaatgacgaggatcacgctcactggacagaagccaagatgctgctcgacaacataaatactccagagggtatcattcccgcgctgtttgaacctgagcgggaaaaatctgcagccatcgatggggagtacaggcttcgcggcgaggctagaaagacgttcgtggaactgatgaggcggggagacctcccagtttggttgtcctataaagtcgccagcgagggctttcaatactcagatcgtcgctggtgcttcgacggggaacgaaacaatcaggtgctggaggaaaacatggatgtggagatctggaccaaggagggagaaaggaaaaagctaaggccccggtggctggacgctcgcacatatagtgaccctctcgcacttagagagtttaaagagttcgccgctggtaggcggtctgtctccggcgatctgattttagagatagggaagttgccgcagcatctgactcagcgagcccaaaatgcactcgacaacctggttatgcttcacaatagcgaacagggaggcagagcgtaccgccatgccatggaggagctgccagaaaccatcgagacactcatgttgctggctttaattgccgtgctaaccggtggggtaactctgtttttcctctcaggcaggggacttggcaagacgagtatcgggctgttgtgtgtgatggcaagctccgtcctgctctggatggcttctgtggaaccccactggattgccgcaagcatcatactggagtttttccttatggttctcctgatccctgagcccgatcggcagcgtaccccacaggacaaccaattggcctatgtggtcattggactgttatttatgatcctaacagtagctgcgaatgaaatgggtctgctcgagactaccaaaaaggatcttggcattgggcacgtggccgttgaaaaccatcaccatgcagctatgctggacgtggatttgcaccctgcctccgcctggacactgtacgcagtcgctaccactatcataacacccatgatgagacatacgattgagaacaccactgccaatatctcactcacagcgattgctaaccaggccgcaatcctgatgggacttgacaaaggctggccaatatctaagatggatatcggtgtgcctttactggccctcgggtgctacagtcaggtcaatccgttgaccctgaccgctgcagtgctaatgctggttgcccactatgcgattatcggccccggactccaagctaaagccacaagggaagcacagaagcgcactgccgctggcattatgaagaacccaacggtggacgggatcgtagccatagatcttgaccctgtggtctacgatgcaaaattcgagaagcagctgggacagattatgttgctgatcctctgtacctcgcaaatcctgttaatgcggacaacttgggctctttgcgagagcattaccctggccacaggccccctcaccactctatgggaaggttccccagggaaattttggaatacgacaatcgcggtttctatggccaacatattccgaggatcatatctggcaggcgctggtttggccttcagcctgatgaagtccctcggcgggggaagaaggggcaccggggcacagggagagactcttggcgaaaaatggaagcgccagctgaatcagttgagtaagtctgagtttaacacctacaaacggagcggtattatggaagtggacagatcagaggctaaggaggggctgaaacgtggagaaacaactaagcacgccgtctccaggggcaccgccaaactccggtggttcgtggagcgcaatttagtaaagcctgaaggtaaggtgatcgacctgggctgtgggcgaggaggctggagttattactgcgcggggcttaaaaaggttacagaggtgaaaggatatacgaagggcggtcccgggcatgaagaaccgattccaatggctacctacggatggaacctggtcaaactacacagcggcaaggatgtgtttttcatccctcccgagaaatgtgacactctcctgtgcgatataggcgaatcttccccaaatcccacaatcgaggaagggagaaccttgagggtcctgaagatggtggagccttggctccggggaaaccaattttgtattaagatccttaatccgtacatgccctcagttgtagagactctggaacagatgcagcgcaaacatggtggcatgttagtgagaaacccactgagcagaaattcgacacacgagatgtattgggtctcttgcgggaccggaaacattgtgagtgcagttaatatgacgtcccgaatgttgctcaaccggttcaccatggcccaccgtaagcctacatacgaaagagacgtggatctgggcgctggtactcgccatgtcgccgtggagcccgaagtagcaaacctagacatcattgggcagaggatcgagaatataaaacacgagcataagagcacctggcactatgatgaagacaacccttacaaaacatgggcctatcatggatcatacgaggtgaagccatccggctctgctagcagtatggttaatggcgtcgtgaaacttctgactaaaccctgggatgtgattcctatggtcacccaaatcgcgatgacagacaccactccatttgggcagcagcgggttttcaaggaaaaagtggatacgagaacacccaaggccaaacgcggaaccactcaaatcatggaggtaaccgcaaggtggctctggggttttctgtcccgaaacaagaagccgcggatttgtacaagagaagagttcacgaggaaagtgcgcagcaatgctgccataggcgcagtctttgtggacgagaaccagtggaactctgccaaggaagctgttgaggacgaacgtttctgggagttggtgcaccgggaaagagagctgcacaaacaggggaagtgcgcaacctgcgtctataacatgatgggaaaaagggagaagaagctcggcgaatttggtaaagcgaaggggtcacgcgcaatctggtacatgtggcttggagcccgattcctggagttcgaggctttaggctttatgaatgaggatcattggttcagtcgggagaactccctgagcggcgtggaaggggagggattgcacaaactcggttacattctgagagacatctctaagattcctggcgggaatatgtatgccgatgacactgcaggatgggatacaaggatcaccgaagacgatctacagaacgaggctaaaataactgacatcatggaaccagagcatgcccttctggctaaggccatttttaaactcacataccaaaataaggtagttcgcgtgcagagacccgcaaagaacggcaccgtcatggatgtgatctcgcggagggaccagcgtggttcaggacaggtgggaacatatggcctgaatactttcaccaacatggaggcgcaattgattcgacagatggaaagcgagggcatcttttcccctagtgaattagagacgccaaacctggccgaacgcgtcctcgattggcttgagaaatacggggttgagagactgaagcggatggctatatctggagacgattgtgtggtaaaacccattgacgacaggttcgccaccgcactaacagctctgaatgatatgggtaaggtgcgcaaagacatcccgcagtgggaacctagcaagggctggaacgattggcagcaagtccccttttgctcccaccacttccatcagctcatcatgaaggacgggagagagattgtggttccatgtcggaatcaggatgaattggtgggaagggcccgagtctcacagggcgcaggttggagtctgcgtgagactgcctgccttgggaaatcttatgcgcaaatgtggcagctgatgtactttcacagacgcgacctccggttagctgccaacgcaatatgtagcgccgtgcctgtagattgggttcccacctccaggacaacttggtcaatccatgctcaccatcagtggatgaccacggaagacatgctgagcgtgtggaatagagtctggattgaggagaacccatggatggaagataagacacacatctcttcctgggaggacgtgccctatttgggaaaacgcgaagatcaatggtgcggcagtctgattggcctcaccgcccgggcaacttgggctacaaatatccaggttgccataaaccaggtgaggcgacttatcgggaatgagaactacctggactacatgaccagcatgaagagattcaaaaatgagtcggaccctgaaggagcgctatggtga

SEQ ID NO: 14155 - RNA, 9879 nt, synthetic construct
  misc_feature 1..9879: note = derived and/or modified CDS sequence (opt3) from DENV-1__KC762621__SS-prME
  source 1..9879: mol_type = other RNA
agcgtgaccatgctgctcatgcttatgcccacggccctggctttccacttgactacgaggggaggggaacctcatatgatcgtctccaagcaggaaaggggaaaatctttactgtttaagacctcagccggtgttaatatgtgcacattaattgccatggacctcggcgagctgtgtgaagatactcttacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaagcagagattttgtggagggtttgagtggcgcgacttgggtagacgttgtgctggagcacgggtcctgtgtcacaaccatggcaaaggataaacccactctggacatcgaactcctgaagacagaggtgaccaaccctgccgtgcttaggaaactgtgcattgaagctaagatctctaatacgaccacagatagccggtgtccaactcaaggagaggccaccttggtcgaagaacaggacgcaaacttcgtttgccgccgaacatttgtggatagaggctggggtaatgggtgtggactcttcggcaaaggctccctgataacttgcgctaagtttaagtgcgtaaccaaattagaggggaagattgtgcagtacgaaaacctgaaatattcagtcatcgtgacagttcacaccggagaccagcatcaagtgggtaatgagagtactgaacacggcacgacagccaccattactccccaggcgcctaccacagagatccagctcaccgactacggggcccttactctggattgtagcccaaggacaggattggacttcaacgaaatggtcctactgacgatgaaggagaaatcttggctcgtgcataagcagtggtttctggatcttccgctgccctggacctccggcgcatcaactagccaagagacatggaatcggcaggacttgctcgtaaccttcaaaacagctcacgccaagaagcaggaagttgtggtcctgggtagtcaagagggggctatgcacactgccttaaccggcgcaacggaaatccagacctctggaacaactaccatttttgccggccatctgaaatgccgtctaaagatggataaactcacactgaaggggatgtcctatgtgatgtgtactggatcgttcaaacttgagaaggaagtcgctgagacccagcacggtacggtgttggttcagataaagtacgagggcacagacgcgccttgcaaaatcccattctcgacccaagatgaaaagggggtgactcagaacggacgcctgattacagcaaatcccatcgtaaccgacaaagagaagcctgtcaacatagaagccgagccaccctttggcgagtcttatattgtgatcggtgctggggaaaaagccctcaagctgtcctggttcaagaaaggctcaagtatcggaaagatgtttgaggcaactgccagaggcgctaggcggatggccattcttggggataccgcatgggacttcggaagcatcggtggcgtttttacatccgtggggaaactggtccatcagattttcggaacggcgtacggcgtgttgttttctggtgtaagctggaccatgaagatagggatcggcgtgctcctgacttggttaggactaaattcacgaagtacatccctaagcatgacctgtattgctgttggcctcgtcacactgtaccttggggtgatggtgcaggccgattctggatgcgtcatcaactggaaaggccgcgaattgaagtgtggttcagggatcttcgttactaatgaggtgcacacctggacggaacaatataagtttcaggcagacagtccgaaaagactgagcgccgctattggaaaggcctgggaggagggcgtgtgcggtataaggtccgcaacacggctcgaaaacatcatgtggaaacagatttctaacgagctgaatcatatcttactggaaaacgacatgaagttcaccgtagtcgtgggcgatgttgctgggattcttgcccagggcaaaaagatgatccgccctcaacccatggagcacaaatactcgtggaaaagctggggcaaggcgaaaataatcggggccgacgtgcagaatactacctttattatcgatggaccaaacacacctgaatgtcccgacgatcagagagcttggaatatttgggaggtcgaggactatggcttcggtatctttactaccaacatatggttgaagctcagggattcctacacacaggtgtgcgaccaccgtctgatgtcagcagccattaaagatagtaaggctgttcatgccgacatggggtattggatcgaatctgagaaaaatgaaacgtggaagctagcacgggcgagcttcattgaggtgaagacctgtatctggccaaaatcccacactctgtggtcaaacggagtactcgaaagcgagatgataatccccaagatttacggcggtcctacatctcaacataattatcgaccaggctacttcacccagactgccgggccgtggcacctgggaaaacttgagttggattttgacctgtgcgaaggcacaaccgtcgtggtggatgagcactgcgggaacagaggaccctccttaaggacgactaccgtcacaggcaagatcattcatgaatggtgttgccgcagttgtaccctccctccactgcggttcagaggtgaggacgggtgctggtacggaatggagatcaggcccgttaaagaaaaggaggaaaatcttgtgaagtccatggtatctgctggctccggtgaggtggactcatttagtctgggcttgctctgtataagcattatgatcgaagaggtcatgcgctcgcgatggtcccggaaaatgctgatgactgggacactagccgtgttctttctgctcatcatgggacagctgacctggaacgatcttattcgtttgtgcatcatggttggcgcaaatgcttctgacagaatggggatgggaacaacttatctggccttaatggcaaccttcaagatgaggcctatgtttgccgtgggcctcctgttccgccggcttacgagcagagaggtcctgctactcacaattggtctgtcattggtggctagtgttgaactgccaaactccttagaggaactcggggatggactggcgatgggcataatgatccttaaactgttgaccgactttcaatctcaccagctctgggccactctgctaagcctgaccttcattaagacaactttttcccttcattacgcatggaaaaccatggctatggtgctctcaatcgtcagcctgttccccttgtgtctgagtacgacatctcagaagaccacttggttaccggtactcctgggctcccttgggtgcaagcctctgacaatgtttttgattgccgagaataaaatctggggaagaaagagctggccactcaacgaaggtataatggccgtgggcatcgtttcgattctgctatcatctctgcttaaaaacgatgtgcccctcgctgggcctctgatcgcaggaggcatgttgattgcctgttatgtcatcagtggttccagcgcggacttatctctggagaaggctgccgaggtgagctgggaagaggaagcagagcactccggggcctcacataatatactcgtagaagtgcaggatgacggaaccatgaaaattaaggatgaggagcgagacgatactctgacaatccttctgaaagctaccttgctagcagtcagtggcgtttaccccctgagcatcccagccacactcttcgtgtggtatttctggcaaaagaagaaacagcgctctggcgtgctgtgggacactccttcacccccagaagtcgagcgggcggtgcttgatgacgggatttacagaataatgcagaggggattactgggtcgtagccaggttggcgtaggggtgtttcaagaaaacgtcttccacaccatgtggcacgtgacacgcggagctgttctcatgtatcagggcaagcggttggagccgagttgggccagcgtgaaaaaggacctgatctcctacggtgggggatggagactccagggctcttggaataccggcgaggaagtccaggtgattgcagtagagcctgggaaaaaccccaagaatgtccaaacagccccaggaacttttaagacccccgaaggtgaggtgggcgctatcgccctggatttcaaacctgggacgtcgggaagcccaattgttaacagggaaggcaagatcgtgggtctttacgggaatggagtcgtgacaacttcaggcacctatgtttccgcaatagctcaggccaaagcgagtcaggagggccccctgcctgagatcgaagacgaggtgtttcgaaagcggaacttgacaattatggatctacatccggggtctggaaaaacccgcagatacctgccagccatcgtcagggaagcaattaagcggaagctccgaactttaatcctggctcccaccagagtggtagccagcgagatggctgaagcacttaaaggtatgcctatacgctatcaaacaacggccgtgaagtccgagcacactggcaaagagattgttgacctgatgtgccatgccaccttcacaatgaggctcttgtcaccagtccgtgtgcccaattacaacatgatcatcatggatgaagctcactttaccgacccttctagcattgcggcacgggggtatatcagtactagagtgggaatgggcgaggccgctgccatattcatgacagcaaccccgcccggttccgtcgaagcctttccacagagcaatgctgtaattcaggatgaggaaagggacatccctgagcgctcttggaactcagggtacgagtggattacggatttccccggaaagactgtgtggtttgttccatccatcaaaagtggcaatgacatagcgaactgtctgcgaaagaatggcaagagagtgattcagctcagccggaaaacattcgataccgaatatcaaaagaccaaaaacaacgactgggactacgtcgtgactacagatatctcggagatgggggccaatttcagggcagaccgcgttatcgatcctcgtagatgcctgaagcccgtgattcttaaagacggaccagaacgggtcatcctagctggtccgatgcctgtgaccgtagcctctgcagcccagaggcgcggccgagtggggagaaaccataataaggagggagatcagtacatttatatgggccagcccctgaacaatgacgaggatcacgctcactggacagaagccaagatgttgttagacaacataaatactccagagggtatcattcccgcgctgtttgaacctgagcgggaaaaatccgcagccatcgatggggagtacaggctccgcggcgaggctagaaagacgttcgttgaactgatgaggcggggagaccttccagtctggctgagctataaagtggcctcagagggctttcaatacagtgatcgtcgctggtgcttcgacggggaacgaaacaatcaggtgctcgaggaaaacatggatgtcgagatctggaccaaggagggagaaaggaaaaagttgaggccccggtggctggacgctcgcacatattctgaccctctagcactgagagagtttaaagagttcgccgctggtaggcggtccgttagcggcgatctcattcttgagatagggaagctgccgcagcatttaactcagcgagcccaaaatgcattggacaacctggtgatgctccacaattcagaacagggaggcagagcgtaccgccatgccatggaggagctgccagataccatcgaaacacttatgctgctcgctttgattgccgtactgaccggtggggtgactttatttttcctaagtggcaggggactgggcaagacgagcatcgggctcctttgtgtcatggcatcctctgtgctgttgtggatggctagcgttgagccccactggattgccgcatccatcatactggaatttttcctcatggtgctgcttatccctgagcccgaccggcagcgtaccccacaggataaccaactcgcctatgtcgtaattggactgttgtttatgatcctgacagtggctgcgaatgagatgggtttactagaaactaccaaaaaggacctgggcattgggtacgttgccgtggagaaccaccatcacgcagctatgctcgatgtcgaccttcatcctgcctcagcctggacactgtacgcagtggctaccactatcataacacccatgatgagacacacgattgaaaacaccactgccaatatctctttgacagcgattgctaaccaggccgcaatcctgatgggactcgataaaggctggccaataagtaagatggacatcggtgtccctctgcttgccttagggtgctatagccaggtgaatccgctgaccctcaccgctgcagttttgatgctggtggcccattacgcgattatcggccccggactacaagctaaagccacaagggaggcacagaagcgcactgccgctggcattatgaagaacccaacggtagatgggatcgtggccatagacctggatcctgtcgtttatgacgcaaaattcgaaaagcagctcggacagattatgcttctgatcttgtgtaccagccaaatcctgctcatgcggacaacttgggctctgtgcgagtccattaccttagccacaggcccccttaccactctgtgggagggttctccagggaaattttggaatacgacaatcgcggtgtcaatggccaacatattccgaggaagctacctcgcaggcgctggtctagccttctccctgatgaagagtttgggcgggggaagaaggggcaccggggcacagggagaaactctgggcgagaaatggaagcgccagctcaatcagctttctaagagcgaatttaacacctataaacggtcaggtattatggaggtcgacagatccgaagctaaggaggggctgaaacgtggagagacaactaagcacgccgtgagtaggggcaccgccaaattgcggtggttcgtagaacgcaatctggtgaagcctgagggtaaggttatcgatctcggctgtgggcgaggaggctggagctactattgcgcggggctaaagaaggtgacagaagtcaaaggatacacgaagggcggtcccgggcacgaggaaccgattccaatggctacctacggatggaacctggtgaaacttcattctggcaaggacgtctttttcatccctcccgagaaatgtgatactctgctatgcgacataggcgagtcctcaccaaatcccacaatcgaagaggggagaaccctcagggtgctgaagatggttgaaccttggttgcggggaaaccaattttgtattaagatcctgaatccgtatatgcccagcgtagtggagactctcgagcagatgcagcgcaaacacggtggcatgcttgtcagaaacccactgtcgagaaattctacacatgaaatgtactgggtgagttgcgggaccggaaacattgtttccgcagtgaatatgacgagccgaatgttactgaaccggttcaccatggcccaccgtaagcctacatatgagagagatgtcgacttgggcgctggtactcgccacgtggccgtagaacccgaggtggcaaacctcgatatcattgggcagaggatcgaaaatataaaacatgagcacaagtcaacctggcattacgacgaggataacccttataaaacatgggcctaccacggatcctatgaagttaagccatctggcagcgctagttccatggtcaatggcgtggtgaagctgctaactaaaccctgggacgtcattcctatggttacccaaatcgcgatgacagataccactccatttgggcagcagcgggtgttcaaggagaaagtagacacgagaacacccaaggccaaacgcggaaccactcaaatcatggaagtgaccgcaaggtggctttggggttttctgagccgaaacaagaagccgcggatttgtacaagagaggagttcacgaggaaagtccgctctaatgctgccataggcgcagtgtttgttgacgagaaccagtggaactcagccaaggaggctgtggaagatgagcgtttctgggacctcgtccatcgggaaagagagctgcacaaacaggggaagtgcgcaacctgcgtgtacaacatgatgggaaaaagggaaaagaagttgggcgagtttggtaaagcgaaggggagtcgcgcaatctggtacatgtggctgggagcccgattcctcgagttcgaagctcttggctttatgaatgaggatcactggttctcccgggaaaacagcctgtctggcgtagagggggagggattacataaactgggttatattttgagagacatctcgaagattcctggcgggaatatgtacgccgatgacactgcaggatgggatacaaggatcaccgaagacgatctccagaacgaggctaaaataactgacatcatggaaccagagcacgccctgctagctaaggccatttttaaacttacatatcaaaataaggttgtgcgcgtccagagacccgcaaagaacggcaccgtgatggatgtgatctcacggagggaccagcgtggtagcgggcaggtcggaacatacggcctgaatactttcaccaacatggaagcgcaactcattcgacagatggagtccgagggcatctttagtccttctgaactggagacgccaaacttggccgaacgcgttttagattggctggagaaatatggggtggaaagactcaagcggatggctataagcggagacgactgtgtagtgaaacccattgatgacaggttcgccaccgcacttacagctctgaatgatatgggtaaggtccgcaaagacatcccgcagtgggagccttccaagggctggaacgattggcagcaagtgcccttttgctcacatcacttccaccagctaatcatgaaggacgggagagagattgttgtgccatgtcggaatcaggatgaactggtcggaagggcccgagtgagtcagggcgcaggttggtctctccgtgagactgcctgcttggggaaaagctacgcgcaaatgtggcagctgatgtattttcatagacgcgaccttcggctggctgccaacgcaatatgttccgccgtacctgttgattgggtgcccacctcaaggacaacttggagcatccacgctcatcaccagtggatgaccacggaagacatgctctctgtctggaatagagtgtggattgaggaaaacccatggatggaggataagacacatgtttccagttgggaggacgtgccctacttaggaaaacgcgaagaccaatggtgcggcagcctgatcggcttgaccgcccgggcaacttgggctacaaatattcaggtcgccatcaaccaggtgaggcgactgatagggaatgagaactacctcgattatatgacctcgatgaagagattcaaaaatgaatccgaccctgagggagcgctttggtga

SEQ ID NO: 14156 - RNA, 9879 nt, synthetic construct
  misc_feature 1..9879: note = derived and/or modified CDS sequence (opt3) from DENV-1__KC762643__SS-prME
  source 1..9879: mol_type = other RNA
agcgtgaccatgctgctcatgcttatgcccacagcactggctttccacttgactacgaggggaggggaacctcatatgatcgtctccaagcaggaaaggggaaaatctttactgttcaagacctcagccggtgttaatatgtgcacactaattgccatggacctcggcgagctgtgtgaagatactcttacctacaaatgcccacggataacagaggcggaaccggacgatgtggactgttggtgcaatgctaccgatacttgggtgacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttatggcactgtttctcgcccatgctattggcacatcgatcacccagaagggcattatcttcatattactgatgcttgtgacgccatcaatggccatgcgctgcgtcgggatcggaagcagagattttgtggagggtttgagtggcgcgacttgggtagacgttgtgctggagcacgggtcctgtgtcacaaccatggcaaaggataaacccactctagacattgaactcctgaagacagaggtgaccaaccctgccgtgcttaggaaactgtgcatcgaagctaagatttctaatacgaccacagatagccggtgtccaactcaaggagaggccaccttggtcgaagaacaggacgcaaacttcgtttgccgccgaacatttgtggatagaggctggggtaatgggtgtggactcttcggcaaaggctccctgatcacttgcgctaagtttaagtgcgtaaccaaattagaggggaagatagtgcagtacgaaaacctgaaatattcagtcattgtgacagttcacaccggagaccagcatcaagtgggtaatgagagtactgaacacggcacgacagccaccatcactccccaggcgcctaccacagagattcagctcaccgactacggggcccttactctggattgtagcccaaggacaggattggacttcaacgaaatggtcctactgacgatgaaggagaaatcttggctcgtgcataagcagtggtttctggatcttccgctgccctggacctccggcgcatcaactagccaagagacatggaatcggcaggacttgctcgtaaccttcaaaacagctcacgccaagaagcaggaagttgtggtcctgggtagtcaagagggggctatgcacactgccttaaccggcgcaacggaaatccagacctctggaacaactaccatctttgccggccatctgaaatgccgtctaaagatggataaactcacactgaaggggatgtcctatgtgatgtgtactggatcgttcaaacttgagaaggaagtcgctgagacccagcacggtacggtgttggttcagattaagtacgagggcacagacgcgccttgcaaaataccattctcgacccaagatgaaaagggggtgactcagaacggacgcctgatcacagcaaatcccattgtaaccgacaaagagaagcctgtcaacatcgaagccgagccaccctttggcgagtcttatatagtgattggtgctggggaaaaagccctcaagctgtcctggttcaagaaaggctcaagtatcggaaagatgtttgaggcaactgccagaggcgctaggcggatggccatccttggggataccgcatgggacttcggaagcattggtggcgttctgacatccgtggggaaattggtccatcagatctttggaacggcgtacggcgtactcttctctggtgtaagctggaccatgaagattgggataggcgtgctgttaacttggctgggactaaattcacgaagtacatccctcagcatgacctgtatcgctgttggcctggtcacactttacttgggggtgatggtgcaggccgattctggatgcgtcattaactggaaaggccgcgaactgaagtgtggttcagggatctttgttactaatgaggtgcacacctggacggaacaatataagttccaggcagacagtccgaaaagactcagcgccgctatcggaaaggcctgggaggagggcgtgtgcggtattaggtccgcaacacggctggaaaacataatgtggaaacagatctctaacgagttaaatcatattctgcttgaaaacgacatgaagtttaccgtagtcgtgggcgatgttgctgggatcttggcccagggcaaaaagatgattcgccctcaacccatggagcacaaatactcgtggaaaagctggggcaaggcgaagatcataggggccgacgtgcagaatactaccttcatcattgatggaccaaacacacctgaatgtcccgacgatcagagagcttggaatatctgggaggtcgaggactatggctttggtattttcactaccaacatctggctcaagctgagggattcctacacacaggtgtgcgaccaccgtctaatgtcagcagccataaaagatagtaaggctgttcatgccgacatggggtattggattgaatctgagaaaaatgaaacgtggaagctggcacgggcgagctttatcgaggtgaagacctgtatttggccaaaatcccacactctctggtcaaacggagtactggaaagcgagatgatcatacccaagatctacggcggtcctacatctcaacataattatcgaccaggctacttcacccagactgccgggccgtggcaccttggaaaattggagctggatttcgacttatgcgaaggcacaaccgtcgtggtggatgagcactgcgggaacagaggaccctccctcaggacgactaccgtcacaggcaagattatccatgaatggtgttgccgcagttgtaccctgcctccacttcggtttagaggtgaggacgggtgctggtacggaatggagattaggcccgttaaagaaaaggaggaaaatctggtgaagtccatggtatctgctggctccggtgaggtggactcattcagtttgggcctcctgtgtatcagcataatgattgaagaggtcatgcgctcgcgatggtcccggaaaatgctaatgactgggacactggccgtgtttttcctcctgatcatgggacagcttacctggaacgatttgatccgtctgtgcattatggttggcgcaaatgcttctgacagaatggggatgggaacaacttatttagccctcatggcaacctttaagatgaggcctatgttcgccgtgggcctgctttttcgccggctgacgagcagagaggtcctactcctgacaatcggtttgtcactggtggctagtgttgaattaccaaactccctcgaggaactgggggatggacttgcgatgggcattatgatactgaaattgctcaccgacttccaatctcaccagctgtgggccactctactgagccttacctttatcaagacaactttctccctccattacgcatggaaaaccatggctatggtgctgtcaattgtcagcttgtttcccctgtgtttaagtacgacatctcagaagaccacttggctcccggtactgcttggctccctggggtgcaagcctttgacaatgttcctcatcgccgagaataaaatttggggaagaaagagctggccactgaacgaaggtatcatggccgtgggcatagtttcgatcctactgtcatctcttctcaaaaacgatgtgcccctggctgggcctttgattgcaggaggcatgttaatcgcctgttatgtcattagtggttccagcgcggacctgtctctcgagaaggctgccgaggtgagctgggaagaggaagcagagcactccggggcctcacataatatcctggtagaagtgcaggatgacggaaccatgaaaataaaggatgaggagcgagacgatactcttacaattctgttgaaagctaccctactggcagtcagtggcgtttaccccctcagcatcccagccacgctgtttgtgtggtatttctggcaaaagaagaaacagcgctctggcgtgctttgggacactccttcacccccagaagtcgagcgggcggtgttagatgacgggatctacagaattatgcagaggggactgctcggtcgtagccaggttggcgtaggggtgttccaagaaaacgtctttcacaccatgtggcacgtgacacgcggagctgttttgatgtatcagggcaagcggctggagccgagttgggccagcgtgaaaaaggacctcatatcctacggtgggggatggagactgcagggctcttggaataccggcgaggaagtccaggtgatcgcagtagagcctgggaaaaaccccaagaatgtccaaacagccccaggaactttcaagacccccgaaggtgaggtgggcgctattgcccttgattttaaacctgggacgtcgggaagcccaatcgttaacagggaaggcaagattgtgggtctgtacgggaatggagtcgtgacaacttcaggcacctatgtttccgcaatcgctcaggccaaagcgagtcaggagggccccttgcctgagatagaagacgaggtgttccgaaagcggaacctaacaatcatggatctgcatccggggtctggaaaaacccgcagatacctcccagccattgtcagggaagcaatcaagcggaagttacgaactctgattcttgctcccaccagagtggtagccagcgagatggctgaagcactgaaaggtatgcctatccgctatcaaacaacggccgtgaagtccgagcacactggcaaagagatagttgacctcatgtgccatgccacctttacaatgaggttgctgtcaccagtccgtgtgcccaattacaacatgattatcatggatgaagctcacttcaccgacccttctagcatcgcggcacgggggtatattagtactagagtgggaatgggcgaggccgctgccatctttatgacagcaaccccgcccggttccgtcgaagccttcccacagagcaatgctgtaatacaggatgaggaaagggacattcctgagcgctcttggaactcagggtacgagtggatcacggattttcccggaaagactgtgtggttcgttccatccattaaaagtggcaatgacatcgcgaactgtctccgaaagaatggcaagagagtgatacagctgagccggaaaacatttgataccgaatatcaaaagaccaaaaacaacgactgggactacgtcgtgactacagatatttcggagatgggggccaatttcagggcagaccgcgttatcgatcctcgtagatgccttaagcccgtgatcctaaaagacggaccagaacgggtcattctggctggtccgatgcctgtgaccgtagcctctgcagcccagaggcgcggccgagtggggagaaaccataataaggagggagatcagtacatctatatgggccagcccttgaacaatgacgaggatcacgctcactggacagaagccaagatgttactggacaacattaatactccagagggtataatccccgcgctctttgaacctgagcgggaaaaatccgcagccattgatggggagtacaggctgcgcggcgaggctagaaagacgtttgttgaacttatgaggcggggagacctgccagtctggctcagctataaagtggcctcagagggcttccaatacagtgatcgtcgctggtgctttgacggggaacgaaacaatcaggtgttggaggaaaacatggatgtcgagatctggaccaaggagggagaaaggaaaaagctgaggccccggtggctagacgctcgcacatattctgaccctctggcactcagagagttcaaagaatttgccgctggtaggcggtccgttagcggcgatcttatcctggagattgggaagttaccgcagcatttgactcagcgagcccaaaatgcactggacaacctcgtgatgctgcacaattcagaacagggaggcagagcgtaccgccatgccatggaggagcttccagataccatagaaacactgatgctcttggctctgatcgccgtattaaccggtggggtgactctattctttctgagtggcaggggactcggcaagacgagcattgggcttctgtgtgtcatggcatcctctgtgttgctgtggatggctagcgttgagccccactggatcgccgcatccattatcctcgagttctttctgatggtgcttctcatacctgagcccgaccggcagcgtaccccacaggataaccaactggcctatgtcgtaatcggattgctgttcatgattttaacagtggctgcgaatgagatgggtctactggaaactaccaaaaaggacctcggcatcgggcacgttgccgtggagaaccatcaccatgcagctatgcttgatgtcgacctgcaccctgcctcagcctggacattgtacgcagtggctaccactattatcacacccatgatgagacatacgatagaaaacaccactgccaatatttctctgacagcgatcgctaaccaggccgcaattctcatgggactggataaaggctggccaatcagtaagatggacataggtgtccctcttttagccctggggtgctacagccaggtgaatccgctcaccttgaccgctgcagttctgatgctagtggcccactatgcgatcattggccccggactgcaagctaaagccacaagggaggcacagaagcgcactgccgctggcatcatgaagaacccaacggtagatgggattgtggccatcgacctcgatcctgtcgtttacgacgcaaaatttgaaaagcagcttggacagataatgctgttgattctgtgtaccagccaaatcctcctgatgcggacaacttgggctttatgcgagtccatcacccttgccacaggccccctgaccactctctgggagggttctccagggaaattctggaatacgacaattgcggtgtcaatggccaacatctttcgaggaagctatctagcaggcgctggtctggccttctccttgatgaagagtctgggcgggggaagaaggggcaccggggcacagggagaaactctcggcgagaaatggaagcgccagcttaatcagctgtctaagagcgagttcaacacctacaaacggtcaggtataatggaggtcgacagatccgaagctaaggaggggttgaaacgtggagagacaactaagcacgccgtgagtaggggcaccgccaaactgcggtggtttgtagaacgcaatctcgtgaagcctgagggtaaggttattgatttaggctgtgggcgaggaggctggagctattactgcgcggggctgaaaaaggtgacagaagtcaaaggatatacgaagggcggtcccgggcatgaggaaccgatcccaatggctacctacggatggaaccttgtgaaactgcactctggcaaggacgtcttctttattcctcccgagaaatgtgatactctactctgcgacatcggcgagtcctcaccaaatcccacaatagaagaggggagaaccctgagggtgttgaagatggttgaaccttggctgcggggaaaccaattctgtatcaagattctcaatccgtacatgcccagcgtagtggagactcttgagcagatgcagcgcaaacatggtggcatgctggtcagaaacccattatcgagaaattctacacacgaaatgtattgggtgagttgcgggaccggaaacatcgtttccgcagtgaatatgacgagccgaatgctgttgaaccggtttaccatggcccaccgtaagcctacatacgagagagatgtcgacctcggcgctggtactcgccatgtggccgtagaacccgaggtggcaaacctggatattatcgggcagaggattgaaaatatcaaacacgagcataagtcaacctggcactatgacgaggataacccttacaaaacatgggcctatcatggatcctacgaagttaagccatctggcagcgctagttccatggtcaatggcgtggtgaagctacttactaaaccctgggacgtcatacctatggttacccaaattgcgatgacagataccactccattcgggcagcagcgggtgtttaaggagaaagtagacacgagaacacccaaggccaaacgcggaaccactcaaatcatggaagtgaccgcaaggtggctgtggggtttcctcagccgaaacaagaagccgcggatctgtacaagagaggaatttattaggaaagtccgctctaatgctgccataggcgcagtgttcgttgacgagaaccagtggaactcagccaaggaggctgtggaagatgagcgtttttgggacctggtccaccgggaaagagagttgcacaaacaggggaagtgcgccacgtgcgtgtataacatgatgggaaaaagggaaaagaagctgggcgagttcggtaaagcgaaggggagtcgcgcaatctggtacatgtggctcggagcccgatttcttgagttcgaagctctgggcttcatgaatgaggatcattggttttcccgggaaaacagcttatctggcgtagagggggagggactgcacaaattgggttacattctcagagacatctcgaagattcctggcgggaatatgtatgccgatgacaccgcaggatgggatactaggatcacagaagacgatctgcagaacgaggctaaaataaccgacatcatggaaccagagcatgccctacttgctaaggccattttcaaactgacttaccaaaataaggttgtgcgcgtccagagacccgcaaagaacggcacagtgatggatgtgatctcacggagggaccagcgtggtagcgggcaggtcggaacctatggcctcaatacatttactaacatggaagcgcaactgattcgacagatggagtccgagggcatcttcagtccttctgaattggagaccccaaacttagccgaacgcgttctggattggctcgagaaatacggggtggaaagacttaagcggatggctataagcggagacgactgtgtagtgaaacccattgatgacaggtttgccacggcactgaccgctctaaatgatatgggtaaggtccgcaaagacatcccgcagtgggagccttccaagggctggaacgattggcagcaagtgcccttctgctcacaccactttcatcagctgatcatgaaggacgggagagagattgttgtgccatgtcggaatcaggatgaactcgtcggaagggcccgagtgagtcagggcgcaggttggtctttgcgtgagacagcctgcctggggaaaagctatgcgcaaatgtggcagcttatgtacttccacagacgcgacctgcggctcgctgccaacgcaatatgttccgccgtacctgttgattgggtgcccacttcaaggaccacatggagcatccatgctcaccatcagtggatgactaccgaagacatgttatctgtctggaatagagtgtggattgaggaaaacccatggatggaggataaggcccacgtttccagttgggaggacgtgccctatctgggaaaacgcgaagaccaatggtgcggcagcttgatcggcctgacggcacgggctacatgggccaccaatattcaggtcgcgatcaaccaggtgaggcgactcatagggaatgagaactaccttgattacatgacttcgatgaagagatttaaaaatgaatccgaccctgagggagctctgtggtga

SEQ ID NO: 14157 - RNA, 9879 nt, synthetic construct
  misc_feature 1..9879: note = derived and/or modified CDS sequence (opt3) from DENV-1__KC762651__SS-prME
  source 1..9879: mol_type = other RNA
agcgtgaccatgctgttcatgctccttcccaccgccctggcttttcacttgactacgcggggaggggaacctcatatgatcgtatccaagcaggaaagaggaaaatctttactgttcaagacctcagccggtgttaacatgtgcacattaattgccatggacctcggcgaactgtgtgaagatactatgacctacaaatgcccacggataacagagaccgaaccggacgatgtggactgttggtgcaatgcgactgagacatgggtaacctatgggacgtgtagtcaaactggagagcaccgccgagataagcgtagcgtggctcttgcaccccatgtcggcctgggtttggaaaccagaacagagacttggatgtcctctgaaggggcatggaaacagatccagaaggtggagacctgggccctcaggcaccctggatttacagttattgctctgttcctggcacatgccatcggcacctcgattacgcagaagggcatcatatttatcctcttaatgctggtgactccatcaatggctatgcggtgcgtcgggattggaaaccgcgacttcgtggagggtcttagcggcgccacatgggtagatgttgtgttggaacacgggagttgtgtcaccactatggcgaaagacaagcccacactggatatcgagctactcaaaaccgaagtgacgaatcctgcagtgctgagaaaactttgcattgaggccaaaatctccaacaccacaactgactctaggtgtccaacccaaggagaagctacactggtcgaggagcaggatactaattttgtttgccggcgcaccttcgtggaccgaggctggggtaacgggtgtggattgtttggcaagggcagcctcataacatgcgccaagttcaaatgcgtaaccaagctggaagggaaaattgtgcagtacgagaatttaaagtattccgtcatcgtgactgttcacacgggagatcagcatcaagtgggtaacgaaacaaccgagcacggcactaccgcaacaattacaccccaggctcctacttcagaaatccagctgacagactacggggccctcacgcttgactgtagtccacggaccggactggattttaatgagatggtcttgctaactatgaaagaaaagagctggctggtgcataaacagtggttcctcgacctgccgcttccctggacatctggcgcgtccacctcacaagaaacatggaacaggcaggatctgttggtaacttttaagaccgcccacgcaaagaaacaggaggttgtggtcctcggtagccaagaaggggctatgcacacggccctgaccggcgctacagagatccagacaagtggaaccacaactattttcgccggccatttaaagtgccggctgaaaatggacaagctaaccctcaaaggggtgtcttatgtcatgtgtacgggatccttcaagctggaaaaggaggtggcagagacacagcacggtaccgttcttgtgcaggtaaaatacgaaggcactgatgccccttgcaagataccatttagctcgcaagacgagcgtggggtcatccagaatggacgcttgattacagctaaccccatcgtgaccgataaagaaaagcctgttaatatagaggcggagccacccttcggcgaatcttatattgtggtcggtgcaggggagaaagccctgaagctctcctggtttaagaaaggctcaagtatcggaaagatgttcgaagctactgccagaggcgcaaggcggatggccatcctgggggacaccgcttgggattttggaagcattggtggcgtgttcacatccgtagggaaacttgtgcatcagatctttggaacggcctacggcgttctgttctctggtgtcagctggaccatgaagattgggataggcatcttgctcacttggctgggattaaactcacgaagtacatccctgagcatgacctgtattgcagtgggcatggtgacactatacctcggggtcatggttcaggcggactctggatgcgtgatcaattggaaaggccgcgagctgaagtgtggttcagggatctttgtgactaacgaagtacacacctggacggagcaatataagttccaggctgatagtccgaaaagacttagcgccgcaattggaaaggcctgggaggaaggcgtctgcggtataaggtccgctacacggttggagaacatcatgtggaaacagatttctaatgaactgaaccatatcctcctggagaatgacatgaagtttaccgtggttgtgggcgacgtctcggggattttagcccagggcaagaagatgatccgccctcaacccatggaacacaaatacagctggaagtcctggggcaaggcaaaaataatcggggctgatgtgcagaacactaccttcattatcgacggaccaaatacacctgagtgtcccgataaccagagagcctggaatatttgggaggttgaagactatggctttggtgtgttcactaccaacatctggctgaaacttagggattcatacacacaggtatgcgaccaccgtttgatgagtgcggccataaaagattctaaggctgtccatgcagacatggggtattggattgagagcgagaagaatgagacgtggaagctcgaacgggcctccttcatcgaggtgaagacctgtatttggccacgatcacacactctgtggagcaacggagtgctagagtctgaaatgatcatacccaaaacatacggcggtcctgtctcccaacataattatagaccaggctactttacccagactgctgggccgtggcacctgggaaagctcgagctggatttcaacctttgcgaaggcacaaccgttgtggtagacgagaattgcgggaacaggggacccagtttgcgcacgactaccgtgacaggcaaaatcattcacgagtggtgttgccggagctgtaccctgcctccattaagatttaagggtgaagatgggtgctggtacggaatggagatcaggcccgtcaaagaaaaggaggaaaatctcgtgaagtctatggtttccgccggctcaggtgaggtggacagtttcagcctgggccttctgtgtatttcgatcatgatagaggaagtcatgcgctcccgatggtctgggaaaatgttgatgactggaacactcgcagtgtttctgctactgaccatgggccagctcacatggaacgatctgattcggctttgcatcatggttggggcgaacgccagcgacatgatgggaatgggcactacctatttggctctgatggccacgttccgtatgagacctatgtttgcagtgggtttactcttcaggcgcctgacatcacgggaggtccttctgctaaccgtagggctcagtctggtggcttccgttgaattgccaaattctctggaggaattaggagacggcctcgccatgggcatcatgatgctgaaacttctgactgattttcaaagccatcagttgtgggcaaccctcctgtccctaacattcgtgaaaactgccttttcactgcactacgcttggaagaccatggcgatgattcttagcatcgtcagtctcttccccctgtgtttgtctacgacatcccagaaaaccacttggctgccggtgttactcgggagcctgggatgcaagcctcttacaatgctgttgattaccgagaacaagatatggggtagaaggtcgtggccactcaatgagggcatcatggccattgggatcgtatcaattctgctatctagtctgcttaaaaacgacgtgcccctcgcaggacctctgatcgctggcggtatgttgatagcctgttatgtcatctccgggagctctgccgatttaagcctggaaaaggctgcagaggtttcctgggaagacgaggccgaacattcaggagcgagtcacaatattctcgtggaggtgcaggatgacggcactatgaaaatcaaggatgaggaacgagacgatacactgaccattcttctgaaagctacgttgctagccatcagcggcgtctaccccatgtctataccagcaactctgtttgtgtggtatttctggcaaaagaaaaagcagcgctccggggttctctgggacaccccttcacccccagaggtagaacgggccgtgctggatgacggaatttacagaatccttcagaggggtttactgggccgtagtcaggtcggggtgggagttttccaagagggcgtgtttcatacaatgtggcacgtcacccgcggtgctgtgctcatgtatcaggggaagcggttggagccgagctgggcatccgtcaagaaggatctgatctcttacggaggcggctggagattccaggggtcgtggaacacaggagaagaggtccaggtgattgccgttgaacctggtaaaaatcccaagaacgtgcaaactaccccaggcacgtttaaaacaagcgagggggaagtcggagcgatagctctcgacttcaagcccggcacttcaggttcccctatcgtgaatagggaggggaagattgttggactgtacggcaacggcgtggtcaccacaagtgggacctatgtgtctgccatcgcacaggccaaagctagccaggagggaccacttcccgaaattgaggacgaagtatttcgaaagcggaatctgactatcatggatttgcaccctggttccggcaaaacccgcagatacctaccggccatactgagggaggcaatcaagcggaaactccgaacattagtgctggctccaacgagagttgtcgcctcagaaatggcggaggcccttaaggggatgcccattcgctatcaaactaccgcagtgaagtctgagcatacaggaaaagaaatcgtggacctgatgtgccacgctaccttcactatgaggctcttgagccctgtccgtgtaccaaactacaatatgattatcatggatgaggcccattttacagaccccgctagtatagcagcccggggctatatttccaccagagtgggtatgggggaagccgctgcgatcttcatgacggcaactcctccgggaagcgttgaggcctttccccagtctaacgctgtgatccaggatgaagagagggacattccagagcgctcatggaactccggctacgattggatcacagacttccctggcaagaccgtctggtttgtgcccagtataaaaagcgggaacgatattgccaactgtctgcgaaagaatggaaaaagagttgtgcagctctcgcggaagaccttcgacactgaatatcaaaagactaagaataatgattgggactacgtcgtgaccacagacatctctgagatgggtgcaaacttcagggccgatcgcgtaattgacccacgtagatgcctgaagcctgtgatccttaaagatggccccgaacgggttatactagctgggccaatgccggtcactgtggcgtccgccgcacagaggcgcggacgaattggcagaaatcctaacaaggagggtgaccagtacgtgtatatggggcagcccctgaataacgatgaggaccacgctcattggacggaagccaaaatgttgttagataatatcaacaccccagagggcatcattcccgcactgtttgaacctgagcgggaaaagagcgccgctatcgacggagagtacaggctccgcggcgaggccagaaagacattcgtcgaactgatgaggagaggggatcttccagtttggctgtcatataaagtggcgagtgagggatttcaatactctgaccgtcgctggtgcttcgatggtgaacgaaataaccaggtactcgaggaaaatatggacgtggagatttggactaaggagggcgaaaggaaaaagttgaggccccggtggctggatgcacgcacctattccgaccctctagccctgagagagtttaaagagttcgctgccgggaggcggagcgtctcaggagacctcatacttgagatcggcaagctgccgcagcacttaacacagaaagctcaaaacgcattggataatctggtgatgctccacaacagtgaacagggtgggaaggcctaccgacatgctatggaggagctgccagacaccattgaaactcttatgctgctcgccttgatcgcagttctgacgggcggagtgaccttatttttcctaagcggcagagggctgggaaagacatccatcggtctcctttgtgtcatggcgtctagcgccctgttgtggatggcttccgtagagccccactggattgccgcatcaataatcctggaatttttcctcatggtgctgcttattcctgagcccgatcgccagaggactccacaggacaaccaactcgcttatgttgtgatcggcctgttgtttatgattctgaccgtcgccgcaaatgagatggggttactagaaacaaccaaaaaggatctgggaatcggccatgccgctgcggagaaccaccaccatgccgcaatgctcgacgtggatcttcaccctgcttctgcctggactctgtacgccgtcgcaacaacgataatcacccccatgatgcggcatactattgaaaatacaaccgctaacatcagtttgaccgccattgcgaatcaggctgccatcctgatgggtctcgacaaagggtggccaatatcgaagatggatattggcgtgcctctgcttgcattaggatgctacagccaggttaacccgctgacactcactgccgctgtgttgatgctggtagcacactatgccatcattggccccgggctacaagcgaaagctacgcgtgaggcccagaagagaaccgcagccggaatcatgaagaatccaacagtggacggcatagtcgctatcgatctggaccctgttgtgtacgatgccaaattcgaaaagcagctcggtcagattatgcttctgatcttgtgtacttcccaaattctgctcatgaggaccacatgggcactgtgcgagtctatcaccttagctactgggccccttacgacactgtgggagggatcaccaggcaaattttggaacaccactatagccgtcagcatggcgaatattttccgcggttcctatctcgccggcgcagggctagctttcagtctgatgaagtctttgggaggcgggcggcgaggaaccggcgcccagggtgaaacactgggggagaaatggaagagacagctcaaccagcttagcaagtcagaatttaatatctacaaaaggtccggaatcatggaggtggaccgcagtgaagcaaaggagggcctgaaacggggtgagactaccaagcatgctgtaagcagaggcacagccaaattgcgttggttcgtggaaaggaacctggttaagcctgaggggaaggtgattgacctcggatgtggcagagggggatggtcttattactgcgccggcctgaaaaaggtcacggaagtgaaaggttataccaaagggggacccggccacgaggaaccggtcccaatggcgacttacggctggaatctagtgaaacttcactccgggaaggatgtatttttcacacctcccgagaaatgtgacaccctgctatgcgatatcggagagtcaagcccaaaccccactatagaagagggtcgcacactccgagttctgaagatggtggaaccttggttgagaggcaatcaattttgtattaagatcctgaacccgtacatgccctcggtcgtggagaccctcgagcagatgcagaggaaacatgggggaatgcttgttcggaatccactgtctcgcaacagtacgcacgaaatgtattgggtgtcctgcggcaccggtaacattgtcagcgctgtgaatatgacatcaagaatgttactgaacaggttcactatggcacatcgaaagcctacctacgagcgggacgtagatttgggggccggaacacgtcacgtggctgttgaacccgaggtcgccaatctcgacatcataggccagagaatcgaaaacattaaaaatgagcacaagtccacttggcattatgatgaggacaacccttacaaaacctgggcatatcacggctcttacgaagtgaagccaagcgggagtgcctccagcatggtgaatggagtcgttcgcctgctaacaaagccctgggatgtgatccctatggtaacccaaattgctatgactgacacgacaccatttggtcagcagagggtgttcaaagagaaggtcgatacccggactcccaaagcgaagagaggcaccgcccaaatcatggaagtgacagcaaaatggctttgggggtttctgtctcgcaacaagaagccgaggatttgtacgcgagaggagttcacccggaaagttagatcaaatgctgccatcggagcagtgtttgtcgacgagaaccagtggaatagtgccaaggaggctgtggaagacgagaggttctgggatctcgtacatcgcgaacgtgagctgcacaaacagggcaagtgcgccacttgcgtttataacatgatgggtaaacgggaaaagaagttgggggagtttggaaaagcgaagggctccagagcaatatggtacatgtggctgggcgccaggttcctcgagttcgaagctcttgggtttatgaatgaggaccattggttcagccgcgaaaactctctgtcgggagtggagggtgagggcttacacaaactggggtacattttgcgagatatctcaaagatccctggaggcaatctctatgccgacgatacagcaggttgggacacccggattactgaagatgacctgcagaacgaggctaaaataacagatatcatggaaccagagcacgccctacttgctaccagcatttttaagctgacataccaaaacaaagtcgtgagagtgcagaggcccgccaagaatgggactgtcatggacgttatctcccgcagagatcagcggggaagtggccaggtgggcacctatgggctcaacacgttcaccaatatggaagcacaactgattaggcagatggagtctgagggaatctttagcccttccgaattggagacaccaaacttagcgaagcgtgtactggactggctcgaaaaacatggtatagagcgacttaagcgcatggccatctcaggcgatgactgtgtggtcaaacccattgacgatagattcgctactgccctgaccgcactaaatgacatggggaaggtgcggaaagatatcccgcagtgggaacctagtaagggatggaacgactggcagcaagttcccttttgctctcaccatttccaccagctgattatgaaggatggcagggagatcgtggtcccatgtcgcaatcaggacgagctcataggtagagctcgggtgagccagggggccggatggtccttgagggaaacagcatgcctgggcaaatcatacgcccaaatgtggcagcttatgtattttcaccgacgtgatctgagactcgcggctaacgccatttgtagcgcagtacctgttgactgggtgcccacttctcgcaccacgtggtccatccatgcccaccatcagtggatgacaaccgaggatatgttaagtgtctggaatcgggtgtggatcgaagagaacccatggatggaagacaagactcacgttagctcgtgggaggatgtgccctacctgggcaaaagggaggaccaatggtgcgggtccttgattggactgacagctagagccacctgggcatctaatatacaggtcgctatcaaccaggtgcgccggctcattggtaatgaaaactatcttgactacatgacttcaatgaagaggttcaaaaatgagagcgatcctgaaggcgccctgtggtga

SEQ ID NO: 14158 - RNA, 9879 nt, synthetic construct
  misc_feature 1..9879: note = derived and/or modified CDS sequence (opt3) from DENV-1__KC762653__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagagaccgaaccggacgatgtggactgttggtgcaatgcgactgagacatgggtaacctatgggacgtgttaccaaactggagagcaccgccgagataagcgtagtgtggctctggccccccatgtcggcttgggtctcgaaaccagaacagagacttggatgagctccgaaggggcatggaggcagatccagaaagtggagacctgggccctgcggcaccctggattcacagttattgctctgtttctcgcacatgccatcggcacctctattacgcagaagggcatcatattcatcttactgatgcttgtgactccatcgatggctatgcgctgcgtcgggattggaaacagagactttgtggagggtttgtcaggcgccacatgggtagatgttgtgctggaacacgggagctgtgtcaccactatggcgaaggacaaacccacactagatatcgagctcctgaagaccgaagtgacgaatcctgcagtgcttaggaaactgtgcattgaggccaagatcagtaacaccacaactgactcccggtgtccaacccaaggagaagctacattggtcgaggagcaggatactaatttcgtttgccgccgaacctttgtggacagaggctggggtaacgggtgtggactcttcggcaaaggctctctgataacatgcgccaagtttaagtgcgtaaccaaattagaagggaagattgtgcagtatgagaatctgaaatacagcgtcatcgtgactgttcacacgggagatcagcatcaagtgggtaacgaaacaaccgagcacggcactaccgcaacaattaccccccaggctcctacttccgaaatccagctcacagactatggggcccttacgctggactgttcaccaaggaccggattggatttcaatgagatggtcctactgactatgaaggagaaaagttggctcgtgcataagcagtggtttctggaccttccgctgccctggacaagcggcgcgtctacctcccaagaaacatggaaccggcaggatttgctcgtaactttcaaaaccgcccacgcaaagaagcaggaggttgtggtcctgggttcacaagaaggggctatgcacacggccttaaccggcgctacagagatccagactagcggaaccacaactatttttgccggccatctgaaatgccgtctaaagatggacaaactcaccctgaaggggatgagttacgtgatgtgtacgggatctttcaaacttgaaaaggaggtcgcagagacacagcacggtaccgtgttggttcaggtgaagtatgaaggcactgatgccccttgcaaaataccattctccagccaagacgagaagggggtaacacagaatggacgcctgatcaccgctaaccccattgtcactgataaagaaaagcctgtgaatatcgaggcggagccaccctttggcgaatcgtacctcgttgtgggtgcaggggagaaagccctgaagctttcttggttcaagaaaggctcctcaataggaaagatgtttgaagctaccgccagaggcgcaaggcggatggccattctgggggacacagcttgggatttcggaagtatcggtggcgtctttacgagcgtggggaaattgatccatcagattttcggaaccgcctacggcgtactcttttccggtgtgtcttggactatgaagatcgggattggcatactgttaacatggctgggactaaacagccgatcaaccagtctctccatgacatgtatcgcagttggcatgattactctgtatcttggggtcatggtgcaggcggacagcggatgcgtgatcaattggaaaggccgcgagttgaagtgtggttctgggatcttcgtcaccaacgaagttcacacgtggacagagcaatacaagtttcaggctgattcaccgaaaagactgagtgccgcaattggaaaggcctgggaggaaggcgtgtgcggtataaggagcgctacccggctcgagaacatcatgtggaaacagatttccaatgaactgaaccatatcttactggagaatgacatgaagttcactgtggtagtcggcgaagtgaacgggattcttgcccagggaaaaaagatgatccgccctcaacccatggagcacaaatattcttggaagtcgtggggcaaggcaaaagttataggggctgacgtgcagaataccacatttatcattgatggaccaaacactcctgagtgtcccgacaatcagagagcctggaacatctgggaagtcgaggattacggcttcggtatttttaccacaaatatctggttgaagctcagggacagctatacgcaggtgtgcgatcaccgtctgatgtccgcggccataaaagactcaaaggctgttcatgcagatatggggtactggattgaaagtgagaaaaacgaaacctggaagctagcccgggcttctttcatcgaggtgaagacttgtatttggccaaaaagccacacactgtggtccaatggagtactcgagtcagaaatgatcatacccaagatctatggcggtcctattagccaacataactaccgaccaggctacttcacccagactgccgggccgtggcacctgggaaaacttgagttggactttgaactgtgcgagggcacaaccgtcgtggtggatgagcactgcgggaatagaggaccctctttaaggacgactaccgtcacaggcaagatcattcatgaatggtgttgccgctcctgtaccctccctccactgcggttcaaaggtgaggacgggtgctggtatggaatggaaatcagacccgttaaggagaaggaagagaaccttgtgaaaagtatggtaagcgcaggctctggtgaggtggattccttttcactgggcttgctctgtataagtattatgatcgaagaggtcatgaggagccgctggtcgcgaaagatgctgatgactgggacactagcggtgttcctgctcctgaccatgggacagcttacatggaatgacttgatccggctgtgcattatggttggcgccaacgcttccgataaaatggggatgggaactacctacttagccctcatggcaacgtttcgtatgagacctatgctggctgtgggccttctgttcaggcgcctaacatctcgggaagtcctcctgttgaccgtgggtctgagcttagttgcctcagtggagctcccaaacagtctggaagagcttggggacggactggcaatgggcatcatgatgttgaagctcctgactgactttcaatcccaccagctatgggccgctctgctttctctcaccttcgtcaaaacaactctgagcttgcattatgcgtggaagaccatggccatgattctgtccatagtatcattatttcccctctgtctgagcacgacaagtcagaagaccacttggcttccggtgctgttgggctctctcgggtgcaaacctctgacaatgttcctaatcaccgagaataagatttggggaagaaaatcctggccactgaacgaaggtatcatggcagttggcattgtgagcatccttctctcgtcactgttgaagaatgatgtccccttagctgggcctctgatagccggaggcatgctcatcgcctgttacgtgatttctggtagttccgctgacctgagccttgagaaagcagccgaagtatcttgggaggaagaggcggagcacagcggggcttcccataacatcctggtggaagtccaggatgacggaactatgaagattaaagatgaggaaagggacgatacattgaccatcctactgaaggccacgctcctggcaatatcaggcgtttatcccatgagtattccagccactctttttgtgtggtacttctggcaaaagaaaaagcagcgaagcggcgtgttatgggacaccccttctcccccagaggtcgagaaagctgtgctggatgacgggatctatcgcatcctccagcggggattgctgggtaagtcccaggttggcgtaggggtgtttcaagaaggagtcttccacacaatgtggcacgtgaccagaggcgcagttctcatgtaccagggtaaaaggctggagccgtcatgggccagtgtgaagaaggatcttattagctacgggggaggctggcgtttccagggctcctggaatacaggggaagaggtccaggtgatagcggtagaacctggaaaaaaccccaagaatgtccaaactgctccaggtacctttaaaacgcccgagggcgaggtgggggccatcgcactggacttcaagcctggaacatctggctcgccaattgttaaccgcgaaggtaaaatcgtggggttgtatggaaatggcgtcgtgactaccagcggcacatacgtttcagccattgctcaggccaaggcatcccaggaggggcccctacctgaaatcgaggatgaagtgtttcggaagagaaacctgaccataatggacctccatccgggaagtggtaaaactaggcgatatttaccagctatcgtccgggaggccattaagcgcaaactgagaacccttgtgctggcgcccacaagggtagtggcctctgagatggcagaagctctcaagggcatgcctatccggtaccaaacgactgccgttaaaagcgagcacaccgggaaggaaattgtcgacttgatgtgccatgctacattcaccatgcgactgctctccccagtgagagtgcccaattataacatgatcataatggatgaggcacactttactgaccctgcctcaattgccgctcgcggatacatctctacaagggtcggcatgggtgaagcggcagccatcttcatgaccgctacgccgcccgggagcatggaggcctttccacagagtaatgcagccattcaggatgaggaacgtgacatccctgagcggtcctggaacagcggatatgattggataactgacttccccggcaagacagtatggtttgtgccatctattaaatcaggcaatgatatcgctaactgtctgagaaagaacgggaaaagggttattcagctttcccgcaagaccttcgacaccgaataccaaaaaactaagaataacgattgggactacgtggtcacaaccgatatcagtgagatgggagcgaattttcgagccgacagagtgatagaccctcggaggtgcctaaagcccgttattctgaaagatggtccagagcgcgtgatcttggcaggcccgatgcctgtcacagtggctagcgccgcacagcgtagagggcggatcggaaggaaccagaataaggaaggcgaccagtatatttacatgggtcaacccttaaacaatgatgaggaccatgcccactggactgaagctaaaatgctgctcgataacatcaatacgccagaggggattatacccgccctgttcgaacctgagcgcgagaagtcggcggcaatcgacggcgaatatcgacttagaggagaggcccggaaaaccttcgtagaactgatgaggcgcggcgatctcccagtgtggttgtcttacaaggttgcttccgaggggtttcagtatagcgacagaaggtggtgcttcgatggagaacggaacaatcaggtcctggaggagaacatggacgtggaaatttggacaaaagagggtgaacgtaagaagctacgcccccgatggctggatgccagaacttactcagaccctctcgctcttagggagtttaaagaattcgcagccggccggcgcagtgtgtctggggatctgatcttagagatcggaaagttgccgcagcacctgacccaaagagctcagaatgccctcgacaacctggtcatgcttcataattccgagcagggcggtaaagcatataggcacgcgatggaagagctgccagacacaattgaaaccctcatgttgctggccttaatagctgttctaactgggggcgtgacgctgtttttcctcagcggacggggccttgggaagacctcaatcggactgttgtgtgtaatggccagtagcgcactgctctggatggcttccgtggagccccattggattgccgcatctatcattctggagtttttccttatggtcctcctgatccctgaacccgatcgacagagaacaccacaagacaaccagttggcctacgtggttataggtctgttatttatgatcctaactgtggctgcgaacgagatgggcctgctcgaaaccacaaaaaaggatcttgggattggacacgccgcagctgagaatcaccatcacgccgccatgctggacgtcgatttgcatcctgcaagcgcttggaccctgtacgccgtagcgactacaatcattacgcccatgatgcgccacaccatcgaaaacactacagctaatatatccctcaccgccattgcaaaccaggccgctatcctgatgggccttgacaagggttggccaatttcaaaaatggatatcggggtgcctttactggcactcggctgctattctcaagttaatccgttgaccctgacagccgcggtgctaatgctggtcgctcattacgccataatcggacccggcctccaggcaaaggccactagggaggctcagaaacggacggccgcagggattatgaagaacccaaccgtggacggaatcgtcgctattgatcttgaccctgtggtttatgatgccaaattcgagaagcagctgggccaaatcatgttgctgatactctgtacaagtcagattctgttaatgcgtactacctgggcgctttgcgaatcgatcacactggccaccggtcccctcactacgctatgggaggggagcccaggaaagttttggaatacaaccatcgcagtgtccatggctaacattttcagaggctcttacctggccggtgcaggcttggctttttcactgatgaaaagcctcgggggaggcaggcgcgggactggagcccagggcgaaacccttggtgagaagtggaaacggcagctgaatcaattgtccaagagtgaattcaacacatataaacgatctgggatcatggaggtagacagaagcgaggccaaggaaggactgaagaggggcgagactaccaaacacgcggtgtcacgcggtacagctaagctccggtggttcgtcgaaagaaatttagttaaacctgagggcaaggtgatagatctggggtgtggacgtggcgggtggtcctactattgcgcaggacttaaaaaggtcacggaagtgaaaggctacaccaagggtgggcccggacacgaggagccgattccaatggccacttacggctggaacctggtaaagctacatagtggcaaagacgtgtttttcacacctcccgaaaagtgtgacaccctcctgtgcgatatcggggagagctctccaaatcccactattgaagagggaaggacattgcgggttctgaaaatggtggagccttggctccgcggtaaccagttttgtatcaaggtccttaatccgtatatgccctccgtgatagaaaccctggagcagatgcagcgaaaacacggcgggatgttagtcagaaacccactgtcaaggaatagcacgcatgaaatgtactgggtgtcgtgcggaaccggcaacatcgtttctgctgtaaacatgacaagtcggatgttgctcaatcgcttcactatggcccacagaaagcctacctatgagagggacgtggatctgggtgcagggacacgacacgtcgccgtggaacccgaggttgctaacctagacattatcggacaacggattgagaatatcaagaacgaacataaatccacttggcactacgatgaggacaatccttataagacctgggcgtaccatggcagctatgaagtgaaaccatcaggctccgcctctagcatggtcaacggggtggtacgtcttctgacaaagccctgggatgtgattcctatggttacccagatcgcaatgactgacacgacaccatttggacagcaaagagtcttcaaagagaaggtggatacccgcactcccaaggctaaaaggggtaccgcccagataatggaagtgacagcacggtggctctggggctttctgagtagaaataagaaaccgcgcatttgtacgagggaggagttcacccgaaaggtccggtccaacgccgctatcggggccgtttttgtggacgaaaatcagtggaacagcgcgaaagaggcagtagaagatgagagattctgggacttggtgcacagggaacgcgagctgcataagcagggaaagtgcgccacttgcgtctacaatatgatgggcaaacgtgagaagaaactcggtgaatttgggaaggctaaaggatctcgggccatctggtacatgtggcttggcgcaagattcctggagtttgaagctttaggcttcatgaacgaggaccactggttctcaagggagaatagtctgtccggggtggaaggagagggtttgcacaagctcggctatattctgcgcgatataagcaaaatccctgggggaaacatgtacgccgacgatacagctggctgggacacccgaattactgaagatgacctacaaaatgaggccaagatcacagatattatggaaccagagcatgcacttctggcgacctctatctttaagctcacatatcagaacaaagttgtgcgggtccagagacccgccaagaacggtactgtgatggacgtaatatcgaggcgcgatcagagagggtcaggacaagttggcacctacggcctgaatacgttcaccaacatggaggctcagttgatccggcagatggaaagcgaggggatttttacaccttccgaattagagactccaaatctggccgaaagggtgctcgactggcttgagaaacacggaatcgagcgtctgaagcgaatggcaattagtggtgatgactgtgtcgtgaaacccatcgatgaccgcttcgctaccgccctaacagcactgaacgacatgggcaaggtgagaaaggatataccgcagtgggaaccttctaaagggtggaatgactggcaacaggtccccttttgcagccatcacttccaccagctcattatgaaggatggacgggagatcgttgtgccatgtaggaaccaggacgaattggtaggccgcgccagagtgtcccaaggtgcggggtggtcactgcgggagactgcttgccttggaaaaagttatgcccagatgtggcagctgatgtactttcataggcgagatctccgtttagcagccaatgctatctgttctgccgtccctgtggactgggttcccaccagcagaacgacatggtccattcacgcacatcaccaatggatgaccactgaagatatgctgtcagtgtggaaccgcgtctggatagaggagaatccatggatggaagacaagacacatgtgagctcttgggaggatgtaccctatttgggcaaacgggaagaccagtggtgcggctccctgatcgggctcaccgctagggccacttgggcgaccaacattcaggttgctatcaatcaggtgagacgccttattggaaacgagaattacctggattacatgacaagtatgaagcggttcaagaacgagagcgaccctgaaggtgccctatggtga

SEQ ID NO: 14159 - RNA, 9879 nt, synthetic construct
  misc_feature 1..9879: note = derived and/or modified CDS sequence (opt3) from DENV-1__KC762640__SS-prME
  source 1..9879: mol_type = other RNA
tccgtgaccatgctgctcatgcttctgcccacggccttggctttccacttaactacgcggggaggggaacctcatatgatcgtctccaagcaggaaaggggaaaatctctgctgtttaagacctcagccggtgttaacatgtgcacactcattgccatggacctgggagagctttgtgaagatactatgacctacaaatgcccacggataacagagaccgaaccggacgatgtggactgttggtgcaatgcgactgagacatgggtaacctatgggacgtgtagtcaaactggagagcaccgccgagataagcgtagcgtggctctggcaccccatgtcggcttgggtctcgaaaccagaacagagacttggatgtcctctgaaggggcatggaggcagatccagaaagtggagacctgggccctgcggcaccctggattcacagttattgctctgtttctcgcacatgccatcggcacctcgattacgcagaagggcatcatattcatcttactgatgcttgtgactccatcaatggctatgcgctgcgtcgggattggaaacagagactttgtggagggtttgagcggcgccacatgggtagatgttgtgctggaacacgggagttgtgtcaccactatggcgaaggacaaacccacactagatatcgagctcctgaagaccgaagtgacgaatcctgcagtgcttaggaaactgtgcattgaggccaagatctccaacaccacaactgactctcggtgtccaacccaaggagaagctacattggtcgaggagcaggatactaatttcgtttgccgccgaacctttgtggacagaggctggggtaacgggtgtggactcttcggcaaaggcagcctgataacatgcgccaagtttaagtgcgtaaccaaattagaagggaagattgtgcagtacgagaatctgaaatattccgtcatcgtgactgttcacacgggagatcagcatcaagtgggtaacgaaacaaccgagcacggcactaccgcaacaattactccccaagctcctacctcagaaatccagctcacagactacggggcccttacgctggactgtagtccaaggaccggattggatttcaatgagatggtcctactgactatgaaggagaaaagctggctcgtgcataagcagtggtttctggaccttccgctgccctggacatctggcgcgtccacctcacaagaaacatggaaccggcaggatttgctcgtaactttcaaaaccgcccacgcaaagaagcaggaggttgtggtcctgggtagccaagaaggggctatgcacacggccttaaccggcgctacagagatccagacaagtggaaccacaactatttttgccggccatctgaaatgccgtctaaagatggacaaactcaccctgaagggggtgtcttatgtcatgtgtacgggatccttcaaacttgaaaaggaggtggcagagacacagcacggtaccgttttggtgcaggtaaagtacgaaggcactgatgccccttgcaaaataccattcagctcgcaagacgagaagggggtcacacagaatggacgcctgatcaccgctaaccccattgtgactgataaagaaaagcctgttaatatcgaggcggagccaccctttggcgaatcttatctcgtggtcggtgcaggggagaaagccctgaaactttcctggttcaagaaaggctcaagtataggaaagatgtttgaagctaccgccagaggcgcaaggcggatggccattctgggggacacagcttgggatttcggaagcatcggtggcgtgtttacgtccgtagggaaattgatccatcagattttcggaaccgcctacggcgtgctcttttctggtgttagctggactatgaagatcgggattggcatactgttaacatggctgggactaaactcacgaagtacctccctcagcatgacatgtatcgcagtcggcatggtgactctgtaccttggggtgatggtccaggcggactctggatgcgttattaattggaaaggccgcgagttgaagtgtggttcagggatcttcgtgaccaacgaagtgcacacgtggacagagcaatataagtttcaggctgatagtccgaaaagactgagcgccgcaatcggaaaggcctgggaggaaggcgtatgcggtattaggtccgctacccggctcgagaacataatgtggaaacagatctctaatgaactgaaccatattttactggagaatgacatgaagttcactgtcgtggttggcgaagtgaacgggatccttgcccagggcaagaagatgattcgccctcaacccatggagcacaaatactcgtggaaaagctggggcaaggcaaaggtcatcggggctgacgtgcagaataccacatttataatcgatggaccaaacactcctgagtgtcccgacaatcagagagcctggaacatttgggaagttgaggattatggcttcggtatctttaccacaaatatttggttgaagctcagggactcctacacacaggtgtgcgatcaccgtctgatgtcagcggccatcaaagacagtaaggctgtacatgcagatatggggtattggatagaatctgagaaaaacgaaacctggaagctagcccgggctagcttcattgaggtcaagacttgtatctggccaaaatcccacacactgtggtcaaatggagtgctcgagagcgaaatgattatccccaagatatacggcggtcctatctctcaacataactatcgaccaggctacttcacccagactgccgggccgtggcacctgggaaaacttgagttggactttgaactgtgcgagggcacaaccgtggtcgttgatgagcactgcgggaatagaggaccctccttaaggacgactaccgtgacaggcaagattatccatgaatggtgttgccgcagttgtaccctccctccactgcggttcaaaggtgaggacgggtgctggtacggaatggaaattagacccgtaaaggagaaggaagagaaccttgtgaaaagcatggtctctgcaggctccggtgaggtggattcatttagtctgggcttgctctgtatcagcataatgattgaagaggttatgaggtcgcgctggtcccgaaagatgctgatgactgggacactagcggtgttcctgctcctgaccatgggacagcttacatggaatgacttgatccggctgtgcatcatggtcggcgccaacgcttctgataaaatggggatgggaactacctatttagccctcatggcaacgtttcgtatgagacctatgttcgctgtgggcctgctttttaggcgcctgacaagccgggaagttctactcctgaccgtgggtttgtcactggtcgccagtgtagagttaccaaactccctcgaagaactgggggacggacttgcaatgggcattatgatgctgaagttgctcactgacttccaatctcaccagctgtgggccgctctactgagccttacctttgtgaaaacaactctctccctgcattacgcgtggaagaccatggccatgatcttgtcaattgttagcctgttccccttatgtctcagtacgacatctcagaagaccacttggctgccggtgcttctgggctccttggggtgcaaacctctcacaatgtttctgataaccgagaataagatctggggaagaaaaagctggccactaaacgaaggtattatggcagtcggcatcgtgtcgattctgctttcatctctcctgaagaatgatgtacccttggctgggcctttaatcgccggaggcatgctgatagcctgttatgtgatcagtggttccagcgctgacctctctctggagaaagcagccgaagtcagctgggaggaagaggcggagcactccggggcttcacataacattcttgttgaagtgcaggatgacggaactatgaagatcaaagatgaggaaagggacgatacactgaccattttgctaaaggccacgctgctcgcaatcagtggcgtgtaccccatgagcataccagccactctgttcgtctggtatttttggcaaaagaaaaagcagcgatctggcgtgctttgggacaccccttcacccccagaggttgagaaagctgtattagatgacgggatttaccgcatcctgcagcggggactcttgggtaagagccaggtgggcgtcggggtgttccaagaaggagttttccacacaatgtggcacgtgaccagaggcgcagtcctgatgtatcagggtaaaaggctcgagccgagttgggccagcgtgaagaaggatctgatctcctacgggggaggctggcgttttcagggctcttggaatacaggggaagaggtacaggtcattgcggtggaacctggcaaaaaccccaagaatgttcaaactgctccaggtaccttcaaaacgcccgagggcgaggtgggggccatagcacttgactttaagcctggaacatcgggcagcccaatcgtcaaccgcgaaggtaaaattgtggggctgtacggaaatggcgttgtgactacctcaggcacatatgtctccgccatcgctcaggccaaggcaagtcaggaggggcccttgcctgaaattgaggatgaagtgttccggaagagaaacctaaccatcatggacctgcatccgggatctggtaaaactaggcgatacctcccagctatagtacgggaggccatcaagcgcaaattaagaaccctggtgcttgcgcccacaagggttgtcgccagcgagatggcagaagctctgaagggcatgcctattcggtatcaaacgactgccgtgaaatccgagcacaccgggaaggaaatcgtggacctcatgtgccatgctacatttaccatgcgattgctgtcaccagtcagagtacccaattacaacatgattatcatggatgaggcacacttcactgaccctgcctctatagccgctcgcggatatattagcacaagggtgggcatgggtgaagcggcagccatctttatgaccgctacgccgcccgggagtatggaggccttcccacagtccaatgcagccatccaggatgaggaacgtgacattcctgagcggagctggaactctggatacgattggatcactgactttcccggcaagacagtttggttcgtgccatcaataaaatccggcaatgatattgctaactgtctcagaaagaacgggaaaagggtcatccagctgagtcgcaagacctttgacaccgaatatcagaaaactaagaataacgattgggactacgtggttacaaccgatattagcgagatgggagcgaatttccgagccgacagagtgatcgaccctcggaggtgccttaagcccgtcatactaaaagatggtccagagcgcgtgattctggcaggcccgatgcctgtaacagtggcttcggccgcacagcgtagagggcggatcggaaggaaccagaataaggaaggcgaccagtacatctatatgggtcaacccttgaacaatgatgaggaccatgcccactggactgaagctaaaatgttactggataacattaatacgccagaggggatcattcccgccctcttcgaacctgagcgcgagaagtctgcggcaatagacggcgaataccgactgagaggagaggcccggaaaacctttgttgaacttatgaggcgcggcgatctgccagtctggctctcctataaggtggctagcgaggggttccagtactcagacagaaggtggtgctttgatggagaacggaacaatcaggtgttggaggagaacatggacgtcgaaatctggacaaaagagggtgaacgtaagaagctgcgcccccgatggctagatgccagaacttatagtgaccctctggctctcagggagttcaaagaatttgcagccggccggcgctctgtttccggggatcttattctggagatcggaaagttaccgcagcacttgacccaaagagctcagaatgccctggacaacctcgtgatgctgcataatagcgagcagggcggtaaagcatacaggcacgcgatggaagaacttccagacacaatcgaaaccctgatgctcttggccctgattgctgtattaactgggggcgtgacgctattctttctgtcaggacggggcctcgggaagaccagtataggacttctgtgtgtcatggccagctccgcattgctgtggatggcttctgtggagccccattggatcgccgcaagcattatcctcgagttctttctgatggttcttctcattcctgaacccgatcgacagagaacaccacaagacaaccagctggcctatgtggtcatcggtttgctgttcatgatattaactgtagctgcgaacgagatgggcctactggaaaccactaaaaaggatctcgggatcggacacgccgcagctgagaatcaccatcacgccgccatgcttgacgtggatctgcatcctgcatccgcttggaccttgtacgccgttgcgactacaattatcacgcccatgatgcgccacaccattgaaaacactacagctaatatctcactgaccgccatagcaaaccaggccgctattctcatgggcctggacaagggttggccaatctctaaaatggatattggggtgcctcttttagcactgggctgctacagtcaagtcaatccgctcaccttgacagccgcggtgctgatgctagtcgctcattatgccatcataggacccggcctgcaggcaaaggccactagggaggctcagaaacggacggccgcagggatcatgaagaacccaaccgtggacggaattgttgctatcgatctcgaccctgtggtatacgatgccaaatttgagaagcagcttggccaaattatgctgttgatcctgtgtacatcgcagatactcctgatgcgtactacctgggcgttatgcgaaagcattacacttgccaccggtcccctgactacgctctgggaggggtccccaggaaagttctggaatacaaccatcgcagtgtctatggctaacatctttagaggctcatatctagccggtgcaggcctggctttcagcttgatgaaatccctagggggaggcaggcgcgggactggagcccagggcgaaaccctcggtgagaagtggaaacggcagcttaatcaactgagtaagtctgagttcaacacatacaaacgaagcgggattatggaggtcgacagatcagaggccaaggaaggattgaagaggggcgagactaccaaacacgcggtttcccgcggtacagctaagctgcggtggtttgtggaaagaaatctcgtcaaacctgagggcaaggtgatcgatttagggtgtggacgtggcgggtggagttattactgcgcaggactgaaaaaggtaacggaagtgaaaggctataccaagggtgggcccggacacgaggagccgataccaatggccacttacggctggaaccttgttaagctgtacagcggcaaagacgtgttctttacacctcccgaaaagtgtgacaccctactctgcgatattggggagtcttccccaaatcccactatcgaagagggaaggacactgcgggtcttgcgcatggtggagccttggctgcgaggtaaccagttctgtattaaagtcctcaatccgtatatgccctcagtgatcgaaacccttgagcagatgcagagaaagcatggcgggatgctggttaggaacccattaagcagaaattcgacgcacgaaatgtactgggtatcttgcggaaccggcaacatagtgagtgctgtcaacatgacatcccgcatgctgttgaatagatttactatggcccataggaaacctacctatgagcgagacgtggatctcggtgcagggacacggcacgttgccgtggaacccgaggtcgctaacctggagatcattggacaacgtatcgaaaatattaagaacgagcacaagagcacttggcattacgacgaagataatccttataaaacctgggcgtaccacggctcatatgaggtgaagccatccggctctgccagcagtatggtaaacggggtggttagactacttacaaaaccctgggacgtcatccctatggtgacccagattgcaatgactgatacgacaccattcggacagcaacgcgtgtttaaggaaaaagtcgacaccaggactcccaaggctaagcggggtaccgcccagatcatggaggttacagcaagatggctgtggggcttcctctcccgcaataaaaagccgaggatatgtacgcgagaggaatttacccggaaagtgagaagcaacgccgctattggggccgtattcgtggatgagaatcagtggaactctgcgaaggaagcagtcgaggacgaaaggttttgggatctggtgcatcgcgagcgtgagttgcacaaacagggaaagtgcgccacttgcgtttacaatatgatgggcaagcgggagaaaaagctgggtgagttcgggaaagctaagggatcaagagccatctggtacatgtggctcggcgcaaggtttcttgagttcgaggctctgggcttcatgaacgaggaccattggtttagtcgcgaaaattccttaagcggggtggagggagaaggtctgcacaaattgggctatatcctccgagacatttctaagatacctgggggaaacatgtacgccgatgacacagctggctgggatacccggatcactgaggacgatctgcaaaatgaagccaaaattacagacatcatggagccagagcacgcactacttgcgacctcgattttcaagctgacatatcagaacaaggtcgtgagagtacagaggcccgccaaaaacggtactgttatggatgtgatctcacgcagagaccagcgggggagcggacaagtcggcacctacggcctcaatacgtttaccaacatggaagctcagctgataaggcagatggagtccgaagggatcttcacacctagtgagttggaaactccaaatttagccgagcgtgtgctggattggctcgagaagcatggaattgaacgacttaaacgcatggcaatctctggtgacgattgtgtggtcaagcccattgacgatagatttgctaccgccctgacagcactaaacgacatgggcaaagttcggaaggacatcccgcagtgggagcctagcaaggggtggaatgattggcaacaggtgcccttctgctcccaccattttcaccagctgataatgaaagacggaagggaaattgtagtgccatgtcgcaaccaggatgagctcgtcggcagagcccgggtgtcacaaggtgcggggtggagtttgagggaaactgcttgcctgggaaagtcttatgcccagatgtggcagcttatgtacttccaccgacgtgacctgagactcgcagccaatgctatctgtagcgccgttcctgtggattgggtccccacctcccgcacgacatggtcaatccatgcacaccatcaatggatgaccactgaggacatgttaagcgtgtggaaccgggtatggattgaggaaaatccatggatggaggataaaacacacgtttcttcctgggaagacgtgccctatctgggcaagagggaggatcagtggtgcggcagtttgatagggctgaccgctagagccacttgggcgaccaacatccaggtcgctattaatcaggtgcgccggctcatcggaaacgagaattaccttgactacatgacaagcatgaaaaggtttaagaacgaatcggatcctgagggtgccctgtggtga

SEQ ID NO: 14160 - RNA, 9879 nt, synthetic construct
  misc_feature 1..9879: note = derived and/or modified CDS sequence (opt3) from DENV-1__KC762645__SS-prME
  source 1..9879: mol_type = other RNA
agcgtgaccatgctgctcatgcttatgcccacagcactggctttccacttgactacgagaggcggggagcctcatatgatcgtctccaagcaagaaagaggaaagtctttactgtttaagacctcagccggtgttaacatgtgcacactgattgccatggacctcggcgagctgtgtgaagatactcttacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagcgggtggaaacttgggctctgcgccaccctggattcaccgttattgcactgtttctcgcccatgctatcggcacatcgattacccagaaaggcatcatattcatcttactgatgcttgtgacgccatcaatggccatgagatgcgtcgggattggaagcagggattttgtggagggtttgagtggcgcgacttgggtagacgttgtgctggagcacgggtcctgtgtcacaaccatggcaaaggataagcccactctagacatcgaactcctgaaaacagaggtgaccaaccctgccgtgcttcggaagctgtgcattgaagctaaaatctctaatacgaccacagatagccgctgtccaactcaaggagaggccaccttggtcgaagaacaagacgcaaacttcgtttgccgaagaacatttgtggataggggctggggtaatgggtgtggactcttcggcaagggctccctgataacttgcgctaaatttaagtgcgtaaccaagttagaggggaaaattgtgcagtacgaaaacctgaagtattcagtcatcgtgacagttcacaccggagaccagcatcaagtgggtaatgagagtactgaacacggcacgacagccaccattactccccaggcgcctaccacagagatccagctcaccgactacggggcccttactctggattgtagcccacggacaggattggacttcaacgaaatggtcctactgacgatgaaagagaagtcttggctcgtgcataaacagtggtttctggatcttccgctgccctggacctccggcgcatcaactagccaagagacatggaatcgtcaggacttgctcgtaaccttcaagacagctcacgccaaaaagcaggaagttgtggtcctgggtagtcaagagggggctatgcacactgccttaaccggcgcaacggaaatccagacctctggaacaactaccatttttgccggccatctgaagtgccgcctaaaaatggataagctcacactgaaagggatgtcctatgtgatgtgtactgggagcttcaaacttgagaaagaagtcgctgagacccagcacggtacggtgttggttcagataaagtacgagggcacagacgcgccttgcaagatcccattctcgacccaagatgaaaaaggggtgactcagaacggaagactgattacagcaaatcccatcgtaaccgacaaggagaaacctgtcaacatagaagccgagccaccctttggcgagtcttatattgtgatcggtgctggggaaaaggccctcaaactgtcctggttcaagaagggctcaagtatcggaaaaatgtttgaggcaactgccaggggcgctcggcgaatggccattcttggggataccgcatgggacttcggaagcatcggtggcgtttttacatccgtggggaagctggtccatcagattttcggaacggcgtacggcgtgttgttttctggtgtaagctggaccatgaaaatagggatcggcgtgctcctgacttggttaggactaaattcacgcagtacatccctaagcatgacctgtattgctgttggcctcgtcacactgtaccttggggtgatggtgcaggccgattctggatgcgtcatcaactggaagggcagagaattgaaatgtggttcagggatcttcgttactaatgaggtgcacacctggacggaacaatataagtttcaggcagacagtccgaagaggctgagcgccgctattggaaaagcctgggaggagggcgtgtgcggtatacggtccgcaacacgcctcgaaaacatcatgtggaagcagatttctaacgagctgaatcatatcttactggaaaacgacatgaaattcaccgtagtcgtgggcgatgttgctgggattcttgcccagggaaagaaaatgatcagacctcaacccatggagcacaagtactcgtggaaaagctggggcaaggcgaagataatcggggccgacgtgcagaatactacctttattatcgatggaccaaacacacctgaatgtcccgacgatcagagggcttggaatatttgggaggtcgaggactatggcttcggtatctttactaccaacatatggttgaaactccgtgattcctacacacaggtgtgcgaccaccggctgatgtcagcagccattaaggatagtaaagctgttcatgccgacatggggtattggatcgaatctgagaagaatgaaacgtggaaactagcacgagcgagcttcattgaggtgaagacctgtatctggccaaagtcccacactctgtggtcaaacggagtactcgaaagcgagatgataatccccaaaatttacggcggtcctatctctcaacataattatagaccaggctacttcacacagaccgccgggccgtggcacctgggaaaacttgagttggattttaacctgtgcgaaggcactacagtcgtggtggacgagcactgcgggaataggggaccctccttacgcaccacgactgtcaccggcaaaattatccatgaatggtgttgccggagttgtacactccctccactgagattcaggggtgaggatgggtgctggtacggaatggagatacgccccgttaaggaaaaagaggaaaaccttgtgaagtccatggtatctgctggctccggtgaggtggactcatttagtctgggcttgctctgtattagcatcatgatcgaagaggtcatgcgatcgcggtggtcccgtaagatgctgatgaccgggactctagccgtgttctttctgctcattatgggacagctgacatggaatgaccttatcagattgtgcattatggttggcgcaaacgcttctgataggatggggatgggaaccacatatctggccttaatggcaactttcaaaatgcgccctatgtttgccgtgggcctcctgttccggagacttaccagcagggaggtcctgctactcacgataggtctgtcattggtggctagtgttgaactgccaaattccttagaggaactcggggacggactggcgatgggcatcatgattcttaagctgttgacagattttcaatctcaccagctctgggccaccctgctaagcctgactttcatcaaaaccacattttcccttcattacgcatggaagactatggctatggtgctctcaattgtcagcctgttccccttgtgtctgagtaccacgtctcagaaaacaacctggttaccggtactcctgggctcccttgggtgcaagcctctgactatgtttttgatcgccgagaacaagatatggggacgaaaaagctggccactcaacgaaggtatcatggccgtgggcattgtttcgatcctgctatcatctctgcttaagaatgacgtgcccctcgctgggcctctgattgcaggaggcatgttgatcgcctgttatgtcataagtggttccagcgcggatttatctctggagaaagctgccgaggtgagctgggaagaggaagcagagcactccggggcctcacataacattctcgtagaagtgcaggacgatggaacaatgaagatcaaagacgaggagcgcgatgacaccctgactatccttctgaaggctacattgctagcagtcagtggcgtttaccccctgagcattccagccaccctcttcgtgtggtatttctggcagaagaagaagcagcggtctggcgtgctgtgggatacgccttcacccccagaagtcgagagagcggtgcttgacgatgggatatacaggatcatgcagcgtggattactgggtcgcagccaggttggcgtaggggtgtttcaagaaaatgtcttccacactatgtggcacgtgacccggggagctgttctcatgtatcagggcaaaagattggagccgagttgggccagcgtgaagaaagacctgatttcctacggtgggggatggaggctccagggctcttggaacacaggcgaggaagtccaggtgatcgcagtagagcctgggaagaatcccaaaaacgtccaaaccgccccaggaacatttaagactcccgaaggtgaggtgggcgctattgccctggacttcaagcctgggacctcgggaagcccaatcgttaatcgagaaggcaaaatagtgggtctttacgggaacggagtcgtgacgacatcaggcacttatgtttccgcaatcgctcaggccaaggcgagtcaggagggccccctgcctgagattgaagatgaggtgtttcggaaacgcaatttgaccatcatggacctacatccggggtctggaaagacaagaaggtacctgccagccattgtccgggaagcaatcaaacgaaagctcagaaccttaatactggctcccactcgcgtggtagccagcgagatggctgaagcacttaagggtatgcctattaggtatcaaaccacagccgtgaaatccgagcacacgggcaaggagatcgttgatctgatgtgccatgccactttcaccatgcgtctcttgtcaccagtccgggtgcccaactacaatatgatcattatggacgaagctcactttacagatccttctagcatcgcggcaagagggtatataagtaccagggtgggaatgggcgaggccgctgccattttcatgactgcaacaccgcccggttccgtcgaagcctttccacagagcaacgctgtaatccaggacgaggaacgcgatattcctgagcgatcttggaactcagggtacgagtggatcaccgacttccccggaaaaacggtgtggtttgttccatccataaagagtggcaacgatattgcgaattgtctgaggaagaatggcaagcgggtgatccagctcagcaggaagactttcgacacagaatatcagaagaccaagaacaatgattgggactacgtcgtgaccactgacatctcggagatgggggccaacttccgcgcagatcgtgttattgaccctagacggtgcctgaaacccgtgatccttaaggatggaccagaaagggtcattctagctggtccgatgcctgtgacagtagcctctgcagcccagcgccgaggcagagtggggcggaatcataacaaagagggagaccagtacatatatatgggccagcccctgaataacgatgaggaccacgctcactggaccgaagccaagatgttgttagataatatcaacacaccagagggtattatccccgcgctgtttgaacctgagagggaaaagtccgcagccatcgacggggagtaccgcctcagaggcgaggctaggaaaactttcgttgaactgatgcggcgtggagatcttccagtctggctgagctataaggtggcctcagagggctttcaatacagtgaccgccgatggtgcttcgatggggaaagaaataaccaggtgctcgaggaaaatatggacgtcgagatttggacgaaagagggagaaaggaagaaattgcggccccgctggctggatgctagaacctattctgaccctctagcactgagggagtttaaggagttcgccgctggtcggcgatccgttagcggcgacctcatacttgagatcgggaaactgccgcagcatttaacacagagagcccaaaacgcattggataatctggtgatgctccacaactcagaacagggaggccgcgcgtacaggcatgccatggaggagctgccagacactattgaaacccttatgctgctcgctttgatcgccgtactgacaggtggggtgaccttatttttcctaagtggccggggactgggcaagactagcattgggctcctttgtgtcatggcatcctctgtgctgttgtggatggctagcgttcagccccactggatcgccgcatccataatcctggagtttttcctcatggtgctgcttattcctgaacccgatcgtcagagaacgccacaagacaatcagctcgcctatgtcgtaatcggactgttgtttatgattctgaccgtggctgcgaacgagatgggtttactagagacaactaagaaagatctgggcatcgggcacgttgccgtggaaaaccatcaccatgcagctatgctcgacgtcgatcttcaccctgcctcagcctggaccctgtacgcagtggctacaaccataattactcccatgatgaggcatacaatcgagaatacgaccgccaacatttctttgactgcgatcgctaatcaggccgcaatactgatgggactcgacaagggctggccaatcagtaaaatggatattggtgtccctctgcttgccttagggtgctactcgcaagtgaacccgctgacactcaccgctgcagttttgatgctggtggcccactatgcgatcattggccccggactacaggctaaggccacccgcgaagcacagaaacggacagccgctggcatcatgaagaatccaactgtagacgggatagtggccattgatctggaccctgtcgtttacgatgcaaagttcgagaaacagctcggacaaatcatgcttctgatcttgtgtacgagccagattctgctcatgcgaaccacatgggctctgtgcgaatccatcactttagccaccggcccccttacaaccctgtgggagggttctccagggaagttttggaacactacgatagcggtgtcaatggccaatattttcagaggaagctatctcgcaggcgctggtctagccttctccctgatgaaaagtttgggcgggggaaggcgcggcacaggggcacagggagagaccctgggcgaaaagtggaaacggcagctcaaccaactttctaagagcgagtttaatacttacaagagatcaggtatcatggaagtcgaccgttccgaggctaaagaagggctgaagaggggagagaccacaaaacacgccgtgagtcggggcactgccaagttgcgctggttcgtagagcgaaacctggtgaaacctgaaggtaaggttattgacctcggctgtgggagaggaggctggagctattactgcgcggggttaaagaaagtgaccgaggtcaagggatatacaaaaggcggtcccgggcatgaggaaccgatcccaatggctacgtacggatggaatctggtgaaacttcactctggcaaagatgtctttttcatacctcccgaaaagtgtgacaccctgctatgcgatatcggcgagtcctcaccaaaccccactattgaggaagggaggacactccgggtgctgaaaatggttgagccttggttgcgcggaaatcagttttgtatcaagattctgaacccgtacatgcccagcgtagtggaaaccctcgagcagatgcagagaaagcatggtggcatgcttgtcaggaatccactgtcgcgaaactctactcacgagatgtattgggtgagttgcgggacaggaaatatcgtttccgcagtgaacatgaccagccggatgttactgaaccgtttcacgatggcccacagaaaacctacctacgaacgcgacgtcgatttgggcgctggtacaaggcatgtggccgtagagcccgaagtggcaaatctcgacattatcgggcaacggatagagaacattaagcacgaacataaatcaacttggcactatgatgaggacaatccttacaagacctgggcctatcatggatcctacgaggttaaaccatctggcagcgctagttccatggtcaacggcgtggtgaagctgctaacaaagccctgggatgtcatccctatggttactcagatcgcgatgaccgacacaaccccatttgggcagcaaagagtgttcaaagaaaaggtagatactcgcacgcccaaagccaagaggggaacaacccagattatggaggtgactgcacgatggctttggggttttctgagccggaataaaaagccgagaatatgtaccagggaagagttcacacgcaaggtccgttctaacgctgccatcggcgcagtgtttgttgacgaaaatcagtggaactcagccaaagaggctgtggaggacgaacggttctgggatctcgtccacagagagagggaactgcacaagcaggggaaatgcgccacgtgcgtgtataatatgatgggaaagcgcgagaaaaagttgggcgaatttggtaaggcgaaagggagtcgagcaatttggtacatgtggctgggagcccggttcctcgagttcgaggctcttggctttatgaacgaagaccattggttctccagagagaatagcctgtctggcgtagaaggggagggattacacaagctgggttacatcttgagggatatttcgaaaatccctggcgggaacatgtatgccgacgataccgcaggatgggacactcgcataacagaggatgacctccaaaatgaagctaagatcaccgatattatggagccagaacatgccctgctagctaaagccatctttaaacttacttaccagaacaaagttgtgagagtccagcggcccgcaaagaatggcacagtgatggacgtgatttcaaggcgtgatcagcgaggtagcgggcaagtcggaacctatggcctgaacacattcactaacatggaggcgcagctcatccgccagatggaatccgagggcatatttagtccttctgagctggaaaccccaaatttggccgagagagttttagactggctggaaaagtacggggtggagcggctcaaaaggatggctattagcggagatgactgtgtagtgaagcccatcgacgatcgcttcgccacggcacttaccgctctgaacgacatgggtaaagtcagaaaggatatcccgcagtgggaaccttccaaaggctggaatgactggcaacaggtgcccttttgctcacaccacttccatcagctaattatgaaggatgggcgggagatagttgtgccatgtaggaaccaggacgagctggtcggacgagcccgtgtgagtcaaggcgcaggttggtctctcagagaaacagcctgcttgggaaagagctatgcgcagatgtggcagctgatgtactttcaccgccgggatcttaggctggctgccaatgcaatctgttccgccgtacctgttgactgggtgcccacttcaagaaccacatggagcattcatgctcaccatcaatggatgactaccgaggatatgctctctgtctggaaccgcgtgtggatcgaagagaatccatggatggaagacaaaacgcacatttccagttgggaggatgttccctatttaggaaagcgggaggaccagtggtgcggcagcctgatcggcttgacagccagggcaacctgggctactaacatacaggtggccatcaatcaggtccgaagactgattgggaacgaaaattacctcgactacatgacatcgatgaaacggttcaagaacgagtccgatcctgaaggagcgctttggtga

SEQ ID NO: 14161 - RNA, 9879 nt, synthetic construct
  misc_feature 1..9879: note = derived and/or modified CDS sequence (opt3) from DENV-1__KC762628__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagagaccgaaccggacgatgtggactgttggtgcaatgcgactgagacatgggtaacctatgggacgtgtagtcaaactggagagcaccgccgagataagcgtagcgtggctctggccccccatgtcggcttgggtctcgaaaccagaacagagacttggatgtcctctgaaggggcatggaggcagatccagaaagtggagacctgggccctgcggcaccctggattcacagttattgctctgtttctcgcacatgccatcggcacctcgattacgcagaagggcatcatattcatcttactgatgcttgtgactccatcaatggctatgcgctgcgtcgggattggaaacagagactttgtggagggtttgagcggcgccacatgggtagatgttgtgctggaacacgggagttgtgtcaccactatggcgaaggacaaacccacactagatatcgagctcctgaagaccgaagtgacgaatcctgcagtgcttaggaaactgtgcattgaggccaagatctccaacaccacaactgactctcggtgtccaacccaaggagaagctacattggtcgaggagcaggatactaatttcgtttgccgccgaacctttgtggacagaggctggggtaacgggtgtggactcttcggcaaaggcagcctgataacatgcgccaagtttaagtgcgtaaccaaattagaagggaagattgtgcagtacgagaatctgaaatattccgtcatcgtgactgttcacacgggagatcagcatcaagtgggtaacgaaacaaccgagcacggcactaccgcaacaattaccccccaggctcctacttcagaaatccagctcacagactacggggcccttacgctggactgtagtccaaggaccggattggatttcaatgagatggtcctactgactatgaaggagaaaagctggctcgtgcataagcagtggtttctggaccttccgctgccctggacatctggcgcgtccacctcacaagaaacatggaaccggcaggatttgctcgtaactttcaaaaccgcccacgcaaagaagcaggaggttgtggtcctgggtagccaagaaggggctatgcacacggccttaaccggcgctacagagatccagactagtggaaccacaactatttttgccggccatctgaaatgccgtctaaagatggacaaactcaccctgaagggggtgtcttatgtcatgtgtacgggatccttcaaacttgaaaaggaggtggcagagacacagcacggtaccgttttggtgcaggtaaagtacgaaggcactgatgccccttgcaaaataccattcagctcgcaagacgagaagggggtcacacagaatggacgcctgatcaccgctaaccccattgtgactgataaagaaaagcctgttaatatcgaggcggagccaccctttggcgaatcttatctcgtggtcggtgcaggggagaaagccctgaagctttcctggttcaagaaaggctcaagtataggaaagatgtttgaagctaccgccagaggcgcaaggcggatggccattctgggggacacagcttgggatttcggaagcatcggtggcgtgtttacgtccgtagggaaattgatccatcagattttcggaaccgcctacggcgtgctcttttctggtgttagctggactatgaagatcgggattggcatactgttaacatggctgggactaaactcacgaagtacctccctcagcatgacatgtatcgcagtcggcatggtgactctgtaccttggggtgatggtccaggcggactctggatgcgttattaattggaaaggccgcgagttgaagtgtggttcagggatcttcgtgaccaacgaagtgcacacgtggacagagcaatataagtttcaggctgatagtccgaaaagactgagcgccgcaatcggaaaggcctgggaggaaggcgtatgcggtattaggtccgctacccggctcgagaacataatgtggaaacagatctctaatgaactgaaccatattttactggagaatgacatgaagttcactgtcgtggttggcgaagtgaacgggatccttgcccagggaaaaaagatgattcgccctcaacccatggagcacaaatactcgtggaagagctggggcaaggcaaaagtcatcggggctgacgtgcagaataccacatttataatcgatggaccaaacactcctgagtgtcccgacaatcagagagcctggaacatttgggaagttgaggattatggcttcggtatctttaccacaaatatttggttgaagctcagggactcctacacgcaggtgtgcgatcaccgtctgatgtcagcggccatcaaagacagtaaggctgtacatgcagatatggggtattggatagaatctgagaaaaacgaaacctggaagctagcccgggctagcttcattgaggtcaagacttgtatctggccaaaatcccacacactgtggtcaaatggagtgctcgagagcgaaatgattatccccaagatatacggcggtcctatctctcaacataactatcgaccaggctacttcacccagactgccgggccgtggcacctgggaaaacttgagttggactttgaactgtgcgagggcacaaccgtggtcgttgatgagcactgcgggtccagaggacccagtttaaggacgactaccgtgacaggcaagattatccatgaatggtgttgccgcagctgtaccctccctccactgcggttcaaaggtgaggacgggtgctggtacggaatggaaattagacccgtaaaggagaaggaagagaatcttgtgaaatctatggtctccgcaggctcaggtgaggtggatagttttagcctgggcttgctctgtatgtcgatcatgatagaagaggttatgaggtcccgctggtctcgaaagatgctgatgactgggacactagcggtgttcctgctcctgaccatgggacagcttacatggaacgacttgattcggctgtgcatcatggtcggcgccaatgctagcgataaaatggggatgggaactacccacttagccctcatggcaacgtttcgtatgagacctatgttcgctgtgggcctgctttttaggcgcctgacatcacgggaagttctactcctgaccgtgggtttgagtctggtcgcctccgtagagttaccaaactctctcgaagagctgggggacggacttgcaatgggcatcatgatgctgaagttgctcactgacttccaaagccatcagctgtgggccgctctactgtcccttacctttgtgaaaacaactctctcactgcactatgcgtggaagaccatggccatgattttgagcatcgttagtctgttccccttatgtctctctacgacatcccagaagaccacttggctgccggtgcttctgggcagcttggggtgcaaacctctcacaatgtttctgattaccgagaacaagatatggggaagaaaatcgtggccactaaatgaaggtatcatggcagtcggcattgtgtcaatcctgctttctagtctcctgaagaacgatgtacccttggctgggcctttaattgccggaggcatgctgatcgcctgttacgtgatatccggtagctctgctgacctcagcctggagaaagcagccgaagtctcctgggaggaagaggcggagcattcaggggctagtcacaatatccttgttgaagtgcaggatgacggaactatgaagattaaagatgaggaaagggacgatacactgaccatcttgctaaaggccacgctgctcgcaattagcggcgtgtatcccatgtctatcccagccactctgttcgtctggtacttttggcaaaagaaaaagcagcgatccggcgtgctttgggacaccccttcacccccagaggttgagcgcgctgtattagatgacgggatatatcggattctgcagagaggactcttgggtaaaagtcaggtgggcgtcggggtgttccaagaaggagttttccacacaatgtggcatgtgaccaggggcgcagtcctgatgtaccagggtaagcgtctcgagccgagctgggcctccgtgaaaaaggatctgatctcttatgggggaggctggcgctttcagggctcgtggaacacaggggaagaggtacaggtcatcgcggtggaacctggaaagaatcccaaaaacgttcaaactgctccaggtaccttcaagacgcccgagggcgaggtgggggccattgcacttgactttaaacctggaacaagcggctcaccaatagtcaatcgggaaggtaagatcgtggggctgtacggaaacggcgttgtgactacctccggcacatacgtcagtgccattgctcaggccaaagcatctcaggaggggcccttgcctgaaatcgaggatgaagtgttcagaaagaggaatctaaccattatggacctgcacccgggaagcggtaagactcgacggtatctcccagctatcgtacgcgaggccataaaaagaaagttaaggaccctggtgcttgcgcccacacgggttgtcgcctccgagatggcagaagctctgaaaggcatgcctatccgataccaaacgactgccgtgaagtcagagcataccgggaaagaaattgtggacctcatgtgccacgctacatttaccatgagattgctgtctccagtccgcgtacccaactataatatgatcattatggatgaggcacatttcactgaccctgccagcatcgccgctaggggatacataagtacacgtgtgggcatgggtgaagcggcagccatttttatgaccgctacgccgcccgggtccatcgaggccttcccacagagcaacgcagccatccaggatgaggaacgggacattcctgagagatcttggaattcaggatatgattggatcactgactttcccggcaagacagtttggttcgtgccatccataaagagtggcaacgatattgctaattgtctcaggaaaaacgggaagcgcgtcatccagctgagccgaaaaacctttgacaccgaataccaaaagactaaaaacaatgattgggactatgtggttacaaccgatatttcggagatgggagcgaacttcagagccgaccgggtgatcgaccctaggcgctgccttaagcccgtcatactaaaggatggtccagagcgtgtgattctggcaggcccgatgcctgtaacagtggcttctgccgcacagagacgggggaggatcggacgcaatcagaacaaagaaggcgaccagtacatctacatgggtcaacccttgaataacgatgaggaccacgcccactggactgaagctaagatgttactggataatattaacacgccagaggggatcattcccgccctcttcgaacctgagcgagagaaatccgcggcaatagacggcgaatatagactgcggggagaggccaggaagacctttgttgaacttatgcgcagaggcgatctgccagtctggctcagctacaaagtggcttcagaggggttccagtatagtgacaggcggtggtgctttgatggagaacgtaataaccaggtgttggaggagaatatggacgtcgaaatctggacaaaggagggtgaacgcaaaaagctgcgacccagatggctagatgccaggacttactctgaccctctggctctccgggagttcaaggaatttgcagccggccgcagatccgttagcggggatcttattctggagatcggaaaattaccgcagcatttgacccaaagggctcagaacgccctggacaatctcgtgatgctgcacaactcagagcagggcggtaaggcatatcggcatgcgatggaagagcttccagacacaatcgaaaccctgatgctcttggccctgattgctgtattaactgggggcgtgacgctattctttctgagtggacgaggcctcgggaaaaccagcataggacttctgtgtgtcatggcctcctctgcattgctgtggatggctagcgtggagccccactggatcgccgcatccattatcctcgagttctttctgatggttcttctcattcctgaacccgatagacagcgcacaccacaagacaatcagctggcctacgtggtcatcggtttgctgttcatgatattaactgtagctgcgaacgagatgggcctactggaaaccacaaagaaagatctcgggatcggacacgccgcagctgagaaccatcaccatgccgccatgcttgacgtggatctgcaccctgcatcagcttggaccttgtatgccgttgcgactacaattatcacgcccatgatgaggcataccattgaaaatactacagctaacatctctctgaccgccatagcaaatcaggccgctattctcatgggcctggacaagggttggccaatcagtaagatggatattggggtgcctcttttagcactgggctgctactcgcaagtcaacccgctcaccttgacagccgcggtgctgatgctagtcgctcactacgccatcataggacccggcctgcaggcaaaagccactcgggaggctcagaagcgtacggccgcagggatcatgaaaaatccaaccgtggacggaattgttgctatcgatctcgaccctgtggtatatgatgccaagtttgagaaacagcttggccaaattatgctgttgatcctgtgtacaagccagatactcctgatgagaactacctgggcgttatgcgaatccattacacttgccaccggtcccctgactacgctctgggaggggtctccaggaaagttctggaacacaaccatcgcagtgtcaatggctaatatctttaggggcagctacctagccggtgcaggcctggctttctccttgatgaagagtctggggggaggccgccgggggactggagcccagggcgaaaccctcggtgagaaatggaagcgacagcttaaccaactgtctaaaagcgaattcaatacatataagagatcagggattatggaggtcgacaggtccgaggccaaagaaggattgaagcgcggcgagactaccaagcacgcggttagtcggggtacagctaaactgagatggtttgtggaacgtaacctcgtcaagcctgagggcaaagtgatcgatttagggtgtggaaggggcgggtggagctactattgcgcaggactgaagaaagtaacggaagtgaagggctacaccaaaggtgggcccggacatgaggagccgataccaatggccacttatggctggaatcttgttaagctgcactctggcaaggacgtgttctttacacctcccgaaaaatgtgacaccctactctgcgatattggggagtcctcaccaaaccccactatcgaagagggacggacactgcgcgtcttgcgaatggtggagccttggctgagaggtaatcagttctgtattaaggtcctcaacccgtacatgcccagcgtgatcgaaacccttgagcagatgcagaggaaacatggcgggatgctggttcggaatccattatcgcgcaactctacgcacgaaatgtactgggtaagttgcggaaccggcaatatagtgtccgctgtcaacatgacaagcagaatgctgttgaacaggtttactatggcccaccgaaagcctacctatgagcgggacgtggatctcggtgcagggacacgtcatgttgccgtggaacccgaggtcgctaatctggacatcattggacaaagaatcgagaacattaaaaatgaacacaagtcaacttggcattacgatgaggacaacccttataagacctgggcgtaccacggctcctatgaagtgaaaccatctggcagcgccagttccatggtaaatggggtggttcgcctacttacaaagccctgggatgtcatccctatggtgacccagattgcaatgactgacacgacaccattcggacagcaaagggtgtttaaagagaaggtcgatacccggactcccaaagctaagagaggtaccgcccagatcatggaagttacagcacgctggctgtggggcttcctcagcaggaacaagaaaccgcgaatatgtacgcgggaggagtttaccagaaaggtgaggtctaatgccgctattggggccgtattcgtggacgaaaaccagtggaattcagcgaaagaggcagtcgaagatgagcgcttttgggacctggtgcatcgtgaacgggagttgcacaagcagggaaaatgcgccacttgcgtttacaacatgatgggcaagagagagaagaaactgggtgaattcgggaaggctaaaggaagtagggccatctggtatatgtggctcggcgcacgctttcttgagttcgaagctctgggcttcatgaatgaggaccactggttttcccgagagaacagcttatctggggtggaaggagagggtctgcataagttgggctacatcctccgggatatttcgaaaatacctgggggaaatatgtacgccgacgatacagctggctgggacaccagaatcactgaagatgacctgcaaaacgaggccaagattacagatatcatggaaccagagcacgcactacttgcgacctcaattttcaaactgacatatcagaataaggtcgtgagggtacagcgccccgccaagaacggtactgttatggacgtgatcagcagacgggatcagagggggtccggacaagtcggcacctacggcctcaacacgtttaccaatatggaggctcagctgatacgtcagatggaaagtgaggggatcttcacaccttctgaattggagactccaaacttagccgaacgagtgctggactggctcgagaaacatggaattgagcgccttaagagaatggcaatcagcggtgatgactgtgtggtcaaacccattgatgaccggtttgctaccgccctgacagcactaaatgacatgggcaaggttaggaaagatatcccgcagtgggaaccttccaaggggtggaacgactggcaacaggtgcccttctgctcacaccactttcatcagctgataatgaaggatggacgcgagattgtagtgccatgtagaaatcaggacgaactcgtcggccgggccagggtgagtcaaggtgcggggtggtctttgcgagagactgcttgcctgggaaaaagctatgcccagatgtggcagcttatgtacttccaccgtagagatctgcgcctcgcagccaacgctatctgttccgccgttcctgtggactgggtccccacctcacggacgacatggagcatccatgcacaccatcaatggatgaccactgaagatatgttatctgtgtggaatagggtatggattgaggagaacccatggatggaagacaagacacacgtttccagttgggaggatgtgccctatctgggcaaaagagaagaccagtggtgcggcagcttgatagggctgaccgctcgcgccacttgggcgaccaatatccaggtcgctattaaccaggtgcggaggctcatcggaaatgagaactaccttgattatatgacatcgatgaagcgatttaaaaatgagtccgaccctgaaggtgccctgtggtga

SEQ ID NO: 14162 - RNA, 9879 nt, synthetic construct
  misc_feature 1..9879: note = derived and/or modified CDS sequence (opt3) from DENV-1__KC762624__SS-prME
  source 1..9879: mol_type = other RNA
agcgtgaccatgctgctcatgcttatgcccacggccctggctttccacttgactacgaggggaggggaacctcatatgatcgtctccaagcaggaaaggggaaaatctttactgtttaagacctcagccggtgttaatatgtgcacattaattgccatggacctcggcgagctgtgtgaagatactcttacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaagcagagattttgtggagggtttgagtggcgcgacttgggtagacgttgtgctggagcacgggtcctgtgtcacaaccatggcaaaggataaacccactctggacatcgaactcctgaagacagaggtgaccaaccctgccgtgcttaggaaactgtgcattgaagctaagatctctaatacgaccacagatagccggtgtccaactcaaggagaggccaccttggtcgaagaacaggacgcaaacttcgtttgccgccgaacatttgtggatagaggctggggtaatgggtgtggactcttcggcaaaggctccctgataacttgcgctaagtttaagtgcgtaaccaaattagaggggaagattgtgcagtacgaaaacctgaaatattcagtcatcgtgacagttcacaccggagaccagcatcaagtgggtaatgagagtactgaacacggcacgacagccaccattactccccaggcgcctaccacagagatccagctcaccgactacggggcccttactctggattgtagcccaaggacaggattggacttcaacgaaatggtcctactgacgatgaaggagaaatcttggctcgtgcataagcagtggtttctggatcttccgctgccctggacctccggcgcatcaactagccaagagacatggaatcggcaggacttgctcgtaaccttcaaaacagctcacgccaagaagcaggaagttgtggtcctgggtagtcaagagggggctatgcacactgccttaaccggcgcaacggaaatccagacctctggaacaactaccatttttgccggccatctgaaatgccgtctaaagatggataaactcacactgaaggggatgtcctatgtgatgtgtactggatcgttcaaacttgagaaggaagtcgctgagacccagcacggtacggtgttggttcagataaagtacgagggcacagacgcgccttgcaaaatcccattctcgacccaagatgaaaagggggtgactcagaacggacgcctgattacagcaaatcccatcgtaaccgacaaagagaagcctgtcaacatagaagccgagccaccctttggcgagtcttatattgtgatcggtgctggggaaaaagccctcaagctgtcctggttcaagaaaggctcaagtatcggaaagatgtttgaggcaactgccagaggcgctaggcggatggccattcttggggataccgcatgggacttcggaagcatcggtggcgtttttacatccgtggggaaactggtccatcagattttcggaacggcgtacggcgtgttgttttctggtgtaagctggaccatgaagatagggatcggcgtgctcctgacttggttaggactaaattcacgaagtacatccctaagcatgacctgtattgctgttggcctcgtcacactgtaccttggggtgatggtgcaggccgattctggatgcgtcatcaactggaaaggccgcgaattgaagtgtggttcagggatcttcgttactaatgaggtgcacacctggacggaacaatataagtttcaggcagacagtccgaaaagactgagcgccgctattggaaaggcctgggaggagggcgtgtgcggtataaggtccgcaacacggctcgaaaacatcatgtggaaacagatttctaacgagctgaatcatatcttactggaaaacgacatgaagttcaccgtagtcgtgggcgatgttgctgggattcttgcccagggcaaaaagatgatccgccctcaacccatggagcacaaatactcgtggaaaagctggggcaaggcgaaaataatcggggccgacgtgcagaatactacctttattatcgatggaccaaacacacctgaatgtcccgacgatcagagagcttggaatatttgggaggtcgaggactatggcttcggtatctttactaccaacatatggttgaagctcagggattcctacacacaggtgtgcgaccaccgtctgatgtcagcagccattaaagatagtaaggctgttcatgccgacatggggtattggatcgaatctgagaaaaatgaaacgtggaagctagcacgggcgagcttcattgaggtgaagacctgtatctggccaaaatcccacactctgtggtcaaacggagtactcgaaagcgagatgataatccccaagatttacggcggtcctacatctcaacataattatcgaccaggctacttcacccagactgccgggccgtggcacctgggaaaacttgagttggattttgacctgtgcgaaggcacaaccgtcgtggtggatgagcactgcgggaacagaggaccctccttaaggacgactaccgtcacaggcaagatcattcatgaatggtgttgccgcagttgtaccctccctccactgcggttcagaggtgaggacgggtgctggtacggaatggagatcaggcccgttaaagaaaaggaggaaaatcttgtgaagtccatggtatctgctggctccggtgaggtggactcatttagtctgggcttgctctgtataagcattatgatcgaagaggtcatgcgctcgcgatggtcccggaaaatgctgatgactgggacactagccgtgttctttctgctcatcatgggacagctgacctggaacgatcttattcgtttgtgcatcatggttggcgcaaatgcttctgacagaatggggatgggaacaacttatctggccttaatggcaaccttcaagatgaggcctatgtttgccgtgggcctcctgttccgccggcttacgagcagagaggtcctgctactcacaattggtctgtcattggtggctagtgttgaactgccaaactccttagaggaactcggggatggactggcgatgggcataatgatccttaaactgttgaccgactttcaatctcaccagctctgggccactctgctaagcctgaccttcattaagacaactttttcccttcattacgcatggaaaaccatggctatggtgctctcaatcgtcagcctgttccccttgtgtctgagtacgacatctcagaagaccacttggttaccggtactcctgggctcccttgggtgcaagcctctgacaatgtttttgattgccgagaataaaatctggggaagaaagagctggccactcaacgaaggtataatggccgtgggcatcgtttcgattctgctatcatctctgcttaaaaacgatgtgcccctcgctgggcctctgatcgcaggaggcatgttgattgcctgttatgtcatcagtggttccagcgcggacttatctctggagaaggctgccgaggtgagctgggaagaggaagcagagcactccggggcctcacataatatactcgtagaagtgcaggatgacggaaccatgaaaattaaggatgaggagcgagacgatactctgacaatccttctgaaagctaccttgctagcagtcagtggcgtttaccccctgagcatcccagccacactcttcgtgtggtatttctggcaaaagaagaaacagcgctctggcgtgctgtgggacactccttcacccccagaagtcgagcgggcggtgcttgatgacgggatttacagaataatgcagaggggattactgggtcgtagccaggttggcgtaggggtgtttcaagaaaacgtcttccacaccatgtggcacgtgacacgcggagctgttctcatgtatcagggcaagcggttggagccgagttgggccagcgtgaaaaaggacctgatctcctacggtgggggatggagactccagggctcttggaataccggcgaggaagtccaggtgattgcagtagagcctgggaaaaaccccaagaatgtccaaacagccccaggaacttttaagacccccgaaggtgaggtgggcgctatcgccctggatttcaaacctgggacgtcgggaagcccaattgttaacagggaaggcaagatcgtgggtctttacgggaatggagtcgtgacaacttcaggcacctatgtttccgcaatagctcaggccaaagcgagtcaggagggccccctgcctgagatcgaagacgaggtgtttcgaaagcggaacttgacaattatggatctacatccggggtctggaaaaacccgcagatacctgccagccatcgtcagggaagcaattaagcggaagctccgaactttaatcctggctcccaccagagtggtagccagcgagatggctgaagcacttaaaggtatgcctatacgctatcaaacaacggccgtgaagtccgagcacactggcaaagagattgttgacctgatgtgccatgccaccttcacaatgaggctcttgtcaccagtccgtgtgcccaattacaacatgatcatcatggatgaagctcactttaccgacccttctagcattgcggcacgggggtatatcagtactagagtgggaatgggcgaggccgctgccatattcatgacagcaaccccgcccggttccgtcgaagcctttccacagagcaatgctgtaattcaggatgaggaaagggacatccctgagcgctcttggaactcagggtacgagtggattacggatttccccggaaagactgtgtggtttgttccatccatcaaaagtggcaatgacatagcgaactgtctgcgaaagaatggcaagagagtgattcagctcagccggaaaacattcgataccgaatatcaaaagaccaaaaacaacgactgggactacgtcgtgactacagatatctcggagatgggggccaatttcagggcagaccgcgttatcgatcctcgtagatgcctgaagcccgtgattcttaaagacggaccagaacgggtcatcctagctggtccgatgcctgtgaccgtagcctctgcagcccagaggcgcggccgagtggggagaaaccataataaggagggagatcagtacatttatatgggccagcccctgaacaatgacgaggatcacgctcactggacagaagccaagatgttgttagacaacataaatactccagagggtatcattcccgcgctgtttgaacctgagcgggaaaaatccgcagccatcgatggggagtacaggctccgcggcgaggctagaaagacgttcgttgaactgatgaggcggggagaccttccagtctggctgagctataaagtggcctcagagggctttcaatacagtgatcgtcgctggtgcttcgacggggaacgaaacaatcaggtgctcgaggaaaacatggatgtcgagatctggaccaaggagggagaaaggaaaaagttgaggccccggtggctggacgctcgcacatattctgaccctctagcactgagagagtttaaagagttcgccgctggtaggcggtccgttagcggcgatctcattcttgagatagggaagctgccgcagcatttaactcagcgagcccaaaatgcattggacaacctggtgatgctccacaattcagaacagggaggcagagcgtaccgccatgccatggaggagctgccagataccatcgaaacacttatgctgctcgctttgattgccgtactgaccggtggggtgactttatttttcctaagtggcaggggactgggcaagacgagcatcgggctcctttgtgtcatggcatcctctgtgctgttgtggatggctagcgttgagccccactggattgccgcatccatcatactggaatttttcctcatggtgctgcttatccctgagcccgaccggcagcgtaccccacaggataaccaactcgcctatgtcgtaattggactgttgtttatgatcctgacagtggctgcgaatgagatgggtttactagaaactaccaaaaaggacctgggcattgggcacgttgccgtggagaaccatcaccatgcagctatgctcgatgtcgaccttcaccctgcctcagcctggacactgtacgcagtggctaccactatcataacacccatgatgagacatacgattgaaaacaccactgccaatatctctttgacagcgattgctaaccaggccgcaatcctgatgggactcgataaaggctggccaataagtaagatggacatcggtgtccctctgcttgccttagggtgctacagccaggtgaatccgctgaccctcaccgctgcagttttgatgctggtggcccactatgcgattatcggccccggactacaagctaaagccacaagggaggcacagaagcgcactgccgctggcattatgaagaacccaacggtagatgggatcgtggccatagacctggatcctgtcgtttacgacgcaaaattcgaaaagcagctcggacagattatgcttctgatcttgtgtaccagccaaatcctgctcatgcggacaacttgggctctgtgcgagtccattaccttagccacaggcccccttaccactctgtgggagggttctccagggaaattttggaatacgacaatcgcggtgtcaatggccaacatattccgaggaagctatctcgcaggcgctggtctagccttctccctgatgaagagtttgggcgggggaagaaggggcaccggggcacagggagaaactctgggcgagaaatggaagcgccagctcaatcagctttctaagagcgaatttaacacctacaaacggtcaggtattatggaggtcgacagatccgaagctaaggaggggctgaaacgtggagagacaactaagcacgccgtgagtaggggcaccgccaaattgcggtggttcgtagaacgcaatctggtgaagcctgagggtaaggttatcgatctcggctgtgggcgaggaggctggagctattactgcgcggggctaaagaaggtgacagaagtcaaaggatatacgaagggcggtcccgggcatgaggaaccgattccaatggctacctacggatggaacctggtgaaacttcactctggcaaggacgtctttttcatccctcccgagaaatgtgatactctgctatgcgacataggcgagtcctcaccaaatcccacaatcgaagaggggagaaccctcagggtgctgaagatggttgaaccttggttgcggggaaaccaattttgtattaagatcctgaatccgtacatgcccagcgtagtggagactctcgagcagatgcagcgcaaacatggtggcatgcttgtcagaaacccactgtcgagaaattctacacacgaaatgtattgggtgagttgcgggaccggaaacattgtttccgcagtgaatatgacgagccgaatgttactgaaccggttcaccatggcccaccgtaagcctacatacgagagagatgtcgacttgggcgctggtactcgccatgtggccgtagaacccgaggtggcaaacctcgatatcattgggcagaggatcgaaaatataaaacacgagcataagtcaacctggcactatgacgaggataacccttacaaaacatgggcctatcatggatcctacgaagttaagccatctggcagcgctagttccatggtcaatggcgtggtgaagctgctaactaaaccctgggacgtcattcctatggttacccaaatcgcgatgacagataccactccatttgggcagcagcgggtgttcaaggagaaagtagacacgagaacacccaaggccaaacgcggaaccactcaaatcatggaagtgaccgcaaggtggctttggggttttctgagccgaaacaagaagccgcggatttgtacaagagaggagttcacgaggaaagtccgctctaatgctgccataggcgcagtgtttgttgacgagaaccagtggaactcagccaaggaggctgtggaagatgagcgtttctgggacctcgtccaccgggaaagagagctgcacaaacaggggaagtgcgcaacctgcgtgtataacatgatgggaaaaagggaaaagaagttgggcgagtttggtaaagcgaaggggagtcgcgcaatctggtacatgtggctgggagcccgattcctcgagttcgaagctcttggctttatgaatgaggatcattggttctcccgggaaaacagcctgtctggcgtagagggggagggattacacaaactgggttacattttgagagacatctcgaagattcctggcgggaatatgtatgccgatgacactgcaggatgggatacaaggatcaccgaagacgatctccagaacgaggctaaaataactgacatcatggaaccagagcatgccctgctagctaaggccatttttaaacttacataccaaaataaggttgtgcgcgtccagagacccgcaaagaacggcaccgtgatggatgtgatctcacggagggaccagcgtggtagcgggcaggtcggaacatatggcctgaatactttcaccaacatggaagcgcaactcattcgacagatggagtccgagggcatctttagtccttctgaactggagacgccaaacttggccgaacgcgttttagattggctggagaaatacggggtggaaagactcaagcggatggctataagcggagacgactgtgtagtgaaacccattgatgacaggttcgccaccgcacttacagctctgaatgatatgggtaaggtccgcaaagacatcccgcagtgggagccttccaagggctggaacgattggcagcaagtgcccttttgctcacaccacttccatcagctaatcatgaaggacgggagagagattgttgtgccatgtcggaatcaggatgaactggtcggaagggcccgagtgagtcagggcgcaggttggtctctccgtgagactgcctgcttggggaaaagctatgcgcaaatgtggcagctgatgtactttcacagacgcgaccttcggctggctgccaacgcaatatgttccgccgtacctgttgattgggtgcccacctcaaggacaacttggagcatccatgctcaccatcagtggatgaccacggaagacatgctctctgtctggaatagagtgtggattgaggaaaacccatggatggaggataagacacacgtttccagttgggaggacgtgccctatttaggaaaacgcgaagaccaatggtgcggcagcctgatcggcttgaccgcccgggcaacttgggctacaaatattcaggtcgccatcaaccaggtgaggcgactgatagggaatgagaactacctcgattacatgacctcgatgaagagattcaaaaatgaatccgaccctgagggagcgctttggtga

SEQ ID NO: 14163 - RNA, 9879 nt, synthetic construct
  misc_feature 1..9879: note = derived and/or modified CDS sequence (opt3) from DENV-1__KC762644__SS-prME
  source 1..9879: mol_type = other RNA
agcgtgaccatgctgctcatgcttatgcccacagcactggctttccacttgactacgaggggaggggaacctcatatgatcgtctccaagcaggaaaggggaaaatctttactgtttaagacctcagccggtgttaatatgtgcacattaattgccatggacctcggcgagctgtgtgaagatactcttacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaagcagagattttgtggagggtttgagtggcgcgacttgggtagacgttgtgctggagcacgggtcctgtgtcacaaccatggcaaaggataaacccactctggacatcgaactcctgaagacagaggtgaccaaccctgccgtgcttaggaaactgtgcattgaagctaagatctctaatacgaccacagatagccggtgtccaactcaaggagaggccaccttggtcgaagaacaggacgcaaacttcgtttgccgccgaacatttgtggatagaggctggggtaatgggtgtggactcttcggcaaaggctccctgataacttgcgctaagtttaagtgcgtaaccaaattagaggggaagattgtgcagtacgaaaacctgaaatattcagtcatcgtgacagttcacaccggagaccagcatcaagtgggtaatgagagtactgaacacggcacgacagccaccattactccccaggcgcctaccacagagatccagctcaccgactacggggcccttactctggattgtagcccaaggacaggattggacttcaacgaaatggtcctactgacgatgaaggagaaatcttggctcgtgcataagcagtggtttctggatcttccgctgccctggacctccggcgcatcaactagccaagagacatggaatcggcaggacttgctcgtaaccttcaaaacagctcacgccaagaagcaggaagttgtggtcctgggtagtcaagagggggctatgcacactgccttaaccggcgcaacggaaatccagacctctggaacaactaccatttttgccggccatctgaaatgccgtctaaagatggataaactcacactgaaggggatgtcctatgtgatgtgtactgggtcgttcaaacttgagaaggaagtcgctgagacccagcacggtacggtgttggttcagataaagtacgagggcacagacgcgccttgcaaaatcccattctcgacccaagatgaaaagggggtgactcagaacggacgcctgattacagcaaatcccatcgtaaccgacaaagagaagcctgtcaacatagaagccgagccaccctttggcgagtcttatattgtgatcggtgctggggaaaaagccctcaagctgtcctggttcaagaaaggctcaagtatcggaaagatgtttgaggcaactgccagaggcgctaggcggatggccattcttggggataccgcatgggacttcggaagcatcggtggcgtttttacatccgtggggaaactggtccatcagattttcggaacggcgtacggcgtgttgttttctggtgtaagctggaccatgaagatagggatcggcgtgctcctgacttggttaggactaaattcacgaagtacatccctaagcatgacctgtattgctgttggcctcgtcacactgtaccttggggtgatggtgcaggccgattctggatgcgtcatcaactggaaaggccgcgaattgaagtgtggttcagggatcttcgttactaatgaggtgcacacctggacggaacaatataagtttcaggcagacagtccgaaaagactgagcgccgctattggaaaggcctgggaggagggcgtgtgcggtataaggtccgcaacacggctcgaaaacatcatgtggaaacagatttctaacgagctgaatcatatcttactggaaaacgacatgaagttcaccgtagtcgtgggcgatgttgctgggattcttgcccagggcaaaaagatgatccgccctcaacccatggagcacaaatactcgtggaaaagctggggcaaggcgaaaataatcggggccgacgtgcagaatactacctttattatcgatggaccaaacacacctgaatgtcccgacgatcagagagcttggaatatttgggaggtcgaggactatggcttcggtatctttactaccaacatatggttgaagctcagggattcctacacacaggtgtgcgaccaccgtctgatgtcagcagccattaaagatagtaaggctgttcatgccgacatggggtattggatcgaatctgagaaaaatgaaacgtggaagctagcacgggcgagcttcattgaggtgaagacctgtatctggccaaaatcccacactctgtggtcaaacggagtactcgaaagcgagatgataatccccaagatttacggcggtcctatctctcaacataattatcgaccaggctacttcacacagaccgccgggccgtggcacctgggaaaacttgagttggattttgacctgtgcgaaggcactacagtcgtggtggatgagcactgcgggaacagaggaccctccttaaggaccacgactgtcaccggcaagattatccatgaatggtgttgccgcagttgtacactccctccactgcggttcagaggtgaggacgggtgctggtacggaatggagataaggcccgttaaagaaaaggaggaaaatcttgtgaagtccatggtatctgctggctccggtgaggtggactcatttagtctgggcttgctctgtattagcatcatgatcgaagaggtcatgcgctcgcgatggtcccggaaaatgctgatgaccgggactctagccgtgttctttctgctcattatgggacagctgacatggaacgatcttatccgtttgtgcattatggttggcgcaaatgcttctgacagaatggggatgggaaccacatatctggccttaatggcaactttcaagatgaggcctatgtttgccgtgggcctcctgttccgccggcttaccagcagagaggtcctgctactcacgataggtctgtcattggtggctagtgttgaactgccaaactccttagaggaactcggggatggactggcgatgggcatcatgattcttaaactgttgacagactttcaatctcaccagctctgggccaccctgctaagcctgactttcatcaagaccacattttcccttcattacgcatggaaaactatggctatggtgctctcaattgtcagcctgttccccttgtgtctgagtaccacgtctcagaagacaacctggttaccggtactcctgggctcccttgggtgcaagcctctgactatgtttttgatcgccgagaataaaatatggggaagaaagagctggccactcaacgaaggtatcatggccgtgggcattgtttcgatcctgctatcatctctgcttaaaaacgatgtgcccctcgctgggcctctgattgcaggaggcatgttgatcgcctgttatgtcataagtggttccagcgcggacttatctctggagaaggctgccgaggtgagctgggaagaggaagcagagcactccggggcctcacataatattctcgtagaagtgcaggatgacggaacaatgaaaatcaaggatgaggagcgagacgataccctgactatccttctgaaagctacattgctagcagtcagtggcgtttaccccctgagcattccagccaccctcttcgtgtggtatttctggcaaaagaagaaacagcgctctggcgtgctgtgggacacgccttcacccccagaagtcgagcgggcggtgcttgatgacgggatatacagaatcatgcagaggggattactgggtcgtagccaggttggcgtaggggtgtttcaagaaaacgtcttccacactatgtggcacgtgacccgcggagctgttctcatgtatcagggcaagcggttggagccgagttgggccagcgtgaaaaaggacctgatttcctacggtgggggatggagactccagggctcttggaatacaggcgaggaagtccaggtgatcgcagtagagcctgggaaaaaccccaagaatgtccaaaccgccccaggaacatttaagactcccgaaggtgaggtgggcgctattgccctggatttcaaacctgggacctcgggaagcccaatcgttaacagggaaggcaagatagtgggtctttacgggaatggagtcgtgacgacatcaggcacttatgtttccgcaatcgctcaggccaaagcgagtcaggagggccccctgcctgagattgaagacgaggtgtttcgaaagcggaacttgaccatcatggatctacatccggggtctggaaaaacacgcagatacctgccagccattgtcagggaagcaatcaagcggaagctccgaaccttaatactggctcccactagagtggtagccagcgagatggctgaagcacttaaaggtatgcctattcgctatcaaaccacagccgtgaagtccgagcacacgggcaaagagatcgttgacctgatgtgccatgccactttcaccatgaggctcttgtcaccagtccgtgtgcccaattacaacatgatcattatggatgaagctcactttacagacccttctagcatcgcggcacgggggtatataagtaccagagtgggaatgggcgaggccgctgccattttcatgactgcaacaccgcccggttccgtcgaagcctttccacagagcaatgctgtaatccaggatgaggaaagggacattcctgagcgctcttggaactcagggtacgagtggatcaccgatttccccggaaagacggtgtggtttgttccatccataaaaagtggcaatgacattgcgaactgtctgcgaaagaatggcaagagagtgatccagctcagccggaaaactttcgatacagaatatcaaaagaccaaaaacaacgactgggactacgtcgtgaccactgatatctcggagatgggggccaatttcagggcagaccgcgttattgatcctcgtagatgcctgaagcccgtgatccttaaagacggaccagaacgggtcattctagctggtccgatgcctgtgacagtagcctctgcagcccagaggcgcggccgagtggggagaaaccataataaggagggagatcagtacatatatatgggccagcccctgaacaatgacgaggatcacgctcactggaccgaagccaagatgttgttagacaacatcaatacaccagagggtattatccccgcgctgtttgaacctgagcgggaaaaatccgcagccatcgatggggagtacaggctccgcggcgaggctagaaagactttcgttgaactgatgaggcggggagaccttccagtctggctgagctataaagtggcctcagagggctttcaatacagtgatcgtcgctggtgcttcgacggggaacgaaacaatcaggtgctcgaggaaaacatggatgtcgagatttggacgaaggagggagaaaggaaaaagttgaggccccggtggctggacgctcgcacctattctgaccctctagcactgagagagtttaaagagttcgccgctggtaggcggtccgttagcggcgatctcatacttgagatcgggaagctgccgcagcatttaacacagcgagcccaaaatgcattggacaacctggtgatgctccacaattcagaacagggaggcagagcgtaccgccatgccatggaggagctgccagatactattgaaacccttatgctgctcgctttgatcgccgtactgacaggtggggtgaccttatttttcctaagtggcaggggactgggcaagactagcattgggctcctttgtgtcatggcatcctctgtgctgttgtggatggctagcgttgagccccactggatcgccgcatccataatcctggaatttttcctcatggtgctgcttattcctgagcccgaccggcagcgtacgccacaggataaccaactcgcctatgtcgtaatcggactgttgtttatgattctgaccgtggctgcgaatgagatgggtttactagaaacaactaaaaaggacctgggcatcgggcacgttgccgtggagaaccatcaccatgcagctatgctcgatgtcgaccttcaccctgcctcagcctggaccctgtacgcagtggctacaaccataattactcccatgatgagacatacaatcgaaaacacgaccgccaatatttctttgactgcgatcgctaaccaggccgcaatactgatgggactcgataaaggctggccaatcagtaagatggacattggtgtccctctgcttgccttagggtgctacagccaggtgaatccgctgacactcaccgctgcagttttgatgctggtggcccactatgcgatcattggccccggactacaagctaaagccaccagggaggcacagaagcgcacagccgctggcatcatgaagaacccaactgtagatgggatagtggccattgacctggatcctgtcgtttacgacgcaaaattcgaaaagcagctcggacagatcatgcttctgatcttgtgtacgagccaaattctgctcatgcggaccacatgggctctgtgcgagtccatcactttagccaccggcccccttacaaccctgtgggagggttctccagggaaattttggaatactacgatagcggtgtcaatggccaacattttccgaggaagctatctcgcaggcgctggtctagccttctccctgatgaagagtttgggcgggggaagaaggggcacaggggcacagggagaaaccctgggcgagaaatggaagcgccagctcaatcagctttctaagagcgaatttaacacttacaaacggtcaggtatcatggaggtcgacagatccgaagctaaggaggggctgaaacgtggagagaccacaaagcacgccgtgagtaggggcactgccaaattgcggtggttcgtagaacgcaatctggtgaagcctgagggtaaggttattgatctcggctgtgggcgaggaggctggagctattactgcgcggggctaaagaaggtgaccgaagtcaaaggatatacaaagggcggtcccgggcatgaggaaccgatcccaatggctacgtacggatggaacctggtgaaacttcactctggcaaggacgtctttttcatacctcccgagaaatgtgataccctgctatgcgacatcggcgagtcctcaccaaatcccactattgaagaggggagaacactcagggtgctgaagatggttgaaccttggttgcggggaaaccaattttgtatcaagattctgaatccgtacatgcccagcgtagtggagaccctcgagcagatgcagcgcaaacatggtggcatgcttgtcagaaacccactgtcgagaaattctactcacgaaatgtattgggtgagttgcgggacaggaaacatcgtttccgcagtgaatatgaccagccgaatgttactgaaccggttcacgatggcccaccgtaagcctacctacgagagagatgtcgacttgggcgctggtacacgccatgtggccgtagaacccgaggtggcaaacctcgatattatcgggcagaggatagaaaatattaaacacgagcataagtcaacttggcactatgacgaggataacccttacaaaacctgggcctatcatggatcctacgaagttaagccatctggcagcgctagttccatggtcaatggcgtggtgaagctgctaacaaaaccctgggacgtcatccctatggttactcaaatcgcgatgaccgatacaaccccatttgggcagcagcgggtgttcaaggagaaagtagacactagaacgcccaaggccaaacgcggaacaacccaaattatggaagtgactgcaaggtggctttggggttttctgagccgaaacaagaagccgcggatatgtaccagagaggagttcacaaggaaagtccgctctaatgctgccatcggcgcagtgtttgttgacgagaaccagtggaactcagccaaggaggctgtggaagatgagcgtttctgggacctcgtccaccgggaaagagagctgcacaaacaggggaagtgcgccacgtgcgtgtataacatgatgggaaaaagggaaaagaagttgggcgagtttggtaaagcgaaggggagtcgcgcaatttggtacatgtggctgggagcccgattcctcgagttcgaagctcttggctttatgaatgaggatcattggttctcccgggaaaacagcctgtctggcgtagagggggagggattacacaaactgggttacatcttgagagacatttcgaagatccctggcgggaatatgtatgccgatgacaccgcaggatgggatactaggataacagaagacgatctccagaacgaggctaaaatcaccgacattatggaaccagagcatgccctgctagctaaggccatctttgaacttacttaccaaaataaagttgtgcgcgtccagagacccgcaaagaacggcacagtgatggatgtgatttcacggagggaccagcgtggtagcgggcaggtcggaacctatggcctgaatacattcactaacatggaggcgcaactcatccgacagatggagtccgaaggcatatttagtccttctgagctggaaaccccaaacttggccgagcgcgttttagattggctggaaaagtacggggtggagagactcaaacggatggctattagcggagacgactgtgtagtgaagcccatcgatgacaggttcgccacggcacttaccgctctgaatgatatgggtaaagtccgcaaggacatcccgcagtgggagccttccaaaggctggaacgattggcagcaagtgcccttttgctcacaccacttccatcagctaattatgaaggacgggagagaaatagttgtgccatgtcggaatcaggatgagctggtcggaagggcccgagtgagtcagggcgcaggttggtctctccgtgaaacagcctgcttgggaaagagctatgcgcaaatgtggcagctgatgtactttcacagacgcgaccttcggctggctgccaacgcaatctgttccgccgtacctgttgattgggtgcccacttcaaggaccacatggagcattcatgctcaccatcagtggatgactaccgaggacatgctctctgtctggaatagagtgtggatcgaagagaacccatggatggaggataaaacgcacatttccagttgggaagacgttccctatttaggaaagcgcgaggaccaatggtgcggcagcctgatcggcttgacagcccgggcaacctgggctactaatatacaggtggccatcaaccaggtcaggcgactgattgggaatgaaaactacctcgattacatgacatcgatgaaaagattcaagaatgagtccgaccctgagggagcgctttggtga

SEQ ID NO: 14164 - RNA, 9879 nt, synthetic construct
  misc_feature 1..9879: note = derived and/or modified CDS sequence (opt3) from DENV-1__KC762630__SS-prME
  source 1..9879: mol_type = other RNA
agcgtgacagtactgttcatgctccttcccacagccctggcttttcacttgactacgcgaggcggggaacctcatatgatcgtttccaagcaggaaaggggaaaatctttactgttcaagacctcagccggtgtgaacatgtgcacactgattgccatggacctcggcgagctgtgtgaagatactatgacctacaaatgcccacggataacagagaccgaaccggacgatgtagactgttggtgcaatgcgactgagacatgggtgacctatgggacgtgtagtcagactggagagcaccgccgagataagcgtagcgtcgctcttgcaccccatgtgggcctgggtttggaaaccagaacagagacttggatgtcctctgaaggggcatggaaacagatccagaaggttgagacctgggccctcaggcaccctggatttacagtgattgctctgttcctggcacatgccatcggcacctcgattacgcagaagggcatcatatttatcctcttaatgctggtcactccatcaatggctatgcggtgcgtggggattggaaaccgcgacttcgtagagggtcttagcggcgccacatgggttgatgtggtcttggaacacgggagttgtgtgaccactatggcgaaaaataagcccacactggacatcgagctactcaaaaccgaagtgacgaaccctgcaattctgagaaaactttgcatcgaggccaaaatatccaataccacaactgattctaggtgtccaacccaaggagaagctacactggtcgaggagcaggacactaactttgtttgccggcgcaccttcgtggatcgaggctggggtaatgggtgtggattgtttggcaagggcagcctcattacatgcgccaagttcaaatgcgtaaccaagctggaagggaaaatcgtgcagtacgagaacttaaagtattccgtcattgtgactgttcacacgggagaccagcatcaagtgggtaatgaaacaaccgagcacggcactaccgcaatcatcacaccccaggctcctacctcagaaattcagctgactgattacggggccctcacacttgactgtagtccaagaacgggactggactttaacgagatggtcttgctaaccatgaaagagaaaagctggctggtgcataaacagtggttcctcgatctgccgcttccctggacttctggcgcgtccacatcacaagaaacctggaataggcaggacctgttggtaacatttaagactgcccacgcaaagaaacaggaagttgtggtcctcggtagccaagaaggggctatgcacaccgccctgacgggcgctaccgagatacagacaagtggaactaccacaatcttcgccggccatttaaagtgccggctgaaaatggataagctaactctcaaaggggtgtcttatgtcatgtgtaccggatccttcaagctggaaaaggaggtggcagagacgcagcacggtacagttcttgtgcaggtaaaatacgaaggcaccgacgccccttgcaagattccatttagctcgcaagatgagaaaggggtcatccagaacggacgtttgataactgctaatcccattgtgacagacaaggaaaaacctgttaacatcgaggcggagccacccttcggcgaatcttatatcgtggtcggtgcaggggagaaggccctgaagctctcctggtttaaaaagggctcaagtattggaaaaatgttcgaagctaccgcccgcggcgcaagaaggatggccatcctgggggatactgcttgggactttggaagcattggtggcgtgttcacctccgtagggaaacttgtgcatcagatatttggaacagcctacggcgttctgttctctggtgtcagctggacgatgaaaatcgggattggcatcttgctcacctggctgggattaaattcacggagtacttccctgagcatgacatgtatcgcagtgggcatggtgaccctatacctcggggtcatggttcaggcggattctggatgcgtgattaactggaagggccgagagctgaagtgtggttcagggatatttgtgacaaacgaagtacacacttggaccgagcaatataaattccaggctgacagtccgaagcgccttagcgccgcaatcggaaaagcctgggaggaaggcgtctgcggtattagatccgctacgaggttggagaatatcatgtggaagcagatttctaacgaactgaatcatatcctcctggagaacgatatgaaatttacagtggttgtgggcgacgtctcggggatattagcccagggaaagaaaatgatccggcctcaacccatggaacacaagtacagctggaagtcctggggcaaagcaaagattatcggggctgacgtgcagaataccactttcattatcgatggaccaaacacccctgagtgtcccgacaatcagcgcgcctggaacatatgggaggttgaagattatggctttggtattttcacaactaatatctggctgaaacttagagactcatacacccaggtgtgcgatcacaggttgatgagtgcggccattaaggactctaaagctgtacatgcagatatggggtattggatcgagagcgaaaagaacgagacatggaagctcgcccgtgcttccttcatagaagtcaaaacgtgtatctggccaaagtcacacaccctgtggagcaatggagtgctagagtctgagatgattatccccaaaatttacggcggtcctgtgtcccaacataactatcggccaggctactttactcagacagccgggccgtggcacctgggaaagctcgaactggacttcgatctttgcgagggcaccactgtcgttgtggacgaaaattgcgggaaccgaggacccagtttgagaacaaccacggtaactggcaaaaccatccacgagtggtgttgcaggagctgtacactgcctccattacgctttaagggtgaggatgggtgctggtacggaatggaaatacggcccgtgaaggagaaagaagagaatctcgtcaagtctatggtgtccgcaggctcaggtgaagttgacagtttcagcctgggccttctgtgtatttcgatcatgatcgaggaggtgatgagatccaggtggtctcgcaaaatgttgatgaccgggactctcgcggtctttctgctactgacaatgggacagctcacctggaacgatctgattcgactttgcatcatggtgggcgccaacgctagcgacatgatggggatgggaacaacttatttggccctgatggcaaccttccggatgcgtcctatgtttgctgttggcttactcttcagaaggctgacgtcacgcgaaattcttctgctaacagtgggtctcagtctggtcgcctccgtagagttgccaaattctctggaagagttaggggacggactcgcaatgggcataatgatgctgaaacttctgaccgattttcaaccccatcagttgtgggccactctcctgagcctaaccttcgtgaaaacaactctgtcccttcactacgcttggaagaccatggcgatgatcctctcaattgttagcctgttgccgctgtgtttaagtacgacatctcagaagaccacttggctccctgtgctgcttggctccctggggtgcaaaccattgacaatgtttctcatcaccgaaaacaagatttggggacggagaagctggcccctgaatgagggtatcatggccataggcatcgtctcgattctactgtcatctcttctcaaaaacgacgtgcctctggcagggcccttgatcgctggaggcatgttaattgcctgttatgtaatcagtggttccagcgccgatctgtctctcgagaaggctgcagaagtgagctgggaggacgaagccgagcattccggggcgtcacacaatatactggtcgaagttcaggatgacggaactatgaaaattaaggatgaggagagggacgatacacttaccatcctgttgaaagctacgctactggtgatcagtggcgtgtacccaatgagcgtccctgccactctcttcgtgtggtatttttggcaaaagaagaaacagcgatctggcgttctgtgggacaccccctccccaccggaagtagagcgcgcagtgcttgataacgggatttaccggatattacagagaggactgctcggtaggtcacaggtcggcgtgggggttttccaagaaggagtgttccatacaatgtggcacgtcacccgtggcgccgtgttgatgtatcagggtaagcgcctggagcctagttgggctagcgtcaagaaggacctcatctcctacgggggaggctggcggtttcagggctcttggaatacaggggaggaagtccaggtgattgcagttgagcccggcaagaacccaaagaatgtgcaaactacccccggtacgttcaagacacctgaaggcgagatcggggccattgcgctggattttaaaccaggaacttcgggcagccccatcgtcaacagagaaggtaagatagtggggctttacggaaatggcgttgtgaccacatcaggcacctatgtctccgctatcgcccaggcaaaagtgagtcaggaggggcctctgccggagattgaagacgaggtattcaggaagcgaaacttgactatcatggacctacacccaggatctggtaaaacccggcgctacctgcccgccattgtgagagaagctatcaagaggaagctccggacattagttctggcccctacgcgagtcgtggcaagcgagatggctgaagcccttaaaggcatgccaataagatatcaaactaccgcggtgaagtccgagcatacagggaaagagattgtcgatctgatgtgccacgccacctttactatgcgcctcttgtcacccgtaagggtgcctaattacaacatgatcatcatggacgaagcacatttcacagatccggcttctattgccgctcgtggatatatcagcacccgggttggcatgggtgaggcagccgccatatttatgacggctactcccccagggagtgtggaagcgttccctcagtccaatgcagtcattcaggacgaggaaagagatatccccgagaggagctggaactctggatacgagtggattacagactttccaggcaagaccgtgtggttcgttccttcaatcaaatccggcaacgatatagccaattgtctgcgcaagaacgggaagcgagtggtccagctcagtagaaaaacctttgacactgaatatcaaaagaccaagaataacgattgggactacgtggtaaccacagatattagcgagatgggagctaatttccgggccgacagggtgatcgacccccgccgttgcctgaagccagttatccttaaagatggtccggaaagagtcattctagcaggccctatgcccgtgactgtggcctcggctgcgcagcggagggggcgcatcggacgaaacccaaataaggagggcgaccagtacgtctatatgggtcagcccctgaacaatgatgaggaccacgcccattggacggaagcaaagatgttgttagataacattaatacccctgaggggataatcccagctctgttcgaacccgagagagaaaaatctgccgcaattgacggcgagtaccggctcaggggagaggcccgcaagacatttgttgaactgatgagaaggggcgatcttcctgtgtggctgtcctataaagtagctagcgaggggttccaatactcagaccggcgttggtgctttgatggagaacgcaacaatcaggtgctcgaggaaaacatggacgtcgagatctggactaaggagggtgaaaggaaaaagttgagaccgagatggctggatgcccggacctatagtgacccactagcgctgcgcgagttcaaagaatttgcagccggcagaaggtctgtgtccggggatctcatccttgagattggaaagctgccccagcacttaacattgaaggctcagaatgccctggacaacctcgttatgctgcacaacagcgaacaaggcggtaaggcttaccggcatgcaatggaggagcttcctgacaccatagaaactctgatgctcttggccctgatcgctgtgttaaccgggggagtcacgctattctttctgtcaggacgaggcctcgggaagacaagtattggacttctgtgtgtaatggccagctccgcattgctgtggatggcgtctgtggagccccactggatcgccgctagcattatcctcgagttctttctgatggttcttctcataccagagcctgatagacagcgcactccccaggacaatcagctggcctatgtggtcatcggtttgctgttcatgattttaaccgtggcagctaacgagatgggcctactggaaacaaccaaaaaggatctcgggatcggacatgccgcagccgagaatcaccaccatgctgcgatgcttgacgtcgatctgcacccagcctccgcatggactttgtacgctgtggccacaacgattatcacccctatgatgaggcatactatagaaaacacaaccgccaatatttcactgaccgcaatcgctaaccaagccgcgattctcatgggcctggacaaaggttggccgatctctaagatggatataggggttccccttttagctctgggctgctacagtcaggtgaatccactcacattgactgccgcagtactgatgctagtggcccactatgctatcattggacctggcctgcaggcaaaggccacgcgggaggcgcaaaaacgtaccgctgccgggatcatgaagaaccccacagtcgacggaattgttgcaatcgatctcgacccagtgatatacgatgccaaatttgaaaagcagcttggccagattatgctgttgatcctgtgtacttcgcagatcctcctgatgagaaccacatgggctttatgcgagagcattacccttgccactggtcctctgacgacactctgggaggggtcccccggaaaattctggaataccactatcgcagtctctatggctaacatatttaggggctcatatctagccggtgcgggcctggccttcagcttgatgaagtccctagggggaggccgccgggggaccggagcacaaggcgaaacactcggtgagaagtggaaacgacagcttaatcagctgagtaagtctgagttcaacatttacaaaagaagcgggatcattgaggtggacaggtcagaagctaaggagggattgaaacgcggcgagactaccaagcatgccgtatcccggggtacagcaaagctgagatggtttgtggaacgtaatctcgttaaaccggagggcaaggtgatcgatttagggtgtggaaggggcgggtggagttattactgcgctggactgaaaaaggtcacggaagtgaaaggctataccaagggtgggccaggacacgaggaacctatacccatggccacttacggctggaaccttgtcaaactgcacagcggcaaggacgtgttctttacaccacccgagaagtgtgacaccctactctgcgatatcggggagtcttcccctaatccgactattgaagagggacggacactgcgcgttttgaaaatggtagaaccctggctgcgaggtaaccagttctgtatcaagattctcaatccatacatgccttcagtggtcgagacccttgagcaaatgcagagaaaacatggcgggatgctggtgaggaaccccttaagccggaactcgacgcacgaaatgtattgggtttcttgcggaaccggcaatatcgtgagtgccgtcaacatgacatcccgcatgctgttgaatagatttactatggcgcataggaagcctacctacgagcgagacgtggatctcggtgctgggacacggcacgtagcagtggaaccagaggttgccaacctggacattatcggacagcgtatagaaaatattaaaaacgagcacaagagcacttggcattatgatgaggacaatccctacaagacctgggcttatcacggctcatacgaagtcaaaccttccggctctgccagcagtatggtgaacggggtggtcagactacttacaaagccatgggatgttatccccatggtgacccagatcgcaatgactgacacgacaccgttcggacaacagcgcgtatttaaagagaaggtggataccaggactcctaaagccaagcggggtaccgctcagattatggaagtcacagcgagatggctgtggggcttcctctcccgcaataagaaaccaaggatatgtacgcgagaggaatttacccggaaggtgagaagcaacgccgcaatcggggctgttttcgtggacgagaatcaatggaactctgccaaagaggcagtcgaagatgagaggttttgggacctggtgcatcgcgaacgtgagttgcacaagcagggaaaatgcgccacttgcgtatataatatgatgggcaagcgggaaaagaaactgggtgagttcgggaaggctaaaggatcaagagccatttggtacatgtggctcggcgcgaggtttcttgagttcgaagcactgggcttcatgaacgaggaccattggtttagtcgcgaaaattccttaagcggggttgagggagagggtctgcacaagttgggctacatcctccgagatatttctaaaatccccgggggaaacatgtatgccgacgatacagctggctgggacacccggataactgaagatgacctgcagaacgaggccaagatcacagatattatggaacctgagcacgcactacttgctacctcgatcttcaaactgacataccagaataaggtggtcagagtgcaaaggccaggtaagaacgggactgtgatggacgtcatttcacgcagagatcagcggggaagcggccaggttggcacctatgggctcaatacgtttaccaacatggaagcccagctgatcaggcaaatggagtccgagggaatattcagtccctctgaattggagacaccgaatttagctgaacgtgtgtttgactggctggagaaacatggtattgaacgactcaagcgcatggccatcagcggcgatgactgtgtagtgaaacctatcgatgacagattcgcaactgcgcttaccgccctgaacgacatggggaaggtccggaaagatattccccagtgggagccatccaagggatggaatgactggcaacaggtgcctttttgctcacaccatttccaccaactaataatgaaggatggcagggagatcgttgtgccctgtcgcaaccaggacgaactggtcggtagagctcgggtgagtcagggggccggatggtctctcagggagacagcatgcttgggcaaaagctacgctcagatgtggcaactgatgtattttcaccgacgtgatcttagactggccgcaaatgccatttgttccgcggtaccagttgactgggtgcccacttcacgcaccacgtggagcatccatgctcaccatcagtggatgacaaccgaagatatgctctctgtctggaaccgggtgtggattgaggaaaatccttggatggaggacaagactcacgtttccagttgggaggatgtgccatacttaggcaaaagggaagaccagtggtgcgggagcctgatcggattgacagccagagcaacctgggccactaacatacaagtcgctatcaatcaggtgcgccggctgattggtaacgagaattatctcgattacatgacctcgatgaagaggttcaaaaacgaatccgacccggagggcgccctttggtga

SEQ ID NO: 14165 - RNA, 9879 nt, synthetic construct
  misc_feature 1..9879: note = derived and/or modified CDS sequence (opt3) from DENV-1__KC762641__SS-prME
  source 1..9879: mol_type = other RNA
agcgtgaccatgctgctcatgcttatgcccacagcactggctttccacttgactacgaggggaggggaacctcatatgatcgtctccaagcaggaaaggggaaaatctttactgtttaagacctcagccggtgttaatatgtgcacattaattgccatggacctcggcgagctgtgtgaagatactcttacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaagcagagattttgtggagggtttgagtggcgcgacttgggtagacgttgtgctggagcacgggtcctgtgtcacaaccatggcaaaggataaacccactctggacatcgaactcctgaagacagaggtgaccaaccctgccgtgcttaggaaactgtgcattgaagctaagatctctaatacgaccacagatagccggtgtccaactcaaggagaggccaccttggtcgaagaacaggacgcaaacttcgtttgccgccgaacatttgtggatagaggctggggtaatgggtgtggactcttcggcaaaggctccctgataacttgcgctaagtttaagtgcgtaaccaaattagaggggaagattgtgcagtacgaaaacctgaaatattcagtcatcgtgacagttcacaccggagaccagcatcaagtgggtaatgagagtactgaacacggcacgacagccaccattactccccaggcgcctaccacagagatccagctcaccgactacggggcccttactctggattgtagcccaaggacaggattggacttcaacgaaatggtcctactgacgatgaaggagaaatcttggctcgtgcataagcagtggtttctggatcttccgctgccctggacctccggcgcatcaactagccaagagacatggaatcggcaggacttgctcgtaaccttcaaaacagctcacgccaagaagcaggaagttgtggtcctgggtagtcaagagggggctatgcacactgccttaaccggcgcaacggaaatccagacctctggaacaactaccatttttgccggccatctgaaatgccgtctaaagatggataaactcacactgaaggggatgtcctatgtgatgtgtactggatcgttcaaacttgagaaggaagtcgctgagacccagcacggtacggtgttggttcagataaagtacgagggcacagacgcgccttgcaaaatcccattctcgacccaagatgaaaagggggtgactcagaacggacgcctgattacagcaaatcccatcgtaaccgacaaagagaagcctgtcaacatagaagccgagccaccctttggcgagtcttatattgtgatcggtgctggggaaaaagccctcaagctgtcctggttcaagaaaggctcaagtatcggaaagatgtttgaggcaactgccagaggcgctaggcggatggccattcttggggataccgcatgggacttcggaagcatcggtggcgtttttacatccgtggggaaactggtccatcagattttcggaacggcgtacggcgtgttgttttctggtgtaagctggaccatgaagatagggatcggcgtgctcctgacttggttaggactaaattcacgaagtacatccctaagcatgacctgtattgctgttggcctcgtcacactgtaccttggggtgatggtgcaggccgattctggatgcgtcatcaactggaaaggccgcgaattgaagtgtggttcagggatcttcgttactaatgaggtgcacacctggacggaacaatataagtttcaggcagacagtccgaaaagactgagcgccgctattggaaaggcctgggaggagggcgtgtgcggtataaggtccgcaacacggctcgaaaacatcatgtggaaacagatttctaacgagctgaatcatatcttactggaaaacgacatgaagttcaccgtagtcgtgggcgatgttgctgggattcttgcccagggcaaaaagatgatccgccctcaacccatggagcacaaatactcgtggaaaagctggggcaaggcgaaaataatcggggccgacgtgcagaatactacctttattatcgatggaccaaacacacctgaatgtcccgacgatcagagagcttggaatatttgggaggtcgaggactatggcttcggtatctttactaccaacatatggttgaagctcagggattcctacacacaggtgtgcgaccaccgtctgatgtcagcagccattaaagatagtaaggctgttcatgccgacatggggtattggatcgaatctgagaaaaatgaaacgtggaagctagcacgggcgagcttcattgaggtgaagacctgtatctggccaaaatcccacactctgtggtcaaacggagtactcgaaagcgagatgataatccccaagatttacggcggtcctatctctcaacataattatcgaccaggctacttcacacagaccgccgggccgtggcacctgggaaaacttgagttggattttgacctgtgcgaaggcactacagtcgtggtggatgagcactgcgggaacagaggaccctccttaaggaccacgactgtcaccggcaagattatccatgaatggtgttgccgcagttgtacactccctccactgcggttcagaggtgaggacgggtgctggtacggaatggagataaggcccgttaaagaaaaggaggaaaatcttgtgaagtccatggtatctgctggctccggtgaggtggactcatttagtctgggcttgctctgtattagcatcatgatcgaagaggtcatgcgctcgcgatggtcccggaaaatgctgatgaccgggactctagccgtgttctttctgctcattatgggacagctgacatggaacgatcttatccgtttgtgcattatggttggcgcaaatgcttctgacagaatggggatgggaaccacatatctggccttaatggcaactttcaagatgaggcctatgtttgccgtgggcctcctgttccgccggcttaccagcagagaggtcctgctactcacgataggtctgtcattggtggctagtgttgaactgccaaactccttagaggaactcggggatggactggcgatgggcatcatgattcttaaactgttgacagactttcaatctcaccagctctgggccaccctgctaagcctgactttcatcaagaccacattttcccttcattacgcatggaaaactatggctatggtgctctcaattgtcagcctgttccccttgtgtctgagtaccacgtctcagaagacaacctggttaccggtactcctgggctcccttgggtgcaagcctctgactatgtttttgatcgccgagaataaaatatggggaagaaagagctggccactcaacgaaggtatcatggccgtgggcattgtttcgatcctgctatcatctctgcttaaaaacgatgtgcccctcgctgggcctctgattgcaggaggcatgttgatcgcctgttatgtcataagtggttccagcgcggacttatctctggagaaggctgccgaggtgagctgggaagaggaagcagagcactccggggcctcacataatattctcgtagaagtgcaggatgacggaacaatgaaaatcaaggatgaggagcgagacgataccctgactatccttctgaaagctacattgctagcagtcagtggcgtttaccccctgagcattccagccaccctcttcgtgtggtatttctggcaaaagaagaaacagcgctctggcgtgctgtgggacacgccttcacccccagaagtcgagcgggcggtgcttgatgacgggatatacagaatcatgcagaggggattactgggtcgtagccaggttggcgtaggggtgtttcaagaaaacgtcttccacactatgtggcacgtgacccgcggagctgttctcatgtatcagggcaagcggttggagccgagttgggccagcgtgaaaaaggacctgatttcctacggtgggggatggagactccagggctcttggaatacaggcgaggaagtccaggtgatcgcagtagagcctgggaaaaaccccaagaatgtccaaaccgccccaggaacatttaagactcccgaaggtgaggtgggcgctattgccctggatttcaaacctgggacctcgggaagcccaatcgttaacagggaaggcaagatagtgggtctttacgggaatggagtcgtgacgacatcaggcacttatgtttccgcaatcgctcaggccaaagcgagtcaggagggccccctgcctgagattgaagacgaggtgtttcgaaagcggaacttgaccatcatggatctacatccggggtctggaaaaacacgcagatacctgccagccattgtcagggaagcaatcaagcggaagctccgaaccttaatactggctcccactagagtggtagccagcgagatggctgaagcacttaaaggtatgcctattcgctatcaaaccacagccgtgaagtccgagcacacgggcaaagagatcgttgacctgatgtgccatgccactttcaccatgaggctcttgtcaccagtccgtgtgcccaattacaacatgatcattatggatgaagctcactttacagacccttctagcatcgcggcacgggggtatataagtaccagagtgggaatgggcgaggccgctgccattttcatgactgcaacaccgcccggttccgtcgaagcctttccacagagcaatgctgtaatccaggatgaggaaagggacattcctgagcgctcttggaactcagggtacgagtggatcaccgatttccccggaaagacggtgtggtttgttccatccataaaaagtggcaatgacattgcgaactgtctgcgaaagaatggcaagagagtgatccagctcagccggaaaactttcgatacagaatatcaaaagaccaaaaacaacgactgggactacgtcgtgaccactgatatctcggagatgggggccaatttcagggcagaccgcgttattgatcctcgtagatgcctgaagcccgtgatccttaaagacggaccagaacgggtcattctagctggtccgatgcctgtgacagtagcctctgcagcccagaggcgcggccgagtggggagaaaccataataaggagggagatcagtacatatatatgggccagcccctgaacaatgacgaggatcacgctcactggaccgaagccaagatgttgttagacaacatcaatacaccagagggtattatccccgcgctgtttgaacctgagcgggaaaaatccgcagccatcgatggggagtacaggctccgcggcgaggctagaaagactttcgttgaactgatgaggcggggagaccttccagtctggctgagctataaagtggcctcagagggctttcaatacagtgatcgtcgctggtgcttcgacggggaacgaaacaatcaggtgctcgaggaaaacatggatgtcgagatttggacgaaggagggagaaaggaaaaagttgaggccccggtggctggacgctcgcacctattctgaccctctagcactgagagagtttaaagagttcgccgctggtaggcggtccgttagcggcgatctcatacttgagatcgggaagctgccgcagcatttaacacagcgagcccaaaatgcattggacaacctggtgatgctccacaattcagaacagggaggcagagcgtaccgccatgccatggaggagctgccagatactattgaaacccttatgctgctcgctttgatcgccgtactgacaggtggggtgaccttatttttcctaagtggcaggggactgggcaagactagcattgggctcctttgtgtcatggcatcctctgtgctgttgtggatggctagcgttgagccccactggatcgccgcatccataatcctggaatttttcctcatggtgctgcttattcctgagcccgaccggcagcgtacgccacaggataaccaactcgcctatgtcgtaatcggactgttgtttatgattctgaccgtgacagctaatgagatgggtttactagaaactaccaaaaaggacctgggcatcgggcacgttgcggtggagaaccatcaccatgccgcaatgctcgatgtcgaccttcaccctgcttcagcctggacactgtacgccgtggcaaccactataattacacccatgatgagacatacgatcgaaaacaccactgctaatatttctttgacagccatcgcgaaccaggctgccatactgatgggactcgataaaggctggccaatcagtaagatggacattggtgtccctctgcttgcattagggtgctacagccaggtgaatccgctgaccctcaccgccgctgttttgatgctggtggcacactatgccatcattggccccggactacaagcgaaagctacaagggaggcccagaagcgcactgcagccggcatcatgaagaacccaacggtagatgggatagtggctattgacctggatcctgtcgtttacgacgccaaattcgaaaagcagctcggacagatcatgcttctgatcttgtgtaccagccaaattctgctcatgcggacaacttgggcactgtgcgagtccatcaccttagctacaggcccccttaccactctgtgggagggttctccagggaaattttggaatacgacaatagccgtgtcaatggcgaacattttccgaggaagctatctcgccggcgcaggtctagctttctccctgatgaagagtttgggcgggggaagaaggggcaccggggcccagggagaaactctgggcgagaaatggaagcgccagctcaatcagctttctaagagcgaatttaacacctacaaacggtcaggtatcatggaggtcgacagatccgaagcaaaggaggggctgaaacgtggagagacaactaagcacgctgtgagtaggggcaccgccaaattgcggtggttcgtagaacgcaatctggtgaagcctgagggtaaggttattgatctcggctgtgggcgaggaggctggagctattactgcgccgggctaaagaaggtgacagaagtcaaaggatatacgaagggcggtcccgggcatgaggaaccgatcccaatggcgacctacggatggaacctggtgaaacttcactctggcaaggacgtctttttcatacctcccgagaaatgtgatactctgctatgcgacatcggcgagtcctcaccaaatcccacaattgaagaggggagaaccctcagggtgctgaagatggttgaaccttggttgcggggaaaccaattttgtatcaagattctgaatccgtacatgcccagcgtagtggagactctcgagcagatgcagcgcaaacatggtggcatgcttgtcagaaacccactgtcgagaaattctacacacgaaatgtattgggtgagttgcgggaccggaaacatcgtttccgctgtgaatatgacgagccgaatgttactgaaccggttcaccatggcacaccgtaagcctacatacgagagagatgtcgacttgggcgccggtactcgccatgtggctgtagaacccgaggtggccaacctcgatattatcgggcagaggatagaaaatattaaacacgagcataagtcaacctggcactatgacgaggataacccttacaaaacatgggcatatcatggatcctacgaagttaagccatctggcagcgccagttccatggtcaatggcgtggtgaagctgctaactaaaccctgggacgtcatccctatggttacccaaatcgctatgacagataccactccatttgggcagcagcgggtgttcaaggagaaagtagacacgagaacacccaaggcgaaacgcggaaccactcaaattatggaagtgaccgccaggtggctttggggttttctgagccgaaacaagaagccgcggatatgtacaagagaggagttcacgaggaaagtccgctctaatgcagctatcggcgccgtgtttgttgacgagaaccagtggaactcagcaaaggaggccgtggaagatgagcgtttctgggacctcgtccaccgggaaagagagctgcacaaacaggggaagtgcgctacctgcgtgtataacatgatgggaaaaagggaaaagaagttgggcgagtttggtaaagccaaggggagtcgcgcgatttggtacatgtggctgggagcacgattcctcgagttcgaagcccttggctttatgaatgaggatcattggttctcccgggaaaacagcctgtctggcgtagagggggagggattacacaaactgggttacatcttgagagacatttcgaagatccctggcgggaatatgtatgctgatgacactgccggatgggatacaaggataaccgaagacgatctccagaacgaggcaaaaatcactgacattatggaaccagagcatgctctgctagccaaggctatctttaaacttacataccaaaataaggttgtgcgcgtccagagacccgccaagaacggcaccgtgatggatgtgatttcacggagggaccagcgtggtagcgggcaggtcggaacatatggcctgaatactttcaccaacatggaagcacaactcatccgacagatggagtccgagggcatatttagtccttctgaactggagacgccaaacttggcggaacgcgttttagattggctggagaaatacggggtggaaagactcaagcggatggccattagcggagacgactgtgtagtgaaacccatcgatgacaggttcgctaccgcccttacagcactgaatgatatgggtaaggtccgcaaagacatcccgcagtgggagccttccaagggctggaacgattggcagcaagtgcccttttgctcacaccacttccatcagctaattatgaaggacgggagagagatagttgtgccatgtcggaatcaggatgaactggtcggaagggctcgagtgagtcagggcgccggttggtctctccgtgagactgcatgcttggggaaaagctatgcccaaatgtggcagctgatgtactttcacagacgcgaccttcggctggcggctaacgccatctgttccgcagtacctgttgattgggtgcccacctcaaggacaacttggagcattcatgcccaccatcagtggatgaccacggaagacatgctctctgtctggaatagagtgtggatcgaggaaaacccatggatggaggataagacacacatttccagttgggaggacgttccctatttaggaaaacgcgaagaccaatggtgcggcagcctgatcggcttgaccgctcgggccacttgggcaacaaatatacaggtggctatcaaccaggtcaggcgactgattgggaatgagaactacctcgattacatgacctcgatgaagagattcaaaaatgaatccgaccctgagggagccctttggtga

SEQ ID NO: 14166 - RNA, 9879 nt, synthetic construct
  misc_feature 1..9879: note = derived and/or modified CDS sequence (opt3) from DENV-1__KC762648__SS-prME
  source 1..9879: mol_type = other RNA
agcgtgaccatgctgctcatgcttatgcccacagcactggctttccacttgactacgaggggaggggaacctcatatgatcgtctccaagcaggaaaggggaaaatctttactgtttaagacctcagccggtgttaatatgtgcacattaattgccatggacctcggcgagctgtgtgaagatactcttacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaagcagagattttgtggagggtttgagtggcgcgacttgggtagacgttgtgctggagcacgggtcctgtgtcacaaccatggcaaaggataaacccactctggacatcgaactcctgaagacagaggtgaccaaccctgccgtgcttaggaaactgtgcattgaagctaagatctctaatacgaccacagatagccggtgtccaactcaaggagaggccaccttggtcgaagaacaggacgcaaacttcgtttgccgccgaacatttgtggatagaggctggggtaatgggtgtggactcttcggcaaaggctccctgataacttgcgctaagtttaagtgcgtaaccaaattagaggggaagattgtgcagtacgaaaacctgaaatattcagtcatcgtgacagttcacaccggagaccagcatcaagtgggtaatgagagtactgaacacggcacgacagccaccattactccccaggcgcctaccacagagatccagctcaccgactacggggcccttactctggattgtagcccaaggacaggattggacttcaacgaaatggtcctactgacgatgaaggagaaatcttggctcgtgcataagcagtggtttctggatcttccgctgccctggacctccggcgcatcaactagccaagagacatggaatcggcaggacttgctcgtaaccttcaaaacagctcacgccaagaagcaggaagttgtggtcctgggtagtcaagagggggctatgcacactgccttaaccggcgcaacggaaatccagacctctggaacaactaccatttttgccggccatctgaaatgccgtctaaagatggataaactcacactgaaggggatgtcctatgtgatgtgtactgggagcttcaaacttgagaaggaagtcgctgagacccagcacggtacggtgttggttcagataaagtacgagggcacagacgcgccttgcaaaatcccattctcgacccaagatgaaaagggggtgactcagaacggacgcctgattacagcaaatcccatcgtaaccgacaaagagaagcctgtcaacatagaagccgagccaccctttggcgagtcttatattgtgatcggtgctggggaaaaagccctcaagctgtcctggttcaagaaaggctcaagtatcggaaagatgtttgaggcaactgccagaggcgctaggcggatggccattcttggggataccgcatgggacttcggaagcatcggtggcgtttttacatccgtggggaaactggtccatcagattttcggaacggcgtacggcgtgttgttttctggtgtaagctggaccatgaagatagggatcggcgtgctcctgacttggttaggactaaattcacgaagtacatccctaagcatgacctgtattgctgttggcctcgtcacactgtaccttggggtgatggtgcaggccgattctggatgcgtcatcaactggaaaggccgcgaattgaagtgtggttcagggatcttcgttactaatgaggtgcacacctggacggaacaatataagtttcaggcagacagtccgaaaagactgagcgccgctattggaaaggcctgggaggagggcgtgtgcggtataaggtccgcaacacggctcgaaaacatcatgtggaaacagatttctaacgagctgaatcatatcttactggaaaacgacatgaagttcaccgtagtcgtgggcgatgttgctgggattcttgcccagggcaaaaagatgatccgccctcaacccatggagcacaaatactcgtggaaaagctggggcaaggcgaaaataatcggggccgacgtgcagaatactacctttattatcgatggaccaaacacacctgaatgtcccgacgatcagagagcttggaatatttgggaggtcgaggactatggcttcggtatctttactaccaacatatggttgaagctcagggattcctacacacaggtgtgcgaccaccgtctgatgtcagcagccattaaagatagtaaggctgttcatgccgacatggggtattggatcgaatctgagaaaaatgaaacgtggaagctagcacgggcgagcttcattgaggtgaagacctgtatctggccaaaatcccacactctgtggtcaaacggagtactcgaaagcgagatgataatccccaagatttacggcggtcctatctctcaacataattatcgaccaggctacttcacacagaccgccgggccgtggcacctgggaaaacttgagttggattttgacctgtgcgaaggcactacagtcgtggtggatgagcactgcgggaacagaggaccctccttaaggaccacgactgtcaccggcaagattatccatgaatggtgttgccgcagttgtacactccctccactgcggttcagaggtgaggacgggtgctggtacggaatggagataaggcccgttaaagaaaaggaggaaaatcttgtgaagtccatggtatctgctggctccggtgaggtggactcatttagtctgggcttgctctgtattagcatcatgatcgaagaggtcatgcgctcgcgatggtcccggaaaatgctgatgaccgggactctagccgtgttctttctgctcattatgggacagctgacatggaacgatcttatccgtttgtgcattatggttggcgcaaatgcttctgacagaatggggatgggaaccacatatctggccttaatggcaactttcaagatgaggcctatgtttgccgtgggcctcctgttccgccggcttaccagcagagaggtcctgctactcacgataggtctgtcattggtggctagtgttgaactgccaaactccttagaggaactcggggatggactggcgatgggcatcatgattcttaaactgttgacagactttcaatctcaccagctctgggccaccctgctaagcctgactttcatcaagaccacattttcccttcattacgcatggaaaactatggctatggtgctctcaattgtcagcctgttccccttgtgtctgagtaccacgtctcagaagacaacctggttaccggtactcctgggctcccttgggtgcaagcctctgactatgtttttgatcgccgagaataaaatatggggaagaaagagctggccactcaacgaaggtatcatggccgtgggcattgtttcgatcctgctatcatctctgcttaaaaacgatgtgcccctcgctgggcctctgattgcaggaggcatgttgatcgcctgttatgtcataagtggttccagcgcggacttatctctggagaaggctgccgaggtgagctgggaagaggaagcagagcactccggggcctcacataatattctcgtagaagtgcaggatgacggaacaatgaaaatcaaggatgaggagcgagacgataccctgactatccttctgaaagctacattgctagcagtcagtggcgtttaccccctgagcattccagccaccctcttcgtgtggtatttctggcaaaagaagaaacagcgctctggcgtgctgtgggacacgccttcacccccagaagtcgagcgggcggtgcttgatgacgggatatacagaatcatgcagaggggattactgggtcgtagccaggttggcgtaggggtgtttcaagaaaacgtcttccacactatgtggcacgtgacccgcggagctgttctcatgtatcagggcaagcggttggagccgagttgggccagcgtgaaaaaggacctgatttcctacggtgggggatggagactccagggctcttggaatacaggcgaggaagtccaggtgatcgcagtagagcctgggaaaaaccccaagaatgtccaaaccgccccaggaacatttaagactcccgaaggtgaggtgggcgctattgccctggatttcaaacctgggacctcgggaagcccaatcgttaacagggaaggcaagatagtgggtctttacgggaatggagtcgtgacgacatcaggcacttatgtttccgcaatcgctcaggccaaagcgagtcaggagggccccctgcctgagattgaagacgaggtgtttcgaaagcggaacttgaccatcatggatctacatccggggtctggaaaaacacgcagatacctgccagccattgtcagggaagcaatcaagcggaagctccgaaccttaatactggctcccactagagtggtagccagcgagatggctgaagcacttaaaggtatgcctattcgctatcaaaccacagccgtgaagtccgagcacacgggcaaagagatcgttgacctgatgtgccatgccactttcaccatgaggctcttgtcaccagtccgtgtgcccaattacaacatgatcattatggatgaagctcactttacagacccttctagcatcgcggcacgggggtatataagtaccagagtgggaatgggcgaggccgctgccattttcatgactgcaacaccgcccggttccgtcgaagcctttccacagagcaatgctgtaatccaggatgaggaaagggacattcctgagcgctcttggaactcagggtacgagtggatcaccgatttccccggaaagacggtgtggtttgttccatccataaaaagtggcaatgacattgcgaactgtctgcgaaagaatggcaagagagtgatccagctcagccggaaaactttcgatacagaatatcaaaagaccaaaaacaacgactgggactacgtcgtgaccactgatatctcggagatgggggccaatttcagggcagaccgcgttattgatcctcgtagatgcctgaagcccgtgatccttaaagacggaccagaacgggtcattctagctggtccgatgcctgtgacagtagcctctgcagcccagaggcgcggccgagtggggagaaaccataataaggagggagatcagtacatatatatgggccagcccctgaacaatgacgaggatcacgctcactggaccgaagccaagatgttgttagacaacatcaatacaccagagggtattatccccgcgctgtttgaacctgagcgggaaaaatccgcagccatcgatggggagtacaggctccgcggcgaggctagaaagactttcgttgaactgatgaggcggggagaccttccagtctggctgagctataaagtggcctcagagggctttcaatacagtgatcgtcgctggtgcttcgacggggaacgaaacaatcaggtgctcgaggaaaacatggatgtcgagatttggacgaaggagggagaaaggaaaaagttgaggccccggtggctggacgctcgcacctattctgaccctctagcactgagagagtttaaagagttcgccgctggtaggcggtccgttagcggcgatctcatacttgagatcgggaagctgccgcagcatttaacacagcgagcccaaaatgcattggacaacctggtgatgctccacaattcagaacagggaggcagagcgtaccgccatgccatggaggagctgccagatactattgaaacccttatgctgctcgctttgatcgccgtactgacaggtggggtgaccttatttttcctaagtggcaggggactgggcaagactagcattgggctcctttgtgtcatggcatcctctgctctgttgtggatggccagcgtggagccccactggatcgcagcctccataatcctggaatttttcctcatggttctgcttattcctgagcccgaccggcagcgtacgccacaggataaccaactcgcttatgtggtcatcggactgttgtttatgattctgaccgtagcggccaatgagatgggtttactagaaacaactaaaaaggacctgggcatcgggcacgtggcagttgagaaccatcaccatgctgccatgctcgatgtggaccttcaccctgcctcagcatggaccctgtacgctgtcgccacaaccataattactcccatgatgagacatacaatcgaaaacacgaccgcgaatatttctttgactgctatcgccaaccaggcagccatactgatgggactcgataaaggctggccaatcagtaagatggacattggtgtgcctctgcttgctttagggtgctactcgcaggtcaatccgctgacactcaccgcagccgtgttgatgctggttgcgcactatgctatcattggccccggactacaagccaaagcaaccagggaggcccagaagcgcacagctgccggcatcatgaagaacccaactgtggatgggatagtagcaattgacctggatcctgtggtctacgacgctaaattcgaaaagcagctcggacagatcatgcttctgatcttgtgtacgagccaaattctgctcatgcggaccacatgggccctgtgcgagtccatcactttagcgaccggcccccttacaaccctgtgggagggttctccagggaaattttggaatactacgatagccgtttcaatggcaaacattttccgaggaagctatctcgctggcgccggtctagcattctccctgatgaagagtttgggcgggggaagaaggggcacaggggctcagggagaaaccctgggcgagaaatggaagcgccagctcaatcagctttctaagagcgaatttaacacttacaaacggtcaggtatcatggaggtggacagatccgaagccaaggaggggctgaaacgtggagagaccacaaagcacgccgtcagtaggggcactgcgaaattgcggtggttcgtggaacgcaatctggtaaagcctgagggtaaggtgattgatctcggctgtgggcgaggaggctggagctattactgcgctgggctaaagaaggttaccgaagtgaaaggatatacaaagggcggtcccgggcatgaggaaccgatcccaatggcaacgtacggatggaacctggtcaaacttcactctggcaaggacgtgtttttcatacctcccgagaaatgtgataccctgctatgcgacatcggcgagtcctcaccaaatcccactattgaagaggggagaacactcagggtcctgaagatggtggaaccttggttgcggggaaaccaattttgtatcaagattctgaatccgtacatgcccagcgttgtagagaccctcgagcagatgcagcgcaaacatggtggcatgcttgtgagaaacccactgtcgagaaattctactcacgaaatgtattgggtcagttgcgggacaggaaacatcgtgtccgccgttaatatgaccagccgaatgttactgaaccggttcacgatggctcaccgtaagcctacctacgagagagatgtggacttgggcgccggtacacgccatgtcgcagtggaacccgaggtagccaacctcgatattatcgggcagaggatagaaaatattaaacacgagcataagtcaacttggcactatgacgaggataacccttacaaaacctgggcttatcatggatcctacgaagtgaagccatctggcagcgcgagttccatggttaatggcgtcgtgaagctgctaacaaaaccctgggacgtgatccctatggtcactcaaatcgccatgaccgatacaaccccatttgggcagcagcgggttttcaaggagaaagtggacactagaacgcccaaggcaaaacgcggaacaacccaaattatggaagtaactgctaggtggctttggggttttctgagccgaaacaagaagccgcggatatgtaccagagaggagttcacaaggaaagtgcgctctaatgccgcaatcggcgccgtctttgtggacgagaaccagtggaactcagctaaggaggccgttgaagatgagcgtttctgggacctcgtgcaccgggaaagagagctgcacaaacaggggaagtgcgcgacgtgcgtctataacatgatgggaaaaagggaaaagaagttgggcgagtttggtaaagcaaaggggagtcgcgccatttggtacatgtggctgggagctcgattcctcgagttcgaagcccttggctttatgaatgaggatcattggttctcccgggaaaacagcctgtctggcgtggagggggagggattacacaaactgggttacatcttgagagacatttcgaagatccctggcgggaatatgtatgcagatgacaccgctggatgggatactaggataacagaagacgatctccagaacgaggccaaaatcaccgacattatggaaccagagcatgctctgctagccaaggcaatctttaaacttacttaccaaaataaggtagttcgcgtgcagagacccgcgaagaacggcacagtcatggatgtgatttcacggagggaccagcgtggtagcggacaggtgggaacctatggcctgaatacattcactaacatggaagcccaactcatccgacagatggagtccgaggaaatatttagtccttctgagctggaaaccccaaacttggctgagcgcgtcttagattggctggaaaaatacggcgttgagagactcaagcggatggccattagcggggacgactgtgtggtaaaacccatcgatgacaggttcgcaacggctcttaccgccctgaatgatatgggaaaggtgcgcaaagacatcccgcagtgggagccttccaagggttggaacgattggcagcaagtccccttttgctcacaccacttccatcagctaattatgaaggacggcagagaaatagtggttccatgtcggaatcaggatgagctggtggggagggcacgagtcagtcagggagccggctggtctctccgtgaaacagcgtgcttgggtaaaagctatgctcaaatgtggcagctgatgtactttcacagacgcgaccttcggctggccgcaaacgccatctgttccgctgtgcctgtagattgggttcccacttcaaggaccacatggagcattcatgcccaccatcagtggatgactaccgaggacatgctctctgtgtggaatagagtctggatcgaagagaacccatggatggaggataagacgcacatttccagttgggaagacgtgccctatttagggaaacgcgaggaccaatggtgcggaagcctgatcggcttgacagcacgggctacctgggccactaatatacaggttgcgatcaaccaggtgaggcgactgattggcaatgaaaactacctcgattacatgacatcgatgaagagattcaaaaatgagtccgaccctgagggggctctttggtga

SEQ ID NO: 14167 - RNA, 9879 nt, synthetic construct
  misc_feature 1..9879: note = derived and/or modified CDS sequence (opt3) from DENV-1__KC762622__SS-prME
  source 1..9879: mol_type = other RNA
agcgtgaccatgctgctcatgcttatgcccacggcactggctttccacttgactacgaggggaggggaacctcatatgatcgtctccaagcaggaaaggggaaaatctttactgtttaagacctcagccggtgttaatatgtgcacattaattgccatggacctcggcgagctgtgtgaagatactcttacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttatggcactgtttctcgcccatgctattggcacatcgatcacccagaagggcattatcttcatattactgatgcttgtgacgccatcaatggccatgcgctgcgtcgggatcggaagcagagattttgtggagggtttgagtggcgcgacttgggtagacgttgtgctggagcacgggtcctgtgtcacaaccatggcaaaggataaacccactctggacattgaactcctgaagacagaggtgaccaaccctgccgtgcttaggaaactgtgcatcgaagctaagatttctaatacgaccacagatagccggtgtccaactcaaggagaggccaccttggtcgaagaacaggacgcaaacttcgtttgccgccgaacatttgtggatagaggctggggtaatgggtgtggactcttcggcaaaggctccctgatcacttgcgctaagtttaagtgcgtaaccaaattagaggggaagatagtgcagtacgaaaacctgaaatattcagtcattgtgacagttcacaccggagaccagcatcaagtgggtaatgagagtactgaacacggcacgacagccaccatcactccccaggcgcctaccacagagattcagctcaccgactacggggcccttactctggattgtagcccaaggacaggattggacttcaacgaaatggtcctactgacgatgaaggagaaatcttggctcgtgcataagcagtggtttctggatcttccgctgccctggacctccggcgcatcaactagccaagagacatggaatcggcaggacttgctcgtaaccttcaaaacagctcacgccaagaagcaggaagttgtggtcctgggtagtcaagagggggctatgcacactgccttaaccggcgcaacggaaatccagacctctggaacaactaccatctttgccggccatctgaaatgccgtctaaagatggataaactcacactgaaggggatgtcctatgtgatgtgtactggatcgttcaaacttgagaaggaagtcgctgagacccagcacggtacggtgttggttcagattaagtacgagggcacagacgcgccttgcaaaataccattctcgacccaagatgaaaagggggtgactcagaacggacgcctgatcacagcaaatcccattgtaaccgacaaagagaagcctgtcaacatcgaagccgagccaccctttggcgagtcttatatagtgattggtgctggggaaaaagccctcaagctgtcctggttcaagaaaggctcaagtatcggaaagatgtttgaggcaactgccagaggcgctaggcggatggccatccttggggataccgcatgggacttcggaagcattggtggcgtttttacatccgtggggaaactggtccatcagatcttcggaacggcgtacggcgtgttgttttctggtgtaagctggaccatgaagattgggataggcgtgctcctgacttggttaggactaaattcacgaagtacatccctaagcatgacctgtatcgctgttggcctcgtcacactgtaccttggggtgatggtgcaggccgattctggatgcgtcattaactggaaaggccgcgaattgaagtgtggttcagggatcttcgttactaatgaggtgcacacctggacggaacaatataagtttcaggcagacagtccgaaaagactgagcgccgctatcggaaaggcctgggaggagggcgtgtgcggtattaggtccgcaacacggctcgaaaacataatgtggaaacagatctctaacgagctgaatcatattttactggaaaacgacatgaagttcaccgtagtcgtgggcgatgttgctgggatccttgcccagggcaaaaagatgattcgccctcaacccatggagcacaaatactcgtggaaaagctggggcaaggcgaaaatcataggggccgacgtgcagaatactacctttatcattgatggaccaaacacacctgaatgtcccgacgatcagagagcttggaatatctgggaggtcgaggactatggcttcggtatttttactaccaacatctggttgaagctcagggattcctacacacaggtgtgcgaccaccgtctgatgtcagcagccataaaagatagtaaggctgttcatgccgacatggggtattggattgaatctgagaaaaatgaaacgtggaagctagcacgggcgagcttcatcgaggtgaagacctgtatttggccaaaatcccacactctgtggtcaaacggagtactcgaaagcgagatgatcatacccaagatctacggcggtcctacatctcaacataattatcgaccaggctacttcacccagactgccgggccgtggcacctgggaaaacttgagttggattttgacctgtgcgaaggcacaaccgtcgtggtggatgagcactgcgggaacagaggaccctccttaaggacgactaccgtcacaggcaagattatccatgaatggtgttgccgcagttgtaccctccctccactgcggttcagaggtgaggacgggtgctggtacggaatggagattaggcccgttaaagaaaaggaggaaaatcttgtgaagtccatggtatctgctggctccggtgaggtggactcatttagtctgggcttgctctgtatcagcataatgattgaagaggtcatgcgctcgcgatggtcccggaaaatgctgatgactgggacactagccgtgttctttctgctcatcatgggacagctgacctggaacgatcttatccgtttgtgcattatggttggcgcaaatgcttctgacagaatggggatgggaacaacttatctggccttaatggcaaccttcaagatgaggcctatgtttgccgtgggcctcctgttccgccggcttacgagcagagaggtcctgctactcacaatcggtctgtcattggtggctagtgttgaactgccaaactccttagaggaactcggggatggactggcgatgggcattatgatacttaaactgttgaccgactttcaatctcaccagctctgggccactctgctaagcctgaccttcatcaagacaactttttcccttcattacgcatggaaaaccatggctatggtgctctcaattgtcagcctgttccccttgtgtctgagtacgacatctcagaagaccacttggttaccggtactcctgggctcccttgggtgcaagcctctgacaatgtttttgatcgccgagaataaaatttggggaagaaagagctggccactcaacgaaggtatcatggccgtgggcatagtttcgatcctgctatcatctctgcttaaaaacgatgtgcccctcgctgggcctctgattgcaggaggcatgttgatcgcctgttatgtcattagtggttccagcgcggacttatctctggagaaggctgccgaggtgagctgggaagaggaagcagagcactccggggcctcacataatatcctcgtagaagtgcaggatgacggaaccatgaaaataaaggatgaggagcgagacgatactctgacaattcttctgaaagctaccttgctagcagtcagtggcgtttaccccctgagcatcccagccacactcttcgtgtggtatttctggcaaaagaagaaacagcgctctggcgtgctgtgggacactccttcacccccagaagtcgagcgggcggtgcttgatgacgggatctacagaattatgcagaggggattactgggtcgtagccaggttggcgtaggggtgtttcaagaaaacgtcttccacaccatgtggcacgtgacacgcggagctgttctcatgtatcagggcaagcggttggagccgagttgggccagcgtgaaaaaggacctgatatcctacggtgggggatggagactccagggctcttggaataccggcgaggaagtccaggtgatcgcagtagagcctgggaaaaaccccaagaatgtccaaacagccccaggaacttttaagacccccgaaggtgaggtgggcgctattgccctggatttcaaacctgggacgtcgggaagcccaatcgttaacagggaaggcaagattgtgggtctttacgggaatggagtcgtgacaacttcaggcacctatgtttccgcaatcgctcaggccaaagcgagtcaggagggccccctgcctgagatagaagacgaggtgtttcgaaagcggaacttgacaatcatggatctacatccggggtctggaaaaacccgcagatacctgccagccattgtcagggaagcaatcaagcggaagctccgaactttaattctggctcccaccagagtggtagccagcgagatggctgaagcacttaaaggtatgcctatccgctatcaaacaacggccgtgaagtccgagcacactggcaaagagatagttgacctgatgtgccatgccaccttcacaatgaggctcttgtcaccagtccgtgtgcccaattacaacatgattatcatggatgaagctcactttaccgacccttctagcatcgcggcacgggggtatattagtactagagtgggaatgggcgaggccgctgccatcttcatgacagcaaccccgcccggttccgtcgaagcctttccacagagcaatgctgtaatacaggatgaggaaagggacattcctgagcgctcttggaactcagggtacgagtggatcacggatttccccggaaagactgtgtggtttgttccatccattaaaagtggcaatgacatcgcgaactgtctgcgaaagaatggcaagagagtgatacagctcagccggaaaacattcgataccgaatatcaaaagaccaaaaacaacgactgggactacgtcgtgactacagatatttcggagatgggggccaatttcagggcagaccgcgttatcgatcctcgtagatgcctgaagcccgtgatccttaaagacggaccagaacgggtcattctagctggtccgatgcctgtgaccgtagcctctgcagcccagaggcgcggccgagtggggagaaaccataataaggagggagatcagtacatctatatgggccagcccctgaacaatgacgaggatcacgctcactggacagaagccaagatgttgttagacaacattaatactccagagggtataatccccgcgctgtttgaacctgagcgggaaaaatccgcagccattgatggggagtacaggctccgcggcgaggctagaaagacgttcgttgaactgatgaggcggggagaccttccagtctggctgagctataaagtggcctcagagggctttcaatacagtgatcgtcgctggtgcttcgacggggaacgaaacaatcaggtgctcgaggaaaacatggatgtcgagatctggaccaaggagggagaaaggaaaaagttgaggccccggtggctggacgctcgcacatattctgaccctctagcactgagagagtttaaagagttcgccgctggtaggcggtccgttagcggcgatctcatccttgagattgggaagctgccgcagcatttaactcagcgagcccaaaatgcattggacaacctggtgatgctccacaattcagaacagggaggcagagcgtaccgccatgccatggaggagctgccagataccatagaaacacttatgctgctcgctttgatcgccgtactgaccggtggggtgactttatttttcctaagtggcaggggactgggcaagacgagcattgggctcctttgtgtcatggcatcctctgtgctgttgtggatggctagcgttgagccccactggatcgccgcatccattatcctggaatttttcctcatggtgctgcttatacctgagcccgaccggcagcgtaccccacaggataaccaactcgcctatgtcgtaatcggactgttgtttatgattctgacagtggctgcgaatgagatgggtttactagaaactaccaaaaaggacctgggcatcgggcacgttgccgtggagaaccatcaccatgcagctatgctcgatgtcgaccttcaccctgcctcagcctggacactgtacgcagtggctaccactattatcacacccatgatgagacatacgatagaaaacaccactgccaatatttctttgacagcgatcgctaaccaggccgcaattctgatgggactcgataaaggctggccaatcagtaagatggacataggtgtccctctgcttgccttagggtgctacagccaggtgaatccgctgaccctcaccgctgcagttttgatgctggtggcccactatgcgatcattggccccggactacaagctaaagccacaagggaggcacagaagcgcactgccgctggcatcatgaagaacccaacggtagatgggattgtggccatcgacctggatcctgtcgtttacgacgcaaaattcgaaaagcagctcggacagataatgcttctgattttgtgtaccagccaaatcctgctcatgcggacaacttgggctctgtgcgagtccatcaccttagccacaggcccccttaccactctgtgggagggttctccagggaaattttggaatacgacaattgcggtgtcaatggccaacatcttccgaggaagctatctcgcaggcgctggtctagccttctccctgatgaagagtttgggcgggggaagaaggggcaccggggcacagggagaaactctgggcgagaaatggaagcgccagctcaatcagctttctaagagcgaatttaacacctacaaacggtcaggtataatggaggtcgacagatccgaagctaaggaggggctgaaacgtggagagacaactaagcacgccgtgagtaggggcaccgccaaattgcggtggttcgtagaacgcaatctggtgaagcctgagggtaaggttattgatctcggctgtgggcgaggaggctggagctattactgcgcggggctaaagaaggtgacagaagtcaaaggatatacgaagggcggtcccgggcatgaggaaccgatcccaatggctacctacggatggaacctggtgaaacttcactctggcaaggacgtctttttcattcctcccgagaaatgtgatactctgctatgcgacatcggcgagtcctcaccaaatcccacaatagaagaggggagaaccctcagggtgctgaagatggttgaaccttggttgcggggaaaccaattttgtatcaagattctgaatccgtacatgcccagcgtagtggagactctcgagcagatgcagcgcaaacatggtggcatgcttgtcagaaacccactgtcgagaaattctacacacgaaatgtattgggtgagttgcgggaccggaaacatcgtttccgcagtgaatatgacgagccgaatgttactgaaccggttcaccatggcccaccgtaagcctacatacgagagagatgtcgacttgggcgctggtactcgccatgtggccgtagaacccgaggtggcaaacctcgatattatcgggcagaggattgaaaatatcaaacacgagcataagtcaacctggcactatgacgaggataacccttacaaaacatgggcctatcatggatcctacgaagttaagccatctggcagcgctagttccatggtcaatggcgtggtgaagctgctaactaaaccctgggacgtcatacctatggttacccaaattgcgatgacagataccactccatttgggcagcagcgggtgttcaaggagaaagtagacacgagaacacccaaggccaaacgcggaaccactcaaatcatggaagtgaccgcaaggtggctttggggttttctgagccgaaacaagaagccgcggatctgtacaagagaggagttcattaggaaagtccgctctaatgctgccataggcgcagtgtttgttgacgagaaccagtggaactcagccaaggaggctgtggaagatgagcgtttctgggacctcgtccaccgggaaagagagctgcacaaacaggggaagtgcgccacgtgcgtgtataacatgatgggaaaaagggaaaagaagttgggcgagtttggtaaagcgaaggggagtcgcgcaatctggtacatgtggctgggagcccgattcctcgagttcgaagctcttggctttatgaatgaggatcattggttctcccgggaaaacagcctgtctggcgtagagggggagggattacacaaactgggttacattttgagagacatctcgaagattcctggcgggaatatgtatgccgatgacaccgcaggatgggatactaggatcacagaagacgatctccagaacgaggctaaaataaccgacatcatggaaccagagcatgccctgctagctaaggccatttttaaacttacttaccaaaataaggttgtgcgcgtccagagacccgcaaagaacggcacagtgatggatgtgatctcacggagggaccagcgtggtagcgggcaggtcggaacctatggcctgaatacattcactaacatggaagcgcaactcattcgacagatggagtccgagggcatctttagtccttctgaactggagaccccaaacttggccgaacgcgttttagattggctggagaaatacggggtggaaagactcaagcggatggctataagcggagacgactgtgtagtgaaacccattgatgacaggttcgccacggcacttaccgctctgaatgatatgggtaaggtccgcaaagacatcccgcagtgggagccttccaagggctggaacgattggcagcaagtgcccttttgctcacaccacttccatcagctaatcatgaaggacgggagagagattgttgtgccatgtcggaatcaggatgaactggtcggaagggcccgagtgagtcagggcgcaggttggtctctccgtgagacagcctgcttggggaaaagctatgcgcaaatgtggcagctgatgtactttcacagacgcgaccttcggctggctgccaacgcaatatgttccgccgtacctgttgattgggtgcccacttcaaggaccacatggagcatccatgctcaccatcagtggatgactaccgaagacatgctctctgtctggaatagagtgtggattgaggaaaacccatggatggaggataaggcccacgtttccagttgggaggacgtgccctatttaggaaaacgcgaagaccaatggtgcggcagcctgatcggcttgacggcacgggctacatgggccaccaatattcaggtcgcgatcaaccaggtgaggcgactgatagggaatgagaactacctcgattacatgacttcgatgaagagattcaaaaatgaatccgaccctgagggagctctttggtga

SEQ ID NO: 14168 - RNA, 9879 nt, synthetic construct
  misc_feature 1..9879: note = derived and/or modified CDS sequence (opt3) from DENV-1__KC762629__SS-prME
  source 1..9879: mol_type = other RNA
agcgtgaccatgctgctcatgcttatgcccacggcactggctttccacttgactacgagaggcggggaacctcatatggtcgtttccaagcaagaaagaggaaaatctttactgtttaagacctcagccggtgtgaacatgtgcacactgatcgccatggacctcggcgaactgtgtgaagatactcttacctacaaatgcccacggattacagaggcggaaccggacgatgtagactgttggtgcaatgctaccgatacttgggtgacatatgggacctgtagtcaaacgggagagcaccgccgagacaagcgtagcgtcgccctggcaccccatgtgggcttgggtctcgagactagaaccgaaacatggatgtcctctgagggggcctggaggcagatacagcgggttgaaacttgggctctgcgccaccctggattcaccgtgatcgcactgtttctcgcccatgctattggcacatcgatcacccagaaaggcattatcttcatattactgatgcttgtcacgccatcaatggccatgagatgcgtggggatcggaagcagggattttgtagagggtttgagtggcgcgacttgggttgacgtggtcctggagcacgggtcctgtgtgacaaccatggcaaaggataagcccactctagacattgaactcctgaaaacagaggtgaccaaccctgccgtccttcggaagctgtgcatcgaagctaaaatttctaatacgaccacagatagccgctgtccaactcaaggagaggccaccttggttgaagaacaagacgcaaacttcgtgtgccgaagaacatttgtagataggggctggggtaatgggtgtggactcttcggcaagggctccctgatcacttgcgctaaatttaagtgcgtgaccaagttagaggggaaaatagtccagtacgaaaacctgaagtattcagtgattgttacagtgcacaccggagaccagcatcaagtcggtaatgagagtactgaacacggcacgacagccaccatcactccccaggcgcctaccacagagattcagctcaccgactacggggcccttactctggattgtagcccacggacaggattggacttcaacgaaatggtgctactgacgatgaaagagaagtcttggctcgtacataaacagtggtttctggatcttccgctgccctggacctccggcgcatcaactagccaagagacatggaatcgtcaggacttgctcgttaccttcaagacagctcacgccaaaaagcaggaagtggtcgtgctgggtagtcaagagggggctatgcacactgccttaaccggcgcaacggaaatccagacctctggaacaactaccatctttgccggccatctgaagtgccgcctaaaaatggataagctcacactgaaagggatgtcctatgtcatgtgtactggtagcttcaaacttgagaaagaagtggctgagacccagcacggaacggttttggtgcagattaagtacgagggcacagacgcgccttgcaagataccattctcgacccaagatgaaaaaggggtaactcagaacggaagactgatcacagcaaatcccattgtcaccgacaaggagaaacctgtgaacatcgaagccgagccaccctttggcgagtcttatatagttattggtgctggggaaaagactctcaaactgtcctggttcaagaagggctcaagtatcggaaaaatgtttgaggccaccgcaaggggcgcccggcgaatggctatccttggggatacagcctgggacttcggaagcattggtggcgtgtttacgtccgtcgggaagctggtgcatcagatcttcggaaccgcatacggcgtattgttttctggtgtgagctggactatgaaaattgggataggcgttctcctgacatggttaggactaaattcacgcagtacctccctaagcatgacatgtatcgcggtcggcctcgtgactctgtaccttggggtgatggtccaggctgattctggatgcgttattaactggaagggcagagaattgaaatgtggttcagggatcttcgtgaccaatgaggtgcacacgtggacagaacaatataagtttcaggccgacagtccgaagaggctgagcgcagccatcggaaaggcttgggaggagggcgtatgcggtattcggtccgccacccgcctcgaaaacataatgtggaagcagatctctaacgagctgaatcatattttactggaaaacgacatgaaattcactgtcgtggttggcgatgtggcagggatccttgctcagggaaagaaaatgattagacctcaacccatggagcacaagtactcgtggaaaagctggggcaaggccaagatcataggggcggacgtccagaataccacatttatcattgatggaccaaacactcctgaatgtcccgacgatcagagggcctggaatatctgggaggtggaggactatggcttcggtatttttaccacaaacatctggttgaaactccgtgattcctacacgcaggtttgcgaccaccggctgatgtcagctgcaataaaggatagtaaagccgtgcatgctgacatggggtattggattgaatctgagaagaatgaaacctggaaactagcccgagcatccttcatcgaggtaaagacttgtatttggccaaagtcccacacactgtggtcaaacggagtcctcgaaagcgagatgatcatacccaaaatctacggcggtcctatttctcaacataattatagaccaggctacttcacccagactgcggggccgtggcacctgggaaaacttgagttggattttaacctgtgcgaaggcacaaccgtggtggtcgacgagcactgcgggaataggggaccctccttacgcacgactaccgttacaggcaaaatcattcatgaatggtgttgccggagttgtaccctccctccactgagattcaggggtgaggatgggtgctggtacggaatggagatccgccccgtgaaggaaaaagaggaaaaccttgtaaagagcatggtgtctgccggctccggtgaggtcgactcatttagtctgggcttgctctgtataagcattatgatcgaagaggtgatgcgatcgcggtggtcccgtaagatgctgatgactgggacactagctgttttctttctgctcatcatgggacagctgacctggaatgaccttattagattgtgcatcatggtgggcgccaacgcatctgataggatggggatgggaacaacttatctggctttaatggccaccttcaaaatgcgccctatgtttgcagtcggcctcctgttccggagacttacgagcagggaggtgctgctactcacaattggtctgtcattggttgccagtgtggaactgccaaattccttagaggaactcggggacggactggctatgggcataatgatccttaagctgttgaccgattttcaatctcaccagctctgggcgactctgctaagcctgaccttcattaaaacaactttttcccttcattacgcctggaagaccatggcaatggtcctctcaatcgtaagcctgttccccttgtgtctgagtacgacatctcagaaaaccacttggttaccggtgctcctgggctcccttgggtgcaagcctctgacaatgtttttgattgctgagaacaagatctggggacgaaaaagctggccactcaacgaaggtataatggccgttggcatcgtgtcgattctgctatcatctctgcttaagaatgacgtccccctcgccgggcctctgatcgctggaggcatgttgattgcatgttatgtgatcagtggttccagcgccgatttatctctggagaaagcggctgaggtaagctgggaagaggaagccgagcactccggggcatcacataacatactcgtggaagtccaggacgatggaaccatgaagattaaagacgaggagcgcgatgacactctgacaatccttctgaaggccaccttgctagctgttagtggcgtgtaccccctgagcatcccagcaacactcttcgtgtggtatttctggcagaagaagaagcagcggtctggcgtcctgtgggatactccttcacccccagaagtggagagagccgttcttgacgatgggatttacaggataatgcagcgtggattactgggtcgcagccaggtaggcgtgggggtctttcaagaaaatgtgttccacaccatgtggcacgttacacggggagcggtgctcatgtatcagggcaaaagattggagccgagttgggctagcgtcaagaaagacctgatctcctacggtgggggatggaggctccagggctcttggaacaccggcgaggaagtgcaggtaattgccgtcgagcctgggaagaatcccaaaaacgtgcaaacagcaccaggaacttttaagacccccgaaggtgaggttggcgccatcgctctggacttcaagcctgggacgtcgggaagcccaattgtgaatcgagaaggcaaaatcgtcggtctttacgggaacggagtggttacaacttcaggcacctatgtgtccgccatagcacaggctaaggccagtcaggagggccccctgcctgagatcgaagatgaggtctttcggaaacgcaatttgacaattatggacctacatccggggtctggaaagaccagaaggtacctgccagcgatcgtgcgggaagccattaaacgaaagctcagaactttaatcctggcacccacccgcgtagtggctagcgagatggccgaagctcttaagggtatgcctataaggtatcaaacaacggcagttaaatccgagcacactggcaaggagattgtcgatctgatgtgccatgccaccttcacaatgcgtctcttgtcaccagtgcgggtgcccaactacaatatgatcatcatggacgaagcccactttaccgatccttctagcattgctgcgagagggtatatcagtactagggtcggaatgggcgaggcagccgctatattcatgacagccaccccgcccggttccgtagaagcatttccacagagcaacgccgtgattcaggacgaggaacgcgatatccctgagcgatcttggaactcagggtacgagtggattacggacttccccggaaaaactgtttggtttgtgccatccatcaagagtggcaacgatatagctaattgtctgaggaagaatggcaagcgggtcattcagctcagcaggaagacattcgacaccgaatatcagaagaccaagaacaatgattgggactacgtggttactacagacatctcggagatgggggcgaacttccgcgccgatcgtgtgatcgaccctagacggtgcctgaaacccgtcattcttaaggatggaccagaaagggtgatcctagcaggtccgatgcctgtaaccgtggcttctgccgcacagcgccgaggcagagttgggcggaatcataacaaagagggagaccagtacatttatatgggccagcccctgaataacgatgaggaccacgcccactggacagaagctaagatgttgttagataatataaacactccagagggtatcattcccgccctgtttgaacctgagagggaaaagtccgcggcaatcgacggggagtaccgcctcagaggcgaggccaggaaaacgttcgtcgaactgatgcggcgtggagatcttccagtgtggctgagctataaggtggcttcagagggctttcaatacagtgaccgccgatggtgcttcgatggggaaagaaataaccaggtcctcgaggaaaatatggacgttgagatctggaccaaagagggagaaaggaagaaattgcggccccgctggctggatgccagaacatattctgaccctctagctctgagggagtttaaggagttcgcagccggtcggcgatccgtgagcggcgacctcattcttgagatagggaaactgccgcagcatttaactcagagagctcaaaacgccttggataatctggtaatgctccacaactcagaacagggaggccgcgcatacaggcatgcgatggaggagctgccagacaccatcgaaacacttatgctgctcgccttgattgctgtgctgaccggtggggtcactttatttttcctaagtggccggggactgggcaagacgagcatcgggctcctttgtgtgatggcctcctctgttctgttgtggatggcaagcgtggagccccactggattgctgcctccatcatactggaatttttcctcatggtcctgcttatccctgagcccgatcgtcagagaaccccacaggacaatcaactcgcatatgtagtgattggactgttgtttatgatcctgacagttgccgctaacgagatgggtttactagaaactaccaagaaagatctgggcattgggcacgtggcggtcgagaaccatcaccatgccgcaatgctcgacgtggatcttcaccctgcttcagcctggacactgtacgccgtcgcaaccactatcataacacccatgatgaggcatacgattgaaaataccactgctaacatctctttgacagccattgcgaatcaggctgccatcctgatgggactcgacaagggctggccaataagtaaaatggatatcggtgtgcctctgcttgcattagggtgctactcgcaggttaacccgctgaccctcaccgccgctgtgttgatgctggtagcacactatgccattatcggccccggactacaagcgaaggctacacgcgaggcccagaaacggactgcagccggcattatgaagaatccaacggtggacgggatcgtcgctatagatctggaccctgttgtgtacgatgccaagttcgaaaaacagctcggacagattatgcttctgatcttgtgtaccagccaaatcctgctcatgcgaacaacttgggcactgtgcgagtccattaccttagctacaggcccccttaccactctgtgggagggttctccagggaagttttggaacacgacaatcgccgtctcaatggcgaatatattcagaggaagctatctcgccggcgcaggtctagctttctccctgatgaaaagtttgggcgggggaaggcgcggcaccggggcccagggagaaactctgggcgagaagtggaaacggcagctcaaccagctttctaagagcgaatttaatacctacaagagatcaggtattatggaggtggaccgttccgaagcaaaagaggggctgaagaggggagagacaactaaacacgctgtaagtcggggcaccgccaagttgcgctggttcgtggaacgaaacctggttaaacctgagggtaaggtgatcgacctcggctgtgggagaggaggctggagctattactgcgccgggttaaagaaagtcacagaagtgaagggatatacgaaaggcggtcccgggcatgaggaaccgattccaatggcgacctacggatggaatctggtcaaacttcactctggcaaagatgtgtttttcatccctcccgagaagtgtgacactctgctatgcgatataggcgagtcctcaccaaaccccacaatcgaagaggggaggaccctccgggttctgaaaatggtagaaccttggttgcgcggaaatcaattttgtattaagatcctgaacccgtacatgcccagcgtggtcgagactctcgagcagatgcagagaaagcatggtggcatgcttgtgaggaatccactgtcgcgaaactctacacacgaaatgtattgggttagttgcgggaccggaaatattgtgtccgctgtcaacatgacgagccggatgttactgaaccgtttcaccatggcacacagaaaacctacatacgagcgcgacgtggatttgggcgccggtactaggcatgtagctgtggaacccgaggttgccaatctcgacatcattgggcagcggatcgaaaacataaagcacgagcataaatcaacctggcactatgatgaggacaatccttacaagacatgggcatatcatggatcctacgaagtcaaaccatctggcagcgccagttccatggtgaacggcgtggtcaagctgctaactaagccctgggatgttattcctatggtgacccaaatcgctatgacagacaccactccatttgggcagcagagagtattcaaagagaaggtggatacgcgcacacccaaagcgaagaggggaaccactcaaatcatggaagtcaccgcccgatggctttggggttttctgagccggaataaaaagccgagaatttgtacaagggaggagttcacgcgcaaggtgcgttctaacgcagctataggcgccgtttttgtggacgagaatcagtggaactcagcaaaagaggccgtcgaagacgagcggttctgggatctcgtgcacagagaaagggagctgcacaagcaggggaaatgcgctacctgcgtatataatatgatgggaaagcgcgagaaaaagttgggcgagtttggtaaggccaaagggagtcgagcgatctggtacatgtggctgggagcacggttcctcgagttcgaagcccttggctttatgaacgaggaccattggttctccagaggcaatagcctgtctggggttgaaggagagggtttacacaagctgggctacattttgagggatatctcgaaaattcctgggggaaacatgtatgctgacgatactgccggctgggacacacgcatcaccgaggatgacctccagaatgaagcaaagataactgatatcatggagccagaacatgctctgctagccaaagctatttttaaacttacataccaaaacaaagtggtcagagtgcagcggcccgccaagaatggtaccgtgatggacgtcatctcaaggcgtgatcagcgagggagcggacaggttggcacatatggcctgaacactttcaccaacatggaggcacaactcattcgccagatggaatccgaggggatctttagtccttctgagctggaaacgccaaatttggcggagagagtgttagactggctggaaaagtacggagtagagcggctcaaaaggatggccataagcggtgatgactgtgtggtcaagcccattgacgatcgcttcgctaccgcccttacagcactgaacgacatgggcaaagtgagaaaggatatcccgcagtgggaaccttccaaagggtggaatgactggcagcaagttcccttttgctcacaccacttccatcagctaatcatgaaggatggacgggagattgtggtcccatgtaggaaccaggacgagctggtgggccgagctcgtgtaagtcagggtgccgggtggtctctcagagaaactgcatgcttgggaaagagctatgcccaaatgtggcagctgatgtactttcaccgccgggatcttaggctggcggctaatgccatatgttccgcagttcctgtggactgggtccccacctcaagaacaacttggagcatccatgcccaccatcagtggatgaccacggaggatatgctctctgtgtggaaccgcgtttggattgaagagaatccatggatggaagacaaaacacacatctccagttgggaggatgtgccctatttaggcaagcgggaggaccaatggtgcggcagcctgattgggttgaccgctagggccacttgggcaacaaacatccaggtcgctataaatcaggtgcgaagactgatcggaaacgaaaattacctcgactacatgacctcgatgaaacggttcaagaacgagtccgatcctgaaggtgccctttggtga

SEQ ID NO: 14169 - RNA, 9879 nt, synthetic construct
  misc_feature 1..9879: note = derived and/or modified CDS sequence (opt3) from DENV-1__KC762627__SS-prME
  source 1..9879: mol_type = other RNA
agcgtgaccatgctgctcatgcttatgcccacagcactggctttccacttgactacgaggggaggggaacctcatatgatcgtctccaagcaggaaaggggaaaatctttactgtttaagacctcagccggtgttaacatgtgcacattaattgccatggacctcggcgagctgtgtgaagatactcttacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaagcagagattttgtggagggtttgagtggcgcgacttgggtagacgttgtgctggagcacgggtcctgtgtcacaaccatggcaaaggataaacccactctggacatcgaactcctgaagacagaggtgaccaaccctgccgtgcttaggaaactgtgcattgaagctaagatctctaatacgaccacagatagccggtgtccaactcaaggagaggccaccttggtcgaagaacaggacgcaaacttcgtttgccgccgaacatttgtggatagaggctggggtaatgggtgtggactcttcggcaaaggctccctgataacttgcgctaagtttaagtgcgtaaccaaattagaggggaagattgtgcagtacgaaaacctgaaatattcagtcatcgtgacagttcacaccggagaccagcatcaagtgggtaatgagagtactgaacacggcacgacagccaccattactccccaggcgcctaccacagagatccagctcaccgactacggggcccttactctggattgtagcccaaggacaggattggacttcaacgaaatggtcctactgacgatgaaggagaaatcttggctcgtgcataagcagtggtttctggatcttccgctgccctggacctccggcgcatcaactagccaagagacatggaatcggcaggacttgctcgtaaccttcaaaacagctcacgccaagaagcaggaagttgtggtcctgggtagtcaagagggggctatgcacactgccttaaccggcgcaacggaaatccagacctctggaacaactaccatttttgccggccatctgaaatgccgtctaaagatggataaactcacactgaaggggatgtcctatgtgatgtgtactggtagcttcaaacttgagaaggaagtcgctgagacccagcacggaacggtgttggttcagataaagtacgagggcacagacgcgccttgcaaaatcccattctcgacccaagatgaaaagggggtgactcagaacggacgcctgattacagcaaatcccatcgtaaccgacaaagagaagcctgtcaacatagaagccgagccaccctttggcgagtcttatattgtgatcggtgctggggaaaaagccctcaagctgtcctggttcaagaaaggctcaagtatcggaaagatgtttgaggcaactgccagaggcgctaggcggatggccattcttggggataccgcatgggacttcggaagcatcggtggcgtttttacatccgtggggaaactgattcatcagatattcggaacggcgtacggcgtcttgttttctggtgtgagctggaccatgaagatcgggattggcgtactcctgacttggttaggactaaattcacgaagtacatccctaagcatgacctgtatcgctgtgggcctcgttacactgtaccttggggtcatggtgcaggccgattctggatgcgtgatcaactggaaaggccgcgaattgaagtgtggttcagggattttcgtcactaatgaggttcacacctggacggaacaatataagtttcaggcagacagtccgaaaagactgagcgccgctataggaaaggcctgggaggagggcgtgtgcggtatcaggtccgcaacacggctcgaaaacattatgtggaaacagatctctaacgagctgaatcatattttactggaaaacgacatgaagttcaccgtggtagtcggcgatgtggctgggatccttgcccagggcaaaaagatgatacgccctcaacccatggagcacaaatactcgtggaaaagctggggcaaggcgaaaatcattggggccgacgttcagaatactacctttatcattgatggaccaaacacacctgaatgtcccgacgatcagagagcttggaatatctgggaggtggaggactatggcttcggtatatttactaccaacatttggttgaagctcagggattcctacacacaggtctgcgaccaccgtctgatgtcagcagccatcaaagatagtaaggctgtgcatgccgacatggggtattggattgaatctgagaaaaatgaaacgtggaagctagcacgggcgagcttcatcgaggttaagacctgtatatggccaaaatcccacactctgtggtcaaacggagtgctcgaaagcgagatgatcattcccaagatctacggcggtcctatttctcaacataattatcgaccaggctacttcacacagaccgccgggccgtggcacctgggaaaacttgagttggattttgacctgtgcgaaggcactacagtagtcgtggatgagcactgcgggaacagaggaccctccttaaggaccacgactgtgaccggcaagatcatacatgaatggtgttgccgcagttgtacactccctccactgcggttcagaggtgaggacgggtgctggtacggaatggagattaggcccgtcaaagaaaaggaggaaaatcttgttaagagcatggtgtctgctggctccggtgaggtagactcatttagtctgggcttgctctgtatcagcatgatgatcgaagaggtgatgcgctcgcgatggtcccggaaaatgctgatgaccgggactctagccgtcttctttctgctcattatgggacagctgacatggaacgatcttatccgtttgtgcattatggtgggcgcaaatgcttctgacagaatggggatgggaaccacatatctggccttaatggcaactttcaagatgaggcctatgtttgccgttggcctcctgttccgccggcttaccagcagagaggtgctgctactcacgataggtctgtcattggtcgctagtgtggaactgccaaactccttagaggaactcggggatggactggcgatgggcatcatgattcttaaactgttgacagactttcaatctcaccagctctgggccaccctgctaagcctgactttcatcaagaccacattttcccttcattacgcatggaaaactatggctatggttctctcaattgtgagcctgttccccttgtgtctgagtaccacgtctcagaagacaacctggttaccggtcctcctgggctcccttgggtgcaagcctctgactatgtttttgatcgccgagaataaaatatggggaagaaagtcctggccactcaacgaaggtatcatggccgtaggcattgtgtcgatcctgctatcatctctgcttaaaaacgatgttcccctcgctgggcctctgattgcaggaggcatgttgatcgcctgttatgtgataagtggttccagcgcggacttatctctggagaaggctgccgaggtcagctgggaagaggaagcagagcactccggggcctcacataatattctcgtggaagtacaggatgacggaacaatgaaaatcaaggatgaggagcgagacgataccctgactatccttctgaaagctacattgctagcagtgagtggcgtctaccccctgagcattccagccaccctcttcgtttggtatttctggcaaaagaagaaacagcgctctggcgtgctgtgggacacgccttcacccccagaagtggagcgggcggtccttgatgacgggatatacagaatcatgcagaggggattactgggtcgtagccaggtgggcgttggggtatttcaagaaaacgtgttccacactatgtggcacgtcacccgcggagctgtgctcatgtatcagggcaagcggttggagccgagttgggccagcgttaaaaaggacctgatttcctacggtgggggatggagactccagggctcttggaatacaggcgaggaagtgcaggtcatcgcagtggagcctgggaaaaaccccaagaatgtacaaaccgccccaggaacatttaagactcccgaaggtgaggtcggcgctattgccctggatttcaaacctgggacctcgggaagcccaatcgtgaacagggaaggcaagatagttggtctttacgggaatggagtggtcacgacatcaggcacttatgtgtccgcaatcgctcaggccaaagcgagtcaggagggccccctgcctgagattgaagacgaggtttttcgaaagcggaacttgaccatcatggatctacatccggggtctggaaaaacacgcagatacctgccagccattgtgagggaagcaatcaagcggaagctccgaaccttaatactggctcccactagagtcgtggccagcgagatggctgaagcacttaaaggtatgcctattcgctatcaaaccacagccgtaaagtccgagcacacgggcaaagagatcgtggacctgatgtgccatgccactttcaccatgaggctcttgtcaccagttcgtgtccccaattacaacatgatcattatggatgaagctcactttacagacccttctagcatcgcggcacgggggtatataagtaccagagtgggaatgggcgaggccgctgccattttcatgactgcaacaccgcccggttccgtggaagcctttccacagagcaatgctgtcatccaggatgaggaaagggacattcctgagcgctcttggaactcagggtacgagtggatcaccgatttccccggaaagacggtatggtttgtgccatccataaaaagtggcaatgacattgcgaactgtctgcgaaagaatggcaagagagttatccagctcagccggaaaactttcgatacagaatatcaaaagaccaaaaacaacgactgggactacgtggtcaccactgatatctcggagatgggggccaatttcagggcagaccgcgtgattgatcctcgtagatgcctgaagcccgttatccttaaagacggaccagaacgggtgattctagctggtccgatgcctgtcacagtggcctctgcagcccagaggcgcggccgagtagggagaaaccataataaggagggagatcagtacatatatatgggccagcccctgaacaatgacgaggatcacgctcactggaccgaagccaagatgttgttagacaacatcaatacaccagagggtattatccccgcgctgtttgaacctgagcgggaaaaatccgcagccatcgatggggagtacaggctccgcggcgaggctagaaagactttcgtggaactgatgaggcggggagaccttccagtttggctgagctataaagtcgcctcagagggctttcaatacagtgatcgtcgctggtgcttcgacggggaacgaaacaatcaggtgctcgaggaaaacatggatgtggagatttggacgaaggagggagaaaggaaaaagttgaggccccggtggctggacgctcgcacctattctgaccctctagcactgagagagtttaaagagttcgccgctggtaggcggtccgtcagcggcgatctcatacttgagatcgggaagctgccgcagcatttaacacagcgagcccaaaatgcattggacaacctggttatgctccacaattcagaacagggaggcagagcgtaccgccatgccatggaggagctgccagatactattgaaacccttatgctgctcgctttgatcgccgtgctgacaggtggggtaaccttatttttcctaagtggcaggggactgggcaagactagcattgggctcctttgtgtgatggcatcctctgtcctgttgtggatggctagcgtggagccccactggatcgccgcatccataatcctggaatttttcctcatggttctgcttattcctgagcccgaccggcagcgtacgccacaggataaccaactcgcctatgtggtcatcggactgttgtttatgattctgaccgtagctgcgaatgagatgggtttactagaaacaactaaaaaggacctgggcatcgggcacgtggccgttgagaaccatcaccatgcagctatgctcgatgtggaccttcaccctgcctcagcctggaccctgtacgcagtcgctacaaccataattactcccatgatgagacatacaatcgaaaacacgaccgccaatatttctttgactgcgatcgctaaccaggccgcaatactgatgggactcgataaaggctggccaatcagtaagatggacattggtgtgcctctgcttgccttagggtgctactcgcaggtcaatccgctgacactcaccgctgcagtgttgatgctggttgcccactatgcgatcattggccccggactacaagctaaagccaccagggaggcacagaagcgcacagccgctggcatcatgaagaacccaactgtggatgggatagtagccattgacctggatcctgtggtctacgacgcaaaattcgaaaagcagctcggacagatcatgcttctgatcttgtgtacgagccaaattctgctcatgcggaccacatgggctctgtgcgagtccatcactttagccaccggcccccttacaaccctgtgggagggttctccagggaaattttggaatactacgatagcggtttcaatggccaacattttccgaggaagctatctcgcaggcgctggtctagccttctccctgatgaagagtttgggcgggggaagaaggggcacaggggcacagggagaaaccctgggcgagaaatggaagcgccagctcaatcagctttctaagagcgaatttaacacttacaaacggtcaggtatcatggaggtggacagatccgaagctaaggaggggctgaaacgtggagagaccacaaagcacgccgtcagtaggggcactgccaaattgcggtggttcgtggaacgcaatctggtaaagcctgagggtaaggtgattgatctcggctgtgggcgaggaggctggagctattactgcgcggggctaaagaaggttaccgaagtgaaaggatatacaaagggcggtcccgggcatgaggaaccgatcccaatggctacgtacggatggaacctggtcaaacttcactctggcaaggacgtgtttttcatacctcccgagaaatgtgataccctgctatgcgacatcggcgagtcctcaccaaatcccactattgaagaggggagaacactcagggtcctgaagatggtggaaccttggttgcggggaaaccaattttgtatcaagattctgaatccgtacatgcccagcgttgtagagaccctcgagcagatgcagcgcaaacatggtggcatgcttgtgagaaacccactgtcgagaaattctactcacgaaatgtattgggtcagttgcgggacaggaaacatcgtgtccgcagttaatatgaccagccgaatgttactgaaccggttcacgatggcccaccgtaagcctacctacgagagagatgtggacttgggcgctggtacacgccatgtcgccgtggaacccgaggtagcaaacctcgatattatcgggcagaggatagaaaatattaaacacgagcataagtcaacttggcactatgacgaggataacccttacaaaacctgggcctatcatggatcctacgaagtgaagccatctggcagcgctagttccatggttaatggcgtcgtgaagctgctaacaaaaccctgggacgtgatccctatggtcactcaaatcgcgatgaccgatacaaccccatttgggcagcagcgggttttcaaggagaaagtggacactagaacgcccaaggccaaacgcggaacaacccaaattatggaagtaactgcaaggtggctttggagctttctgtctcgaaacaagaagccgcggatatgtaccagagaggagttcacaaggaaagtgcgctcaaatgctgccatcggtgcagtctttgtggacgagaaccagtggaatagtgccaaggaggctgttgaagatgagcgtttctgggacctcgtgcaccgggaaagagagctgcacaaacagggcaagtgcgccacgtgcgtctataacatgatggggaaaagggaaaagaagttgggagagtttggcaaagcgaagggttcccgcgcaatttggtacatgtggctgggggcccgattcctcgagttcgaagctcttggatttatgaatgaggatcattggttcagccgggaaaactctctgtcgggcgtggagggcgaggggttacacaaactgggatacatcttgagagacatttcaaagatccctggtggcaatatgtatgccgatgacaccgcagggtgggatactaggataacagaagacgatctccagaacgaggctaaaatcaccgacattatggaaccagagcatgccctgctagctaaggccatctttaaacttacttaccaaaataaggtagttcgcgtgcagagacccgcaaagaacggaacagtcatggatgtgattagccggagggaccagcgtggctccggtcaggtggggacctatggactgaatacattcactaacatggaagcgcaactcatccgacagatggagagtgagggcatattttctcctagcgaactggagacctccaacttggccgaacgcgtcttagattggctggagaaatacggcgttgaaagactcaagcggatggctatttcaggggacgactgtgtggtaaaaccaatcgatgacaggttcgccacggcacttaccgctctgaatgatatgggaaaggtgcgcaaagacatcccccagtgggagccgagtaagggttggaacgattggcagcaagtccctttttgctctcaccacttccatcagctaattatgaaggacggcagagagatagtggttccctgtcggaatcaggatgaactggtggggagggcccgagtcagccagggagcaggctggtccctccgtgagacagcctgcttgggtaaatcatatgcgcaaatgtggcagctgatgtactttcacagacgcgaccttcggctggctgccaacgcaatctgtagcgccgtgccagtagattgggttcctacttctaggaccacatggtccattcatgctcaccatcagtggatgactaccgaagacatgctcagtgtgtggaatagagtctggatcgaggaaaacccctggatggaggataagacgcacattagctcgtgggaggacgtgccatatttagggaaacgcgaagaccaatggtgcggatccctgatcggcttgacagcccgggcaacctgggctactaatatacaggttgccatcaaccaggtgaggcgactgattggcaatgagaactacctcgattacatgacatctatgaagagattcaaaaatgaatcagaccccgagggggcgctttggtga

SEQ ID NO: 14170 - RNA, 9879 nt, synthetic construct
  misc_feature 1..9879: note = derived and/or modified CDS sequence (opt3) from DENV-1__KC762647__SS-prME
  source 1..9879: mol_type = other RNA
tccgtgaccatgctgctcatgcttacgcccactgcactggctttccacttgacgaccagaggaggggaacctcatatgatcgtctccaagcaggaaaggggaaaatctttactgtttaagacgtcagccggtgttaatatgtgcactttaattgccatggacctcggcgagctgtgtgaagatacccttacatacaaatgcccacggataaccgaggcggaaccggacgatgtggactgttggtgcaatgctactgatacatgggtaacctatgggacgtgtagtcaaactggagagcaccgccgagacaagcgtagcgtggccctggcaccccatgtcggcttgggtctcgagaccagaacagaaacttggatgtcctctgagggggcctggaaacagatccagagggtggaaacctgggctctgcggcaccctggattcacagttattgcactgtttctcgcccatgctatcggcacctcgattacgcagaagggcatcatattcatcttactgatgcttgtgactccatcaatggccatgcgctgcgtcgggattggaagcagagattttgtggagggtttgagtggcgcgacatgggtagacgttgtgctggagcacgggtcctgtgtcaccactatggcaaaggataaacccacactggacatcgaactcctgaagaccgaggtgacgaaccctgccgtgcttaggaaactgtgcattgaagctaagatctctaataccacaactgatagccggtgtccaacccaaggagaggccacattggtcgaagaacaagacgcaaacttcgtttgccgccgaacttttgtggatagaggctggggtaatgggtgtggactcttcggcaaaggctccctgataacctgcgctaagtttaagtgcgtaacaaaattagaggggaagattgtgcagtacgaaaacctgaaatattcagtcatcgtgaccgttcacactggagaccagcatcaagtgggtaatgagagtacggaacacggcacaaccgccactattacaccccaagcgcctaccaccgagatccagctcactgactacggggcccttacactggattgtagcccaaggacgggattggacttcaacgaaatggtcctactgaccatgaaggagaaatcttggctcgtgcataagcagtggtttctggatcttccgctgccctggacttccggcgcatcaacaagccaagagacctggaatcggcaggacttgctcgtaacattcaaaactgctcacgccaagaagcaggaagttgtggtcctgggtagtcaagagggggctatgcacaccgccttaacgggcgcaaccgaaatccagacatctggaactaccacaatttttgccggccatctgaaatgccgtctaaagatggataaactcactctgaaggggatgtcctatgtgatgtgtaccgggagcttcaaacttgagaaggaagtcgctgagacgcagcacggtacagtgttggttcagataaagtacgagggcaccgacgcgccttgcaaaatcccattctcgactcaagatgaaaagggggtgacacagaacggacgcctgattaccgcaaatcccatcgtaactgacaaagagaagcctgtcaacatagaagccgagccaccctttggcgagtcttatattgtgatcggtgctggggaaaaagccctcaagctgtcctggttcaagaaaggctcaagtatcggaaagatgtttgaggcaaccgccagaggcgctaggcggatggccattcttggggatacagcatgggacttcggaagcatcggtggcgtttttacgtccgtggggaaactggtccatcagattttcggaaccgcgtacggcgtgttgttttctggtgtaagctggactatgaagatagggatcggcgtgctcctgacatggttaggactaaattcacgaagtacctccctaagcatgacatgtattgctgttggcctcgtcactctgtaccttggggtgatggtgcaggccgattctggatgcgtcatcaactggaaaggccgcgaattgaagtgtggttcagggatcttcgttaccaatgaggtgcacacgtggacagaacaatataagtttcaggcagacagtccgaaaagactgagcgccgctattggaaaggcctgggaggagggcgtgtgcggtataaggtccgcaacccggctcgaaaacatcatgtggaaacagatttctaacgagctgaatcatatcttactggaaaacgacatgaagttcactgtagtcgtgggcgatgttgctgggattcttgcccagggcaagaagatgatccgccctcaacccatggagcacaaatactcgtggaaaagctggggcaaggcgaaaataatcggggccgacgtgcagaataccacatttattatcgatggaccaaacactcctgaatgtcccgacgatcagagagcttggaatatttgggaggtcgaggactatggcttcggtatctttaccacaaacatatggttgaagctcagggattcctacacacaggtgtgcgaccaccgtctgatgtcagcagccattaaagatagtcgggctgttcatgccgacatggggtattggatcgaatctgagaagaatgaaacctggaaactagcacgagcgagcttcattgaggtgaagacttgtgtatggccaaagtcccacacactgtggtcaaacggagtcctcgaaagcgagatgatcatacccaaaatctacggcggtcctatttctcaacataattatagaccaggctacttcacccagactgccgggccgtggcacctgggaaaacttgagttggattttgacctgtgcgaaggcacaaccgtggtggtcgatgagcactgcgggaacaggggaccctccttacgcacgactaccgttacaggcaaaatcattcatgaatggtgttgccggagttgtaccctccctccactgagattcaggggtgaggacgggtgctggtacggaatggagatccgccccgtgaaggaaaaagaggaaaatcttgtaaagagcatggtgtctgctggctccggtgaggtcgactcatttagtctgggcttgctctgtataagcattatgatcgaagaggtgatgcgatcgcggtggtcccgtaagatgctgatgactgggacactagccgttttctttctgctcatcatgggacagctgacctggaacgatcttattagattgtgcatcatggtgggcgcaaatgcttctgacaggatggggatgggaacaacttatctggccttaatggcaaccttcaaaatgcgccctatgtttgccgtcggcctcctgttccggagacttacgagcagggaggtgctgctactcacaattggtctgtcattggttgctagtgtggaactgccaaactccttagaggaactcggggatggactggcgatgggcataatgatccttaagctgttgaccgactttcaatctcaccagctctgggccactctgctaagcctgaccttcattaaaacaactttttcccttcattacgcatggaagaccatggctatggtcctctcaatcgtaagcctgttccccttgtgtctgagtacgacatctcagaaaaccacttggttaccggtgctcctgggctcccttgggtgcaagcctctgacaatgtttttgattgccgagaataagatctggggacgaaaaagctggccactcaacgaaggtataatggccgttggcatcgtgtcgattctgctatcatctctgcttaagaacgatgtccccctcgctgggcctctgatcgcaggaggcatgttgattgcctgttatgtgatcagtggttccagcgcggacttatctctggagaaagctgccgaggtaagctgggaagaggaagcagagcactccggggcctcacataatatactcgtggaagtccaggatgacggaaccatgaagattaaagatgaggagcgcgacgatactctgacaatccttctgaaggctaccttgctagcagttagtggcgtgtaccccctgagcatcccagccacactcttcgtgtggtatttctggcagaaaaagaagcagcggtctggcgtcctgtgggacactccttcacccccagaagtggagagagcggttcttgatgacgggatttacaggataatgcagcgtggattactgggtcgcagccaggtaggcgtgggggtctttcaagaaaacgtgttccacaccatgtggcacgttacacggggagctgtgctcatgtatcagggcaaaagattggagccgagttgggccagcgtcaagaaagacctgatctcctacggtgggggatggaggctccagggctcttggaataccggcgaggaagtgcaggtaattgcagtcgagcctgggaagaaccccaaaaatgtgcaaacagccccaggaacttttaagacccccgaaggtgaggttggcgctatcgccctggatttcaagcctgggacgtcgggaagcccaattgtgaaccgagaaggcaaaatcgtcggtctttacgggaatggagtggttacaacttcaggcacctatgtgtccgcaatagctcaggccaaggcgagtcaggagggccccctgcctgagatcgaagacgaggtctttcggaaacgcaacttgacaattatggatctacatccggggtctggaaagaccagaaggtacctgccagccatcgtgcgggaagcaattaaacgaaagctcagaactttaatcctggctcccacccgcgtagtggccagcgagatggctgaagcacttaagggtatgcctataaggtatcaaacaacggccgttaaatccgagcacactggcaaggagattgtcgacctgatgtgccatgccaccttcacaatgcgtctcttgtcaccagtgcgggtgcccaattacaacatgatcatcatggatgaagctcactttaccgacccttctagcattgcggcaagagggtatatcagtactagggtcggaatgggcgaggccgctgccatattcatgacagcaaccccgcccggttccgtagaagcctttccacagagcaatgctgtgattcaggatgaggaacgcgacatccctgagcgatcttggaactcagggtacgagtggattacggatttccccggaaaaactgtttggtttgtgccatccatcaagagtggcaatgacatagcgaactgtctgaggaaaaatggcaagcgggtcattcagctcagcaggaagacattcgataccgaatatcagaaaaccaagaacaacgactgggactacgtggttactacagatatctcggagatgggggccaatttccgcgcagaccgtgtgatcgatcctagacggtgcctgaaacccgtcattcttaaggacggaccagaaagggtgatcctagctggtccgatgcctgtaaccgtggcctctgcagcccagcgccgaggcagagttgggcggaaccataataaagagggagatcagtacatttatatgggccagcccctgaacaatgacgaggatcacgctcactggacagaagccaagatgttgttagacaacataaatactccagagggtatcattcccgcgctgtttgaacctgagagggaaaagtccgcagccatcgatggggagtaccgcctcagaggcgaggctaggaaaacgttcgtcgaactgatgcggcgtggagaccttccagtgtggctgagctataaggtggcctcagagggctttcaatacagtgatcgccgatggtgcttcgacggggaaagaaacaatcaggtcctcgaggaaaacatggatgttgagatctggaccaaagagggagaaaggaagaaattgcggccccgctggctggacgctagaacatattctgaccctctagcactgagggagtttaaggagttcgccgctggtcggcgatccgtgagcggcgatctcattcttgagatagggaaactgccgcagcatttaactcagaaggcccaaaatgcattggacaacctggtaatgctccacaattcagaacagggaggcagagcgtaccgccatgccatggaggagctgccagataccatcgaaacacttatgctgctcgctttgattgccgtgctgaccggtggggtcactttatttttcctaagtggcaggggactgggcaagacgagcatcgggctcctttgtgtgatggcatcctctgttctgttgtggatggctagcgtggagccccactggattgccgcatccatcatactggaatttttcctcatggtcctgcttatccctgagcccgaccggcagcgtaccccacaggataaccaactcgcctatgtagtgattggactgttgtttatgatcctgacagttgctgcgaatgagatgggtttactagaaactaccaaaaaggacctgggcattgggcacgtggccgtcgagaaccatcaccatgcagctatgctcgatgtggaccttcaccctgcctcagcctggacactgtacgcagtcgctaccactatcataacacccatgatgagacatacgattgaaaacaccactgccaatatctctttgacagcgattgctaaccaggccgcaatcctgatgggactcgataaaggctggccaataagtaagatggacatcggtgtgcctctgcttgccttagggtgctactcgcaggttaatccgctgaccctcaccgctgcagtgttgatgctggtagcccactatgcgattatcggccccggactacaagctaaagccacaagggaggcacagaagcgcactgccgctggcattatgaagaacccaacggtggatgggatcgtcgccatagacctggatcctgttgtgtacgacgcaaaattcgaaaagcagctcggacagattatgcttctgatcttgtgtaccagccaaatcctgctcatgcggacaacttgggctctgtgcgagtccattaccttagccacaggcccccttaccactctgtgggagggttctccagggaaattttggaatacgacaatcgcggtctcaatggccaacatattccgaggaagctatctcgcaggcgctggtctagccttctccctgatgaagagtttgggcgggggaagaaggggcaccggggcacagggagaaactctgggcgagaaatggaagcgccagctcaatcagctttctaagagcgaatttaacacctacaaacggtcaggtattatggaggtggacagatccgaagctaaggaggggctgaaacgtggagagacaactaagcacgccgtaagtaggggcaccgccaaattgcggtggttcgtggaacgcaatctggttaagcctgagggtaaggtgatcgatctcggctgtgggcgaggaggctggagctattactgcgcggggctaaagaaggtcacagaagtgaaaggatatacgaagggcggtcccgggcatgaggaaccgattccaatggctacctacggatggaacctggtcaaacttcactctggcaaggacgtgtttttcatccctcccgagaaatgtgatactctgctatgcgacataggcgagtcctcaccaaatcccacaatcgaagaggggagaaccctcagggttctgaagatggtagaaccttggttgcggggaaaccaattttgtattaaggtgctgaatccgtacatgcccagcgtcgtggagactctcgagcagatgcagcgcaaacatggtggcatgcttgttagaaacccactgtcgagaaattctacacacgaaatgtattgggtgagttgcgggaccggaaacatcgtctccgcagtgaatatgacgagccgaatgttactgaaccggttcaccatggcccaccgtaagcctacatacgagagagatgtagacttgggcgctggtactcgccatgtggccgttgaacccgaggtcgcaaacctcgatattatcgggcagaggattgaaaatatcaaacacgagcataagtcaacctggcactatgacgaggataacccttacaaaacatgggcctatcatggatcctacgaagtgaagccatctggcagcgctagttccatggtgaatggcgtcgttaagctgctaactaaaccctgggacgtgatacctatggtaacccaaattgcgatgacagataccactccatttgggcagcagcgggtgttcaaggagaaagtcgacacgagaacacccaaggccaaacgcggaaccactcaaatcatggaagtgaccgcaaggtggctttggggttttctgagccgaaacaagaagccgcggatctgtacaagagaggagttcacgaggaaagttcgctctaatgctgccattggcgcagtgtttgtcgacgagaaccagtggaactcagccaaggaggctgtggaagatgagcgtttctgggacctcgtacaccgggaaagagagctgcacaaacaggggaagtgcgcgacctgcgtttataacatgatgggaaaaagggaaaagaagttgggcgagtttggtaaagccaaggggagtcgcgcaatatggtacatgtggctgggagcccgattcctcgagttcgaagctcttggctttatgaatgaggatcattggttctcccgggaaaacagcctgtctggcgtggagggggagggattacacaaactgggttacatcttgagagacatttcgaagatccctggcgggaatatgtatgccgatgacactgcaggatgggatacaaggattaccgaagacgatctccagaacgaggctaaaatcactgacataatggaaccagagcatgccctgctagctaaggccatctttaaacttacataccaaaataaggtcgtgcgcgtgcagagacccgcaaagaacggcaccgtcatggatgttatttcacggagggaccagcgtggtagcggacaggtgggaacatatggcctgaatactttcaccaacatggaagcgcaactcatccgacagatggagtccgagggcatttttagtccttctgaactggagacgccaaacttggccgaacgcgtattagattggctggagaaatacggggtggaaagactcaagcggatggctatcagcggagacgactgtgtcgtgaaacccatagatgacaggttcgccaccgcacttacagctctgaatgatatgggtaaggttcgcaaagacattccgcagtgggagccttccaagggctggaacgattggcagcaagtgcccttttgctcacaccacttccatcagctaatcatgaaggacgggagagagatcgtcgtgccatgtcggaatcaggatgaactggtaggaagggcccgagttagtcagggcgcaggttggtctctccgtgagcctgcctgcttggggaaaagctatgcgcaaatgtggcagctgatgtactttcacagacgcgaccttcggctggctgccaacgcaatttgttccgccgtgcccgtcgattgggtgccaacttcaaggaccacatggagcatacatgctcaccatcagtggatgactaccgaagacatgctctctgtttggaatagagtgtggatcgaggaaaacccctggatggaggataagacgcacatttccagttgggaggacgtcccttatttaggaaaacgcgaagaccaatggtgcggcagcctgatcggcttgacagcccgggcaacctgggctactaatattcaggtggccatcaaccaggtaaggcgactgatagggaatgagaactacctcgattacatgacatcgatgaagagattcaaaaatgaatccgacccagagggagcgctttggtga

SEQ ID NO: 14171 - RNA, 9879 nt, synthetic construct
  misc_feature 1..9879: note = derived and/or modified CDS sequence (opt3) from DENV-1__KC762639__SS-prME
  source 1..9879: mol_type = other RNA
tccgtgaccatgctgctcatgcttacgcccactgcactggctttccacttgacgaccagaggaggggaacctcatatgatcgtctccaagcaggaaaggggaaaatctttactgtttaagacgtcagccggtgttaatatgtgcactttaattgccatggacctcggcgagctgtgtgaagatacccttacatacaaatgcccacggataaccgaggcggaaccggacgatgtggactgttggtgcaatgctactgatacatgggtaacctatgggacgtgtagtcaaactggagagcaccgccgagacaagcgtagcgtggccctggcaccccatgtcggcttgggtctcgagaccagaacagaaacttggatgtcctctgagggggcctggaaacagatccagagggtggaaacctgggctctgcggcaccctggattcacagttattgcactgtttctcgcccatgctatcggcacctcgattacgcagaagggcatcatattcatcttactgatgcttgtgactccatcaatggccatgcgctgcgtcgggattggaagcagagattttgtggagggtttgagtggcgcgacatgggtagacgttgtgctggagcacgggtcctgtgtcaccactatggcaaaggataaacccacactggacatcgaactcctgaagaccgaggtgacgaaccctgccgtgcttaggaaactgtgcattgaagctaagatctctaataccacaactgatagccggtgtccaacccaaggagaggccacattggtcgaagaacaagacgcaaacttcgtttgccgccgaacttttgtggatagaggctggggtaatgggtgtggactcttcggcaaaggctccctgataacctgcgctaagtttaagtgcgtaacaaaattagaggggaagattgtgcagtacgaaaacctgaaatattcagtcatcgtgaccgttcacactggagaccagcatcaagtgggtaatgagagtacggaacacggcacaaccgccactattacaccccaagcgcctaccaccgagatccagctcactgactacggggcccttacactggattgtagcccaaggacgggattggacttcaacgaaatggtcctactgaccatgaaggagaaatcttggctcgtgcataagcagtggtttctggatcttccgctgccctggacttccggcgcatcaacaagccaagagacctggaatcggcaggacttgctcgtaacattcaaaactgctcacgccaagaagcaggaagttgtggtcctgggtagtcaagagggggctatgcacaccgccttaacgggcgcaaccgaaatccagacatctggaactaccacaatttttgccggccatctgaaatgccgtctaaagatggataaactcactctgaaggggatgtcctatgtgatgtgtaccgggagcttcaaacttgagaaggaagtcgctgagacgcagcacggtacagtgttggttcagataaagtacgagggcaccgacgcgccttgcaaaatcccattctcgactcaagatgaaaagggggtgacacagaacggacgcctgattaccgcaaatcccatcgtaactgacaaagagaagcctgtcaacatagaagccgagccaccctttggcgagtcttatattgtgatcggtgctggggaaaaagccctcaagctgtcctggttcaagaaaggctcaagtatcggaaagatgtttgaggcaaccgccagaggcgctaggcggatggccattcttggggatacagcatgggacttcggaagcatcggtggcgtttttacgtccgtggggaaactggtccatcagattttcggaaccgcgtacggcgtgttgttttctggtgtaagctggactatgaagatagggatcggcgtgctcctgacatggttaggactaaattcacgaagtacctccctaagcatgacatgtattgctgttggcctcgtcactctgtaccttggggtgatggtgcaggccgattctggatgcgtcatcaactggaaaggccgcgaattgaagtgtggttcagggatcttcgttaccaatgaggtgcacacgtggacagaacaatataagtttcaggcagacagtccgaaaagactgagcgccgctattggaaaggcctgggaggagggcgtgtgcggtataaggtccgcaacccggctcgaaaacatcatgtggaaacagatttctaacgagctgaatcatatcttactggaaaacgacatgaagttcactgtagtcgtgggcgatgttgctgggattcttgcccagggcaagaagatgatccgccctcaacccatggagcacaaatactcgtggaaaagctggggcaaggcgaaaataatcggggccgacgtgcagaataccacatttattatcgatggaccaaacactcctgaatgtcccgacgatcagagagcttggaatatttgggaggtcgaggactatggcttcggtatctttaccacaaacatatggttgaagctcagggattcctacacacaggtgtgcgaccaccgtctgatgtcagcagccattaaagatagtcgggctgttcatgccgacatggggtattggatcgaatctgagaagaatgaaacctggaaactagcacgagcgagcttcattgaggtgaagacttgtgtatggccaaagtcccacacactgtggtcaaacggagtcctcgaaagcgagatgatcatacccaaaatctacggcggtcctatttctcaacataattatagaccaggctacttcacccagactgccgggccgtggcacctgggaaaacttgagttggattttgacctgtgcgaaggcacaaccgtggtggtcgatgagcactgcgggaacaggggaccctccttacgcacgactaccgttacaggcaaaatcattcatgaatggtgttgccggagttgtaccctccctccactgagattcaggggtgaggacgggtgctggtacggaatggagatccgccccgtgaaggaaaaagaggaaaatcttgtaaagagcatggtgtctgctggctccggtgaggtcgactcatttagtctgggcttgctctgtataagcattatgatcgaagaggtgatgcgatcgcggtggtcccgtaagatgctgatgactgggacactagccgttttctttctgctcatcatgggacagctgacctggaacgatcttattagattgtgcatcatggtgggcgcaaatgcttctgacaggatggggatgggaacaacttatctggccttaatggcaaccttcaaaatgcgccctatgtttgccgtcggcctcctgttccggagacttacgagcagggaggtgctgctactcacaattggtctgtcattggttgctagtgtggaactgccaaactccttagaggaactcggggatggactggcgatgggcataatgatccttaagctgttgaccgactttcaatctcaccagctctgggccactctgctaagcctgaccttcattaaaacaactttttcccttcattacgcatggaagaccatggctatggtcctctcaatcgtaagcctgttccccttgtgtctgagtacgacatctcagaaaaccacttggttaccggtgctcctgggctcccttgggtgcaagcctctgacaatgtttttgattgccgagaataagatctggggacgaaaaagctggccactcaacgaaggtataatggccgttggcatcgtgtcgattctgctatcatctctgcttaagaacgatgtccccctcgctgggcctctgatcgcaggaggcatgttgattgcctgttatgtgatcagtggttccagcgcggacttatctctggagaaagctgccgaggtaagctgggaagaggaagcagagcactccggggcctcacataatatactcgtggaagtccaggatgacggaaccatgaagattaaagatgaggagcgcgacgatactctgacaatccttctgaaggctaccttgctagcagttagtggcgtgtaccccctgagcatcccagccacactcttcgtgtggtatttctggcagaaaaagaagcagcggtctggcgtcctgtgggacactccttcacccccagaagtggagagagcggttcttgatgacgggatttacaggataatgcagcgtggattactgggtcgcagccaggtaggcgtgggggtctttcaagaaaacgtgttccacaccatgtggcacgttacacggggagctgtgctcatgtatcagggcaaaagattggagccgagttgggccagcgtcaagaaagacctgatctcctacggtgggggatggaggctccagggctcttggaataccggcgaggaagtgcaggtaattgcagtcgagcctgggaagaaccccaaaaatgtgcaaacagccccaggaacttttaagacccccgaaggtgaggttggcgctatcgccctggatttcaagcctgggacgtcgggaagcccaattgtgaaccgagaaggcaaaatcgtcggtctttacgggaatggagtggttacaacttcaggcacctatgtgtccgcaatagctcaggccaaggcgagtcaggagggccccctgcctgagatcgaagacgaggtctttcggaaacgcaacttgacaattatggatctacatccggggtctggaaagaccagaaggtacctgccagccatcgtgcgggaagcaattaaacgaaagctcagaactttaatcctggctcccacccgcgtagtggccagcgagatggctgaagcacttaagggtatgcctataaggtatcaaacaacggccgttaaatccgagcacactggcaaggagattgtcgacctgatgtgccatgccaccttcacaatgcgtctcttgtcaccagtgcgggtgcccaattacaacatgatcatcatggatgaagctcactttaccgacccttctagcattgcggcaagagggtatatcagtactagggtcggaatgggcgaggccgctgccatattcatgacagcaaccccgcccggttccgtagaagcctttccacagagcaatgctgtgattcaggatgaggaacgcgacatccctgagcgatcttggaactcagggtacgagtggattacggatttccccggaaaaactgtttggtttgtgccatccatcaagagtggcaatgacatagcgaactgtctgaggaaaaatggcaagcgggtcattcagctcagcaggaagacattcgataccgaatatcagaaaaccaagaacaacgactgggactacgtggttactacagatatctcggagatgggggccaatttccgcgcagaccgtgtgatcgatcctagacggtgcctgaaacccgtcattcttaaggacggaccagaaagggtgatcctagctggtccgatgcctgtaaccgtggcctctgcagcccagcgccgaggcagagttgggcggaaccataataaagagggagatcagtacatttatatgggccagcccctgaacaatgacgaggatcacgctcactggacagaagccaagatgttgttagacaacataaatactccagagggtatcattcccgcgctgtttgaacctgagagggaaaagtccgcagccatcgatggggagtaccgcctcagaggcgaggctaggaaaacgttcgtcgaactgatgcggcgtggagaccttccagtgtggctgagctataaggtggcctcagagggctttcaatacagtgatcgccgatggtgcttcgacggggaaagaaacaatcaggtcctcgaggaaaacatggatgttgagatctggaccaaagagggagaaaggaagaaattgcggccccgctggctggacgctagaacatattctgaccctctagcactgagggagtttaaggagttcgccgctggtcggcgatccgtgagcggcgatctcattcttgagatagggaaactgccgcagcatttaactcagaaggcccaaaatgcattggacaacctggtaatgctccacaattcagaacagggaggcagagcgtaccgccatgccatggaggagctgccagataccatcgaaacacttatgctgctcgctttgattgccgtgctgaccggtggggtcactttatttttcctaagtggcaggggactgggcaagacgagcatcgggctcctttgtgtgatggcatcctctgttctgttgtggatggctagcgtggagccccactggattgccgcatccatcatactggaatttttcctcatggtcctgcttatccctgagcccgaccggcagcgtaccccacaggataaccaactcgcctatgtagtgattggactgttgtttatgatcctgacagttgctgcgaatgagatgggtttactagaaactaccaaaaaggacctgggcattgggcacgtggccgtcgagaaccatcaccatgcagctatgctcgatgtggaccttcaccctgcctcagcctggacactgtacgcagtcgctaccactatcataacacccatgatgagacatacgattgaaaacaccactgccaatatctctttgacagcgattgctaaccaggccgcaatcctgatgggactcgataaaggctggccaataagtaagatggacatcggtgtgcctctgcttgccttagggtgctactcgcaggttaatccgctgaccctcaccgctgcagtgttgatgctggtagcccactatgcgattatcggccccggactacaagctaaagccacaagggaggcacagaagcgcactgccgctggcattatgaagaacccaacggtggatgggatcgtcgccatagacctggatcctgttgtgtacgacgcaaaattcgaaaagcagctcggacagattatgcttctgatcttgtgtaccagccaaatcctgctcatgcggacaacttgggctctgtgcgagtccattaccttagccacaggcccccttaccactctgtgggagggttctccagggaaattttggaatacgacaatcgcggtctcaatggccaacatattccgaggaagctatctcgcaggcgctggtctagccttctccctgatgaagagtttgggcgggggaagaaggggcaccggggcacagggagaaactctgggcgagaaatggaagcgccagctcaatcagctttctaagagcgaatttaacacctacaaacggtcaggtattatggaggtggacagatccgaagctaaggaggggctgaaacgtggagagacaactaagcacgccgtaagtaggggcaccgccaaattgcggtggttcgtggaacgcaatctggttaagcctgagggtaaggtgatcgatctcggctgtgggcgaggaggctggagctattactgcgcggggctaaagaaggtcacagaagtgaaaggatatacgaagggcggtcccgggcatgaggaaccgattccaatggctacctacggatggaacctggtcaaacttcactctggcaaggacgtgtttttcatccctcccgagaaatgtgatactctgctatgcgacataggcgagtcctcaccaaatcccacaatcgaagaggggagaaccctcagggttctgaagatggtagaaccttggttgcggggaaaccaattttgtattaaggtgctgaatccgtacatgcccagcgtcgtggagactctcgagcagatgcagcgcaaacatggtggcatgcttgttagaaacccactgtcgagaaattctacacacgaaatgtattgggtgagttgcgggaccggaaacatcgtctccgcagtgaatatgacgagccgaatgttactgaaccggttcaccatggcccaccgtaagcctacatacgagagagatgtagacttgggcgctggtactcgccatgtggccgttgaacccgaggtcgcaaacctcgatattatcgggcagaggattgaaaatatcaaacacgagcataagtcaacctggcactatgacgaggataacccttacaaaacatgggcctatcatggatcctacgaagtgaagccatctggcagcgctagttccatggtgaatggcgtcgttaagctgctaactaaaccctgggacgtgatacctatggtaacccaaattgcgatgacagataccactccatttgggcagcagcgggtgttcaaggagaaagtcgacacgagaacacccaaggccaaacgcggaaccactcaaatcatggaagtgaccgcaaggtggctttggggttttctgagccgaaacaagaagccgcggatctgtacaagagaggagttcacgaggaaagttcgctctaatgctgccattggcgcagtgtttgtcgacgagaaccagtggaactcagccaaggaggctgtggaagatgagcgtttctgggacctcgtacaccgggaaagagagctgcacaaacaggggaagtgcgcgacctgcgtttataacatgatgggaaaaagggaaaagaagttgggcgagtttggtaaagccaaggggagtcgcgcaatatggtacatgtggctgggagcccgattcctcgagttcgaagctcttggctttatgaatgaggatcattggttctcccgggaaaacagcctgtctggcgtggagggggagggattacacaaactgggttacatcttgagagacatttcgaagatccctggcgggaatatgtatgccgatgacactgcaggatgggatacaaggattaccgaagacgatctccagaacgaggctaaaatcactgacataatggaaccagagcatgccctgctagctaaggccatctttaaacttacataccaaaataaggtcgtgcgcgtgcagagacccgcaaagaacggcaccgtcatggatgttatttcacggagggaccagcgtggtagcggacaggtgggaacatatggcctgaatactttcaccaacatggaagcgcaactcatccgacagatggagtccgagggcatttttagtccttctgaactggagacgccaaacttggccgaacgcgtattagattggctggagaaatacggggtggaaagactcaagcggatggctatcagcggagacgactgtgtcgtgaaacccatagatgacaggttcgccaccgcacttacagctctgaatgatatgggtaaggttcgcaaagacattccgcagtgggagccttccaagggctggaacgattggcagcaagtgcccttttgctcacaccacttccatcagctaatcatgaaggacgggagagagatcgtcgtgccatgtcggaatcaggatgaactggtaggaagggcccgagttagtcagggcgcaggttggtctctccgtgagactgcctgcttggggaaaagctatgcgcaaatgtggcagctgatgtactttcacagacgcgaccttcggctggctgccaacgcaatttgttccgccgtgcctgtcgattgggtgcccacctcaaggacaacttggagcatacatgctcaccatcagtggatgaccacggaagacatgctctctgtttggaatagagtgtggatcgaggaaaacccatggatggaggataagacacacatttccagttgggaggacgtcccctatttaggaaaacgcgaagaccaatggtgcggcagcctgatcggcttgaccgcccgggcaacttgggctacaaatattcaggtggccatcaaccaggtaaggcgactgatagggaatgagaactacctcgattacatgacctcgatgaagagattcaaaaatgaatccgaccctgagggagcgctttggtga

SEQ ID NO: 14172 - RNA, 9879 nt, synthetic construct
  misc_feature 1..9879: note = derived and/or modified CDS sequence (opt3) from DENV-1__KC762642__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactcttacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaagcagagattttgtggagggtttgagtggcgcgacttgggtagacgttgtgctggagcacgggtcctgtgtcacaaccatggcaaaggataaacccactctagacatcgaactcctgaagacagaggtgaccaaccctgccgtgcttaggaaactgtgcattgaagctaagatctctaatacgaccacagatagccggtgtccaactcaaggagaggccaccttggtcgaagagcaggacgcaaacttcgtttgccgccgaacatttgtggatagaggctggggtaatgggtgtggactcttcggcaaaggctccctgataacttgcgctaagtttaagtgcgtaaccaaattagaggggaagattgtgcagtacgaaaacctgaaatattcagtcatcgtgacagttcacaccggagaccagcatcaagtgggtaatgagagtactgaacacggcacgacagccaccattactccccaggcgcctaccacagagatccagctcaccgactacggggcccttactctggattgtagcccaaggacaggattggacttcaacgaaatggtcctactgacgatgaaggagaaatcttggctcgtgcataagcagtggtttctggatcttccgctgccctggacctccggcgcatcaactacacaagagacctggaatcggcaggacttgctcgtaacattcaaaactgctcacgccaagaagcaggaagttgtggtcctgggtagccaagagggggctatgcacaccgccttaacgggcgcaaccgaaatccagacaagtggaactaccacaatttttgccggccatctgaaatgccgtctaaagatggataaactcactctgaaggggatgtcttatgtgatgtgtaccggatccttcaaacttgagaaggaagtcgctgagacgcagcacggtacagtgttggttcagataaagtacgagggcaccgacgcgccttgcaaaatcccattcagcactcaagatgaaaagggggtgacacagaacggacgcctgattaccgcaaatcccatcgtaactgacaaagagaagcctgtcaacatagaagccgagccaccctttggcgagtcgtatattgtgatcggtgctggggaaaaagccctcaagctgtcttggttcaagaaaggctcctcaatcggaaagatgtttgaggcaaccgccagaggcgctaggcggatggccattcttggggatacagcatgggacttcggaagtatcggtggcgtttttacgagcgtggggaaactggtccatcagattttcggaaccgcgtacggcgtgttgttttccggtgtatcttggactatgaagatagggatcggcgtgctcctgacatggttaggactgaatagccgatcaaccagtctatccatgacatgtattgctgttggcctcgtcactctgtaccttggggtgatggtgcaggccgatagcggatgcgtcatcaactggaaaggccgcgaattgaagtgtggttctgggatcttcgttaccaatgaggtgcacacgtggacagaacaatataagtttcaggcagactcaccgaaaagactgagtgccgctattggaaaggcctgggaggagggcgtgtgcggtataaggagcgcaacccggctcgaaaacatcatgtggaaacagatttccaacgagctgaatcatatcttactggaaaacgacatgaagttcactgtagtcgtgggcgatgttgctgggattcttgcccagggaaaaaagatgatccgccctcaacccatggagcacaaatactcttggaagtcgtggggcaaggcgaaaataatcggggccgacgtgcagaataccacatttattatcgatggaccaaacactcctgaatgtcccgacgatcagagagcttggaatatttgggaggtcgaggactatggcttcggtatctttaccacaaacatatggttgaagctcagggatagctacacgcaggtgtgcgaccaccgtctgatgtccgcagccattaaagattcaaaggctgttcatgccgacatggggtattggatcgaaagtgagaaaaatgaaacctggaagctagcacgggcgtctttcattgaggtgaagacttgtatctggccaaaaagccacacactgtggtccaacggagtactcgaatcagagatgataatccccaagatttacggcggtcctatcagccaacataattatcgaccaggctacttcacccagactgccgggccgtggcacctgggaaaacttgagttggattttgacctgtgcgaaggcacaaccgtcgtggtggatgagcactgcgggaacagaggaccctctttaaggacgactaccgtcacaggcaagattatccatgaatggtgttgccgctcctgtaccctccctccactgcggttcagaggtgaggacgggtgctggtacggaatggagataaggcccgttaaagaaaaggaggaaaatcttgtgaagagtatggtaagcgctggctctggtgaggtggactccttttcactgggcttgctctgtattagtatcatgatcgaagaggtcatgcgcagccgatggtcgcggaaaatgctgattactgggacactagccgtgttctttctgctcatcatgggacaggttacctggaacgatctgacacgtctttgcattatggtgggcgcaaatgcttccgacagaatggggatgggaactacctatttggccctgatggcaacgttcaagatgaggcctatgtttgccgtcggcttactcttccgccggctgacatctagagaggtgcttctgctaaccataggtctcagcctggttgcttcagtggaattgccaaacagtctggaggaattaggggatggactcgcgatgggcatcatgattctgaaacttctgactgactttcaatcccaccagttgtgggccaccctcctgtctctaacattcatcaagactacctttagcctgcattacgcatggaaaacgatggctatggtcctttccattgtatcactcttccccctgtgtttgagcacaaccagtcagaagactacatggctgccggtgttactcggctctctggggtgcaagcctcttaccatgtttctgatcgccgagaataaaatatggggaaggaagtcctggccattgaacgaaggtatcatggccgttggcattgtgagcatcctcctgtcgtcactactgaaaaacgatgtcccccttgctgggcctctcattgcaggaggcatgctgatcgcctgttatgtgatatctggtagttccgcggacttgagcttagagaaggctgccgaggtatcttgggaagaggaagcagagcacagcggggcctcccataatattctggtggaagtccaggatgacggaactatgaaaatcaaggatgaggagcgagacgatacactcaccatcctgcttaaagctacgctgttggcagtttcaggcgtgtaccccctaagtattccagccactctgttcgtgtggtatttctggcaaaagaagaaacagcgcagcggcgtcctctgggacaccccttctcccccagaagtggagcgggcggttctggatgacgggatatacagaatcatgcagaggggacttttaggtcgttcccaggtaggcgtgggggtctttcaagaaaacgtgttccacacaatgtggcacgttacccgcggagctgtgctgatgtatcagggcaagcggctcgagccgtcatgggccagtgtcaaaaaggacttgattagctacggtgggggatggagactgcagggctcctggaatacaggcgaggaagtgcaggtaatcgcagtcgagcctgggaaaaaccccaagaatgtgcaaactgccccaggaacctttaagacgcccgaaggtgaggttggcgctattgccctcgatttcaaacctgggacatctggatcgccaatcgtgaacagggaaggcaagatagtcggtctgtacgggaatggagtggttactaccagcggcacatatgtgtcagcaatcgctcaggccaaagcgtcccaggagggcccccttcctgagattgaagacgaggtctttcgaaagcggaacctgaccatcatggatttgcatccggggagtggaaaaactcgcagatacctaccagccattgtgagggaagcaatcaagcggaagctgcgaaccctcatattagctcccacaagagtagtggcctctgagatggctgaagcactgaaaggtatgcctattcgctatcaaacgactgccgttaagagcgagcacaccggcagggagatcgtcgaccttatgtgccatgccacattcaccatgcgtctgctctccccagtgcgggtgcccaattacaacatgatcattatggatgaagctcactttactgacccttcatctatcgcggcaagagggtatataagcacaagggtcggaatgggcgaggccgctgccattttcatgaccgcaacgccgcccggtagtgtagaagcctttccacagtccaatgctgtgatccaggatgaggaacgcgacattcctgagcgaagctggaactctgggtacgagtggatcactgatttccccggaaaaacagtttggtttgtgccatcaataaagtccggcaatgacattgcgaactgtttgagaaaaaatggcaagcgggtcatccagctgagtaggaagaccttcgataccgaatatcaaaaaactaagaacaacgactgggactacgtggttacaaccgatatcagcgagatgggggccaatttccgcgcagaccgtgtgattgatcctagacggtgcctcaaacccgtcatcctgaaggacggaccagaaagggtgattcttgctggtccgatgcctgtaacagtggcctcggcagcccagcgccgaggcagaatagggcggaaccataataaagagggagatcagtacatctatatgggccagcccctaaacaatgacgaggatcacgctcactggactgaagccaagatgctgttggacaacattaatacgccagagggtatcatccccgcgttatttgaacctgagagggaaaagtctgcagccattgatggggagtaccgcctgagaggcgaggctaggaaaaccttcgttgaactcatgcggcgtggagacctgccagtctggctttcctataaggtggccagcgagggctttcaatactcagatcgccgatggtgcttcgacggggaaagaaacaatcaggtgctggaggaaaacatggatgtcgagatatggacaaaagagggagaaaggaagaaactccggccccgctggttggacgctagaacttatagtgaccctctggcactaagggagtttaaggaattcgccgctggtcggcgatctgtttccggcgatctgatcctcgagattgggaaacttccgcagcatctgacccagagagcccaaaatgcattagacaacttggtgatgctgcacaatagcgaacagggaggccgcgcgtacaggcatgccatggaggagctcccagatacaatcgaaaccctgatgcttctggctctcattgccgtattgactggtggggtgacgctgtttttcttatcaggccggggactaggcaagaccagtatcgggctgctctgtgtcatggcaagctccgtgcttctgtggatggcttctgttgagccccactggatagccgcaagcatcattttggaatttttcctgatggtgctcctgatccctgagcccgaccgtcagagaacaccacaggataaccaacttgcctatgtcgtaattggactcctgtttatgatcttgactgtggctgcgaatgagatgggtctgttagaaaccacaaagaaagacctaggcatagggcacgttgccgtggagaaccatcaccatgcagctatgctggatgtcgacctccaccctgcctccgcctggaccctttacgcagtggctactacaattatcacgcccatgatgaggcataccattgaaaacactacagccaatatctcactgaccgcgatagctaaccaggccgcaatcttgatgggactggataagggctggccaatttctaaaatggacatcggtgtccctctcctggcccttgggtgctacagtcaggtgaatccgttaaccctgacagctgcagttctcatgttggtggcccactatgcgattatcggccccggactgcaagctaaggccactcgcgaggcacagaaacggacggccgctggcataatgaagaacccaaccgtagatgggattgtggccatcgacctagatcctgtcgtttacgacgcaaagttcgaaaaacagctgggacagatcatgctccttattctgtgtacatcgcaaatcttgctgatgcgaactacctgggctctctgcgagagcataacactggccaccggccccttaactacgctttgggagggttccccagggaagttttggaatacaaccattgcggtgtctatggccaacatcttcagaggatcatatctggcaggcgctggtctcgccttcagcctaatgaaatccctgggcgggggaaggcgcggcactggggcacagggagaaaccttgggcgagaagtggaaacggcagctgaatcagctcagtaagtctgaatttaacacatacaagagaagcggtattatggaggtcgaccgttcagaagctaaagaggggcttaagaggggagagactaccaaacacgccgtgtcccggggcacagccaagctgcgctggttcgtagaacgaaatttggtgaaacctgagggtaaggttatcgatctgggctgtgggagaggaggctggagttattactgcgcggggctcaagaaagtgacggaagtcaagggatataccaaaggcggtcccgggcatgaggaaccgataccaatggctacttacggatggaacttagtgaagctgcacagcggcaaagacgtctttttcatccctcccgagaagtgtgatacacttctgtgcgacattggcgagtcttccccaaatcccaccatcgaagaggggaggactctacgggtgctcaaaatggttgaaccttggctgcgcggaaaccaattttgtattaagatcttgaatccgtacatgccctcagtagtggagacactggagcagatgcagagaaagcatggtggcatgctcgtcaggaacccacttagccgaaattcgacccacgaaatgtattgggtgtcttgcgggacgggaaacattgttagtgcagtgaatatgacctcccggatgctgttaaaccgtttcacaatggcccacagaaaacctacttacgagcgcgatgtcgacctgggcgctggtaccaggcatgtggccgtagaacccgaggtggcaaacttggatatcatagggcagcggattgaaaatatcaagtatgagcacaaaagcacatggcattacgacgaggataacccttataagacttgggcctaccacggatcatatgaagttaaaccatccggctctgctagcagtatggtcaatggcgtggtgaagctcctgaccaagccctgggacgtcatccctatggttacacaaattgcgatgaccgatactacgccatttgggcagcagagagtgttcaaagagaaggtagacacacgcacccccaaagccaagaggggaactgcacaaataatggaagtgaccgctcgatggctatggggttttctttcccggaacaaaaagccgagaatctgtacaagggaggaattcacgcgcaaggtccgtagcaatgccgcaattggcgccgtgtttgttgacgagaaccagtggaattctgctaaagaggccgtggaagatgagcggttctgggacctggtccatagagaaagggagctccacaagcaggggaaatgcgcgacctgcgtgtacaacatgatgggaaagcgcgaaaaaaagctgggcgagtttggtaaggcaaaagggtcacgagccatctggtacatgtggttgggagctcggttcctggagttcgaagccctcggctttatgaatgaggatcactggttcagtagagaaaactcccttagcggcgtagagggggagggactgcataagttaggttatattctgagggacatctctaaaatacctggcgggaatatgtacgcagatgacactgctggatgggatacacgcatcaccgaagacgatttgcagaacgaggccaagattactgacatcatggaaccagagcacgctctcctggccaaagcagtttttaagctaacatatcaaaataaagtggtcagagtgcagcggcccgcgaagaacggcaccgtgatggatgtcatttcgaggcgtgaccagcgaggttcagggcaggttggaacatacggccttaatactttcaccaacatggaagcccaactgatccgccagatggagagcgagggcatattttcccctagtgaactcgagacgccaaacctggctgaaagagtgttgtattggttagagaagtacggggtagaacggctgaaaaggatggccatttctggagatgactgtgtggtcaagcccatcgacgatcgcttcgcaaccgctctcacagcccttaatgacatgggtaaagtgagaaaggatatcccgcagtgggagcctagcaaaggctggaacgactggcagcaagttcccttttgctcccatcacttccaccagctgattatgaaggatgggcgggagatagtggtcccatgtaggaatcaggacgaactagtgggacgagcacgtgtatcacagggcgccggttggagtctgagagagactgcgtgcctcgggaagtcttatgctcaaatgtggcagttgatgtactttcatcgccgggatctgaggcttgccgcaaacgccatctgtagcgctgttcctgtggactgggtccccacctccagaacaacttggtcaattcacgcccatcaccagtggatgaccacggaagatatgctgagcgtgtggaatcgcgtttggatcgaggaaaacccatggatggaggacaaaacacatatttcttcctgggaggatgtgccctacctcggaaagcgggaagaccaatggtgcggcagtttaatcggcctgaccgcaagggctacttgggccacaaatatacaggtcgcgatcaaccaggtgcgaagattgattgggaatgagaactatctggactacatgaccagcatgaaacggttcaagaatgaatcggatcctgagggagctctctggtga

SEQ ID NO: 14173 - RNA, 9879 nt, synthetic construct
  misc_feature 1..9879: note = derived and/or modified CDS sequence (opt3) from DENV-1__JQ915077__SS-prME
  source 1..9879: mol_type = other RNA
agcgtgaccatgctgctcatgcttctgcccaccgtcttgactttccacttaacgaccagaggcggggagcctcatatgatcgtttccaagcaggaaaggggaaaatctctgttatttaagacctcagcaggggtgaatatgtgcactctcattgctatggacctgggcgagctttgtgatgacaccatgacatacaaatgcccgcggataaccgaaactgagccggatgacgtagattgttggtgcaatgcaacagaaacctgggtgacgtatgggacttgtagtcaaaccggagagcaccgccgagacaagcgtagcgtcgcactggcgccccatgtgggcttgggtctcgagacaagaactgaaacctggatgtcctctgagggggcttggaggcagatccagaaagttgaaacatgggccctgcggcaccctggattcaccgtgattgcactgtttctcgcccatgctatcggcacgtcgattactcagaagggcatcatattcatcttactgatgcttgtcacaccatcaatggcaatgcgctgcgtggggattggaaacagagattttgttgagggtttgagcggcgccacctgggttgacgtggtcctggagcacgggagttgtgtgactacaatggctaaggataaacccaccttggacatcgaactcctgaagacggaggtgaccaatcctgccgtccttaggaaactgtgcattgaagcgaagatctccaacacaactaccgattctcggtgtccaacacaaggagaggcaactttggttgaggaacaggacaccaatttcgtgtgccgccgaacatttgtagatagaggctggggtaacgggtgtggactcttcggcaaaggcagcctgataacctgcgccaagtttaagtgcgtgactaaattagaggggaagattgtccagtacgaaaatctgaaatattccgtgatcgttacggtgcacacaggagaccagcatcaagtcggtaacgagaccactgaacacggcaccattgctacaatcacaccccaggcccctacttcagagatccagctcacagactacggggcacttacgctggattgtagtccaaggaccggattggacttcaatgaaatggtgctactgactatgaaggagaaaagctggctcgtacataagcagtggtttctggatcttccgctgccctggacatctggcgcttccacctcacaagagacatggaaccggcaggacttgctcgttactttcaaaaccgcccacgcgaagaagcaggaagtggtcgtgctgggtagccaagagggggccatgcacacggcattaaccggcgctacagaaattcagacaagtggaaccacaactatatttgccggccatctgaaatgccgtctaaagatggataaactcaccctgaaggggatctcttatgtcatgtgtacgggatccttcaaacttgagaaggaagtggctgagacacagcacggtaccgttttggtgcaggtaaagtacgagggcactgacgccccttgcaaaattccattcagctcgcaagatgaaaagggggtcacacagaatggacgcctggtgaccgcaaaccccatcgttactgacaaagagaagcctgtgaatatagaagccgagccaccctttggcgagtcttatattgtcgtgggtgctggggaaaaagcgctcaagctgtcctggttcaagaaaggctcaagtatcggaaagatgtttgaggcaaccgccagaggcgctaggcggatggccatccttggggatacagcatgggacttcggaagcattggtggcgtatttacgtccgtggggaaactggttcatcagatcttcggaaccgcctacggcgtcttgttttctggtgtgagctggactatgaagattgggataggcatcctcctgacatggttaggactgaactcacgaagtacctccctaagcatgacatgtattgctgtgggcatggtcactctctacctgggggttatggtgcaggccgattctggatgcgtgatcaattggaaaggccgcgaacttaagtgtggttcagggatcttcgtaaccaacgaggtccacacgtggacagaacaatataagtttcaggcagacagtccgaaaagattgagcgcggctattggaaaggcctgggaggagggcgtgtgcggtataaggtccgcaacccggctggaaaacatcatgtggaaacagatttctaatgagctcaaccatatcctgttagaaaatgacatgaagttcactgttgtggtcggcgatgtgtcggggattctggcccagggcaagaaaaccatccgccctcaacccatggagcacaaatacagctggaagtcctggggcaaggctaaaataatcggggccgacgttcagaacacaacttttattatcgatggaccaaatacccctgaatgtcccgacgatcagagagcatggaacatttgggaggtggaggactatggcttcggtatctttacaacgaatatatggcttaagttgagggattcatacacccaggtatgcgaccaccgtctcatgagtgctgccattaaagattctaaggcggtccatgccgacatggggtattggatcgaaagcgagaaaaacgaaacttggaagctggctcgggcatccttcattgaggtgaagacatgtgtgtggccaaaatcacacaccctatggagcaatggagtcctggaatctgagatgatcatacccaagatctacggcggtcctatttcccaacataactatcgaccaggctacttcactcagacagccgggccgtggcacctcggaaaactggagcttgattttgacttgtgcgaaggcaccacggttgtggtagatgagcactgcgggaatagaggacccagtctgaggactaccacagtgaccggcaagatcattcatgaatggtgttgccgcagctgtactttacctccactccggttcaaaggtgaggacgggtgctggtacggaatggagatcagacccgtcaaggaaaaggaggaaaacctggtgaaatctatggtttccgctggctcaggtgaggtggacagttttagccttggcctgttgtgtatatcgattatgatcgaagaggtcatgaggtcccgctggtctcgaaagatgctcatgacagggaccctggtggttttcctactgctcacactgggacagcttacttggaatgatttgatccggctgtgcattatggtgggcgccaacgcaagcgacaatatggggatgggaaccacgtatttagcgctcatggccacatttcgtatgagacctatgttcgctgtcggcctgctttttaggcgcctgacctcacgggaggtactactcctgactgtgggtttgagtctggttgcctccgtggaattaccaaactctctcgatgagctgggggacggacttgcaatgggcatcatgattctgaaattgctcaccgatttccaaagccaccagctgtgggctatactactgtcccttacatttgtcaagactaccctctcactgcattacgcctggaaaacgatggcaatgatcttgagcattgtgagtctgttacccctctgtctgtctacaacctcccagaagactacatggcttccggtactgttgggcagcctcgggtgcaagcctctgaccatgttcctaatcactgaaaacaaaatttggggaagaaagtcgtggccactgaatgagggtatcatggccgtgggcatagtctcaatccttctctctagtctgttgaaaaacgacgttcccttagctgggcctctgattgcgggaggcatgctcatcgcctgttatgtgatttccggtagctctgcagatctgagccttgaaaaggctgccaaagtgtcctgggaggaggaagccgagcactcaggggctagtcataatatcctggtcgaaatacaggacgatggaacaatgaagattaaagacgaggaaagggatgacaccatcacgatcttgctaaaggcaactctgctcgccattagcggcgtgtaccccatgtctataccagcgaccctgtttgtttggcacttctggcaaaagaaaaagcagcgatccggcgtactttgggatacaccttcacccccagaggtggagaaagctgtcttagacgacgggatctatcgcattctgcagcggggactcttgggtagaagtcaggtgggcgttggggtgtttcaagaaggagtcttccacaccatgtggcatgtgacaaggggcgccgtactgatgtaccagggtaagcgtctcgagccgagctgggcatccgtcaaaaaggatctgatctcttatgggggaggctggcgcttccagggctcgtggaacactggggaagaggtgcaggttattgccgtggagcctggaaagaatcccaaaaacgtccaaaccgctccaggtacgtttaagacaagcgaaggcgaggtgggggcaatcgcccttgacttcaaacccggaacttcaggctcccctatagttaatcgggaaggtaagatcgtggggctgtacggaaacggcgtcgtgaccacaagtggcacctacgtatctgcgattgctcaggccaaagcaagccaggaggggccattgcccgaaatcgaggatgaggtgtttagaaagaggaatctaactattatggacctgcaccctggatccggtaagacccgacggtatctcccggccatcgttcgcgaagctataaaaagaaagttaaggacactggtccttgccccaacgcgggtggtggcatcagagatggctgaagccctgaaaggcatgcccattcgataccaaactaccgcggtcaagtctgagcatacagggaaagaaatcgtagatctcatgtgccacgccaccttcactatgagattgctgagccctgtgcgcgttccaaactataatatgatcattatggacgaggcacattttacagatcccgctagtatcgccgctaggggatacatatccacccgtgtgggcatgggtgaggcagccgccattttcatgacggctactcctccggggagcgtcgaagcgtttccccagtctaacgcagtgatccaggacgaggaaaaggatattccagagcggtcatggaactccggatatgactggatcacagatttccctggcaagaccgtttggtttgtgcccagtataaaaagcggcaacgacattgccaattgtctcagaaagaacgggaaaagggtcatccagctgtcgcgcaagaccttcgacactgaataccaaaagactaagaacaatgattgggactatgtggtaaccacagatatctctgagatgggagctaactttcgagccgacagagtgattgatccacggaggtgccttaagcctgttatcctaaaagacggtcccgagcgcgtcattctggcaggcccaatgccggtgactgtggcctccgctgcgcagcgtagagggcggataggaaggaatcagaacaaggaaggcgatcagtacatctacatgggtcaacctttgaataacgacgaggatcacgcccactggacggaagcaaaaatgttactggacaatattaacacccccgaggggatcatcccagctctcttcgagcccgaacgcgagaaaagcgccgcaattgatggcgaatatcgactgagaggagaagcccggaaaacattcgtcgaacttatgaggcgcggcgacctgcctgtttggctctcatacaaggtggctagtgaggggtttcagtattctgatagaaggtggtgcttcgacggagagcggaataaccaggtattggaagagaatatggacgtggaaatatggactaaagagggtgaacgtaagaagctgcgcccacgatggctagatgccagaacctactccgaccccctggcgctcagggagtttaaagagttcgcagccggccggcgcagcgtctcaggggatcttatcctggaaattggaaagttacctcagcatttgacacaaagagctcagaacgccctggacaatctcgtgatgctgcacaacagtgagcagggcggtaaggcttataggcatgcaatggaggaacttccggataccatcgaaactattatgctgctcgccttgatcgctgttctgacgggtggagtgaccttatttttcctaagcggacggggcctggggaagacatccataggactcctttgtgtcacttctagctccgtactgttgtggatggcctcagtggagccacactggatcgcagcgtctattatcctggagtttttcctcatggttctgcttattcccgaacctgaccgacagagaacaccccaagataatcagctcgcctacgtggtcatcggtctgttgtttatgatactgacagtggctgccaacgagatgggcttactagaaaccactaaaaaggacctggggattggacacgcagctgccgagaaccatcaccatgcagccatgctcgatgtcgaccttcacccagctagtgcgtggacactgtatgccgtggcaacgaccatcattactcctatgatgcgccatacaatcgagaataccaccgctaacatatcgttgacagccatcgccaatcaggcagctattctgatgggcctcgataagggttggcccatcagcaaaatggacattggggttccactgcttgccttaggctgctactcccaagtgaaccctctgactctcacggcggctgtattgatgctggtggcccactacgcaatcataggaccgggcctacaggccaaggctaccagggaagcacagaaacggacagccgcggggattatgaagaatcccactgtcgatggaatcgttgctatcgacctggacccagtggtctatgatgccaaattcgagaagcagctcggccaaattatgcttctgatcttgtgtacctctcagatactgctcatgcgtacaacctgggcactgtgcgaatcaattactttagccacgggtcctcttacaaccctgtgggaggggagccccggaaagttttggaacactaccatcgctgtgtccatggccaatattttcagaggcagttacctcgccggtgctggcctagccttttctctgatgaaaagcctagggggaggcaggcgcgggacaggagcgcagggcgaaactctgggtgagaagtggaaacggcagctcaaccaactttcaaagtccgagttcaatacctataaacgaagtgggatcatagaagtagacagaagcgaggccaaggaaggactgaagaggggcgagacaacgaaacacgcagtgtctcgcggtaccgctaagttgcggtggttcgttgaaagaaacctggtgaaaccagagggcaaggtcatcgatctcgggtgtggacgtggcgggtggtcctactattgcgccggactgaaaaaggtgactgaggtcaaaggctacacaaagggtgggcctggacatgaggagcccattccgatggcaacctatggctggaatctagtgaaacttcactcaggcaaagacgtatttttcatcccacctgaaaagtgtgatactctgctatgcgacattggggagagctcgcccaacccaacaatcgaagagggaaggaccctccgggtactgaaaatggtggagccctggttgcgcggtaatcagttttgtattaagatcctgaacccttacatgccgtctgtcgtggaaacgctcgagcagatgcagcgaaaacatggcgggatgcttgttagaaatcccctgagtaggaactccacccacgaaatgtactgggtgagctgcggaacaggcaatatagtctcagctgtgaacatgacttcccggatgttactgaaccgcttcaccatggcccacagaaagccaacatatgagagggatgtagacttgggtgccgggactcgacatgtggcggttgagcctgaagtcgctaatctcgatattatcggacaacggatcgagaacattaagaatgaacacaaatctacctggcattacgacgaggataacccctataagacatgggcataccacggcagctatgaagtgaaacctagtggctccgccagctctatggtgaatggggtcgttcgtctgctaaccaagccatgggacgtgatacccatggtaactcagatcgctatgacggacacaaccccttttggacagcaaagagtgttcaaagagaaggtcgatactcgcaccccaaaggccaaaaggggtacagcacagattatggaggtgacggccaagtggctttggggctttctgtcacggaacaaaaagcccagaatctgtacccgcgaagagttcactaggaaagttcgaagtaatgctgcgattggggccgtgtttgtcgacgaaaaccagtggaactccgcaaaggaggctgtggaagatgagcggttctgggacctcgtaagaagggagcgcgaactgcataagcagggaaaatgcgccacatgcgtttacaacatgatgggcaagcgtgagaaaaagttgggtgaatttgggaaagcaaagggaagccgggccatctggtatatgtggctgggcgctagattcctcgagtttgaagcccttggcttcatgaatgaggatcactggttctctagggagaactcgctgtcaggggtggaaggagagggtttacacaaactgggctacatattgcgcgacatcagcaagattccagggggaaatatgtacgcggatgacaccgcaggctgggatactcgaatcacagaagacgatctccaaaacgaggccaagattaccgacatcatggagcctgaacatgctctgctagccacatccatatttaaacttacttatcagaataaggtcgtgcgggtgcagagaccagccaaaaatggtaccgtcatggatgttattagtaggcgcgaccagagagggtctggacaagtgggcacgtacggcctgaacaccttcacaaatatggaggctcagctcatccggcagatggaaagcgaggggatcttttccccctcagaactggagactcctaacttggccggaagggtattagactggctggagaagcacggtaccgaacgtctccgacgcatggctattagtggcgatgactgtgtggtcaaaccaatagatgacagattcgccacagcacttactgcgctgaatgatatggggaaggtgcggaaggacatcccccagtgggagccgtctaaaggatggaacgattggcaacaggttcctttttgcagccatcacttccaccagctaattatgaaggacggcagggaaatcgtggtcccctgtcgcaatcaggatgagctggtgggtagagcccgggtatcccaaggggctggatggtcactcagggaaaccgcctgcttgggcaaaagctatgcacagatgtggcagctgatgtactttcatcgacgtgaccttagactggctgccaacgcaatttgttctgccgttccagtggattgggtccctacgtcccgcacaacctggagtatccacgcgcatcaccaatggatgactacagaggacatgctcagcgtgtggaatcgggtttggatagaggaaaacccctggatggaggacaagacccatgtgtcgtcctgggaagatgtcccatatttaggcaaaagggaggaccagtggtgcgggtctctgatcggattgactgctagagccacctgggcaacaaatattcaggtggccatcaaccaggtacgccggctgattggtaatgaaaactacctcgattatatgacgtcaatgaagaggttcaagaatgagagcgaccccgagggcgctctttggtga

SEQ ID NO: 14174 - RNA, 9879 nt, synthetic construct
  misc_feature 1..9879: note = derived and/or modified CDS sequence (opt3) from DENV-1__JQ915079__SS-prME
  source 1..9879: mol_type = other RNA
tccgtgaccatgctgctcatgcttctgcccaccgtcttgactttccacttaacgaccagaggcggggagcctcatatgatcgtttccaagcaggaaaggggaaagtctctgttgtttaagacatcagctggtgtgaatatgtgcactctcattgcaatggacctgggcgagctttgtgatgacaccatgacatacaagtgcccacggataaccgaaactgagccggatgacgtagattgttggtgcaatgcaacagaaacctgggtgacgtatgggacttgtagtcaaaccggagagcaccgccgagacaagcgtagcgtcgccctggcgccccatgtgggcttgggtctcgagacaagaactgaaacctggatgtcctctgagggggcttggaggcagatccagaaagttgaaacatgggccctgcggcaccctggattcaccgtgattgcactgtttctcgcccatgctatcggcacgtcgattactcagaagggcatcatattcatcttactgatgcttgtcacaccatcaatggcaatgcgctgcgtggggattggaaacagagattttgttgagggtttgagcggcgccacctgggttgacgtggtcctggagcacgggagttgtgtgactacaatggctaaggataaacccaccctagacatcgaactcctgaagacggaggtgaccaatcctgccgtccttaggaaactgtgcattgaagcgaagatctccaacacaactaccgattctcggtgtccaacacaaggagaggcaactttggttgaagaacaggacaccaatttcgtgtgccgccgaacatttgtagatagaggctggggtaacgggtgtggactcttcggcaaaggcagcctgataacctgcgccaagtttaagtgcgtgactaaattagaggggaagattgtccagtacgaaaatctgaaatattccgtgatcgttacggtgcacacaggagaccagcatcaagtcggtaacgagaccactgaacacggcaccattgctacaatcacaccccaggcccctacttcagagatccagctcacagactacggggcacttacgctggattgtagtccaaggaccggattggacttcaatgaaatggtgctactgactatgaaggagaaaagctggctcgtacataagcagtggtttctggatcttccgctgccctggacaaccggcgcttctacatcccaagagacttggaaccggcaggacttgctcgttaccttcaaaacggcccacgcgaagaagcaggaagtggtcgtgctgggttcacaagagggggccatgcacaccgcattaacaggcgctactgaaattcagaccagcggaacaactaccatatttgccggccatctgaaatgccgtctaaagatggataaactcacgctgaaggggatcagttatgtcatgtgtacaggatctttcaaacttgagaaggaagtggctgagacccagcacggtactgttttggtgcaggtaaagtacgagggcacagacgccccttgcaaaattccattctccagccaagatgaaaagggggtcacccagaatggacgcctggtgactgcaaaccccatcgttaccgacaaagagagacctgtgaatatagaagccgagccaccctttggcgagtcgtatattgtcgtgggtgctggggaaaaggcgctcaaactgtcttggttcaagaagggctcctcaatcggaaaaatgtttgaggcaacagccaggggcgctcggcgaatggccatccttggggatacggcatgggacttcggaagtattggtggcgtatttaccagcgtggggaagctggttcatcagatcttcggaactgcctacggcgtcttgttttccggtgtgtcttggacaatgaaaattgggataggcatcctcctgacctggttaggactgaacagccgctcaacaagtctatccatgacttgtattgctgtgggcatggtcaccctctacctgggggttatggtgcaggccgatagcggatgcgtgatcaattggaagggcagagaacttaaatgtggttctgggatcttcgtaacgaacgaggtccacacatggaccgaacaatataagtttcaggcagactcaccgaagaggttgagtgcggctattggaaaagcctgggaggagggcgtgtgcggtatacggagcgcaactcgcctggaaaacatcatgtggaagcagatttccaatgagctcaaccatatcctgttagaaaatgacatgaaattcaccgttgtggtcggcgatgtgtctgggattctggcccagggaaagaaaacaatcagacctcaacccatggagcacaagtactcgtggaaaagctggggcaaggctaagataatcggggccgacgttcagaacactacctttattatcgatggaccaaatacacctgaatgtcccgacgatcagagggcatggaacatttgggaggtggaggactatggcttcggtatctttacgaccaatatatggcttaaattgcgtgattcctacactcaggtatgcgaccaccggctcatgtcagctgccattaaggatagtaaagcggtccatgccgacatggggtattggatcgaatctgagaagaacgaaacatggaaactggctcgagccagcttcattgaggtgaagacctgtgtgtggccaaagtcccacactctatggtcaaatggagtcctggaaagcgagatggttatccccaaaatatacggcggtcctatctctcaacataactatagaccaggctacttcacacagaccgcagggccgtggcacctcggaaagctggagcttgattttgacttgtgcgaaggcacgactgtggtagtggatgagcactgcgggaataggggaccctccctgcgcaccacaaccgtcactggcaaaattatccatgaatggtgttgccggagttgtacattacctccactcagattcaagggtgaggacgggtgctggtacggaatggagattaggcccgtgaaagaaaaggaggaaaacctggttaagagcatggtgtctgctggctccggtgaggtcgactcatttagtcttggcctgttgtgtatcagcataatgattgaagaggtgatgcgctcgcgatggtcccggaaaatgctcatgaccgggacactggttgtgttcctactgctcactctgggacagcttacctggaatgatttgatccgtctgtgcatcatggtcggcgccaacgcatctgacaatatggggatgggaacgacatatttagcgctcatggccacctttagaatgaggcctatgttcgctgtaggcctgctttttcgccggctgactagcagagaggtgctactcctgaccgttggtttgtcactggtggccagtgtcgaattaccaaactccctcgatgagctgggggacggacttgcaatgggcattatgatcctgaagttgctcacagatttccaatctcaccagctgtgggctactctactgagccttacctttgtgaaaacgacactctccctgcattacgcctggaagaccatggcaatgattttgtcaatagtaagcctgttacccctctgtctgagtactacatctcagaaaaccacttggcttccggtgctgttgggctccctcgggtgcaagcctctgacaatgttcctaatcaccgaaaacaagatttggggaaggaaaagctggccactgaatgagggtatcatggccgtcggcattgtttcgatccttctctcatctctgttgaagaacgacgtgcccttagctgggcctctgatagcgggaggcatgctcatcgcctgttatgtgattagtggttccagcgcagatctgtctcttgaaaaagctgccaaggtcagctgggaggaggaagccgagcactccggggcttcacataatatcctggtggaaattcaggacgatggaacgatgaaaatcaaggacgaggaacgagatgacactataaccattttgctaaaagcaacactgctcgccatcagtggcgtttaccccatgagcatcccagcgaccctgtttgtatggcacttctggcaaaagaagaaacagcgctctggcgtgctttgggatacaccttcacccccggaggtcgagaaggctgtgttagacgacgggatttatcggatactgcagagaggactcttgggtaggagccaggttggcgtgggggtctttcaagaaggagtgttccacactatgtggcatgtaacccgtggcgccgtcctgatgtaccagggtaaacgcctcgagccgagttgggcaagcgtgaagaaagatctgatctcctatgggggaggctggcggttccagggctcttggaacatgggggaagaggttcaggtgattgccgtcgagcctggaaagaatcccaagaacgtgcaaacggctccaggtacatttaaaacttcggaaggcgaggttggggcaatcgcccttgacttcaagcccggaaccagcggctcacctattgtgaatagagaaggtaaaatcgtcgggctgtacggaaacggcgtggtaacaacctccggcacttacgtgagtgcgatagctcaggccaaggcatctcaggaggggccattgcccgaaatcgaggatgaggtttttaggaaacgaaatctaaccattatggacctgcaccctggaagcggtaagacacggcgctatctcccggccatcgtcagagaagctattaagaggaaattacggacgctggtgcttgccccaactcgagtggtcgcatccgagatggctgaagccctgaagggcatgcccatcagataccaaaccacagcggtaaaatcagagcataccgggaaggaaatagtggatctcatgtgccacgccactttcacaatgcgcttgctgtctcctgttagggtgccaaactataatatgattatcatggacgaggcacattttaccgatcccgctagcatcgccgctcgtggatacattagtacgcgggtcggcatgggtgaggcagccgccatcttcatgactgctacacctccggggtccgtggaagcgtttccccagagcaacgcagttatacaggacgaggaaaaagatattccagagagatcttggaactcaggatatgactggatcaccgatttccctggcaagaccgtgtggtttgtcccctccattaagagtggcaacgacatcgccaattgtctcaggaaaaacgggaagcgcgtgatacagctgagccgaaaaactttcgacacagaataccaaaagaccaaaaacaatgattgggactatgtagtgacaactgatatttcggagatgggagctaactttagagccgaccgggttatcgatccaaggcgctgccttaagcctgtcatcctaaaggacggtcccgagcgtgtgattctggcaggcccaatgccggtgacggtcgcctctgctgcgcagagacgggggaggatcggacgcaatcagaacaaagaaggcgatcagtacatttacatgggtcaacctttgaataacgacgaggatcacgcccactggaccgaagcaaagatgttactggacaatataaacacacccgaggggatcattccagctctcttcgagcccgaacgagagaaatccgccgcaatcgatggcgaatatagactgcggggagaggccaggaagactttcgttgaacttatgcgcagaggcgacctgcctgtgtggctcagctacaaagtagcttcagaggggtttcagtatagtgataggcggtggtgcttcgacggagagcgtaataaccaggtgttggaagagaatatggacgtcgaaatctggaccaaggagggtgaacgcaaaaagctgcgaccaagatggctagatgccaggacatactctgaccccctggcgctccgggagtttaaggagttcgcagccggccgcagatccgtgagcggggatcttattctggaaataggaaaattacctcagcatttgacccaaagggctcagaacgccctggacaatctcgttatgctgcacaactcagagcagggcggtaaggcttatcggcatgcaatggaggaacttccggatactatcgaaacgattatgctgctcgccttgatcgctgtgctgaccgggggcgtcacattatttttcctaagtggacgaggcctggggaaaactagcattggactcctttgtgtaacctcctctagcgccctgttgtggatggcatccgtggagccacactggatcgcggcctcaataatcctggagtttttcctcatggttctgcttattcccgaacctgacagacagcgcacaccccaagataatcagctcgcttacgtggtcatcggtctgttgtttatgattctgaccgtggccgcaaacgagatgggcttactagaaactacaaagaaagacctggggatcggacacacggctgccgagaaccatcaccatgcagccatgctcgatgtcgaccttcacccagcttctgcgtggaccctgtatgccgtggcaactacaataattacccctatgatgaggcataccatcgagaatacaactgctaacattagtttgacggccatcgccaatcaggcagctatactgatgggcctcgataagggttggcccatctcgaagatggacattggggttccactgcttgccttaggctgctacagccaagtgaaccctctgaccctcacagcggctgtattgatgctggtggcccactacgcaatcattggaccgggcctacaggccaaagctactcgggaagcacagaagcgtaccgccgcggggatcatgaaaaatcccacagtcgatggaatagttgctattgacctggacccagtggtctatgatgccaagttcgagaaacagctcggccaaatcatgcttctgatcttgtgtacctcccagattctgctcatgagaactacgtgggcactgtgcgaatctatcacattagccaccggtcctcttactaccctgtgggaggggtcacccggaaagttttggaacacaactatagctgtgagcatggccaatattttcaggggctcctacctcgccggtgctggcctagcctttagtctgatgaagtctctagggggaggccgccgggggaccggagcgcagggcgaaacactgggtgagaaatggaagcgacagctcaaccaacttagcaaatcacagttcaatacgtataagagatccgggatcattgaggtagacaggagtgaagccaaagagggactgaagcgcggcgaaaccactaagcacgcagtgagccggggtacagctaaattgagatggttcgttgagcgtaacctggtgaagccagaaggcaaagtcatcgatctcgggtgtggaaggggcgggtggtcttactattgcgccggattaaagaaagtgaccgaggtcaagggctacactaaaggtgggcctggacatgaggaacccataccgatggcaacatatggctggaatctggtgaaacttcactccggcaaggacgtatttttcatcccacctgagaaatgtgataccctgctatgcgacattggggaatcaagccccaacccaacgatcgaggaaggacggaccctccgcgtactgaagatggtggagccctggttgcgaggtaatcagttttgtattaaaatcctgaacccttacatgccgtcggtcgtggagacactcgaacagatgcaaagaaagcatggcgggatgcttgttaggaatcccctgtctcggaacagtactcacgagatgtactgggtgtcctgcggaaccggcaatattgtcagcgctgtgaacatgacatcacgcatgttactgaacagattcactatggcccacaggaaaccaacctatgaacgagatgtagacttgggtgccgggacacggcatgtggcggttgagcctgaggtcgctaatctcgatatcataggacagcgtattgaaaacatcaagaatgagcacaagtccacctggcattacgacgaagataacccctataaaacttgggcataccacggctcttatgaggtgaagcctagcggcagtgcctccagcatggtgaatggggtcgttagactgctaacgaaaccatgggacgtgatccccatggtaacacagattgctatgaccgacactaccccttttggacaacagcgcgtgttcaaggaaaaagtcgatacaaggacgccaaaggccaagcggggtaccgcacagataatggaggtgactgccaaatggctttggggctttctgtctagaaacaagaaaccccgcatctgtacaagggaggagttcacccgaaaggttcggtcaaatgctgcgattggggccgtgtttgtcgacgagaaccagtggaatagtgcaaaagaagctgtggaggatgaaagattctgggacctcgtaaggcgcgagcgtgagctgcataagcaaggaaagtgcgccacttgcgtttacaacatgatgggcaaacgggaaaagaaattgggtgagtttgggaaggcaaaaggatccagagccatctggtatatgtggctgggcgctaggttcctcgaatttgaggcccttggcttcatgaatgaagatcactggttcagccgcgagaactctctgtcgggggtggagggagaaggtttacacaagctgggctacattttgcgagacatctcaaaaataccagggggaaatatgtacgcggatgacacagcaggctgggatacccggatcacagaggaagacctccagaacgaggccaagattactgatatcatggagcctgaacatgctctgctagccaccagcatttttaaacttacgtatcagaataaagtcgtgagagtgcagaggccagcaaagaacggtaccgtcatggacgttatctcccgcagagatcaacgggggagtggacaggtgggcacatacggcctgaacactttcaccaatatggaggctcagctcataaggcagatggaatctgaggggatttttagcccctccgaactggagacacctaacttggccggacgtgtattagactggctggagaaacacggtatcgaacgactccgcagaatggctatctcaggcgacgattgtgtggtcaagccaattgacgatcggttcgccactgcacttaccgcgctgaatgacatggggaaagtgaggaaggatataccccaatgggagccgagtaagggatggaacgactggcagcaggttcctttttgctctcatcacttccaccagctaatcatgaaagatggccgcgaaattgtggtcccctgtagaaatcaagacgagctggtgggtcgggccagggtaagccagggggctggatggtccctccgagaaacggcctgcttgggcaagtcatatgcacagatgtggcaactgatgtactttcatcgtagagatcttcgcctggctgccaacgcaatctgtagcgccgttccagtggactgggtccctacatctcggaccacttggtccattcacgcgcatcaccagtggatgacaaccgaggatatgctcagtgtgtggaatagggtttggatcgaggaaaacccctggatggaggacaaaactcatgtgagctcgtgggaagacgtcccatatttaggcaagagagaggatcagtggtgcgggtccctgataggattgaccgctcgcgccacatgggcaacgaatatccaggtggccattaaccaagtacggaggctgatcggtaatgaaaactacctcgactatatgacctctatgaaacgattcaagaatgagtcagatcccgagggcgctctttggtga

SEQ ID NO: 14175 - RNA, 9879 nt, synthetic construct
  misc_feature 1..9879: note = derived and/or modified CDS sequence (opt3) from DENV-1__JQ915080__SS-prME
  source 1..9879: mol_type = other RNA
tccgtgaccatgctgctcatgcttctgcccaccgtcttgactttccacttaacgaccagaggcggggagcctcatatgatcgtttccaagcaggaaaggggaaagtctctgttgtttaagacatcagctggtgtgaatatgtgcactctcattgcaatggacctgggcgagctttgtgatgacaccatgacatacaagtgcccacggataaccgaaactgagccggatgacgtagattgttggtgcaatgcaacagaaacctgggtgacgtatgggacttgtagtcaaaccggagagcaccgccgagacaagcgtagcgtcgccctggcgccccatgtgggcttgggtctcgagacaagaactgaaacctggatgtcctctgagggggcttggaggcagatccagaaagttgaaacatgggccctgcggcaccctggattcaccgtgattgcactgtttctcgcccatgctatcggcacgtcgattactcagaagggcatcatattcatcttactgatgcttgtcacaccatcaatggcaatgcgctgcgtggggattggaaacagagattttgttgagggtttgagcggcgccacctgggttgacgtggtcctggagcacgggagttgtgtgactacaatggctaaggataaacccaccctagacatcgaactcctgaagacggaggtgaccaatcctgccgtccttaggaaactgtgcattgaagcgaagatctccaacacaactaccgattctcggtgtccaacacaaggagaggcaactttggttgaagaacaggacaccaatttcgtgtgccgccgaacatttgtagatagaggctggggtaacgggtgtggactcttcggcaaaggcagcctgataacctgcgccaagtttaagtgcgtgactaaattagaggggaagattgtccagtacgaaaatctgaaatattccgtgatcgttacggtgcacacaggagaccagcatcaagtcggtaacgagaccactgaacacggcaccattgctacaatcacaccccaggcccctacttcagagatccagctcacagactacggggcacttacgctggattgtagtccaaggaccggattggacttcaatgaaatggtgctactgactatgaaggagaaaagctggctcgtacataagcagtggtttctggatcttccgctgccctggacaaccggcgcttctacatcccaagagacttggaaccggcaggacttgctcgttaccttcaaaacggcccacgcgaagaagcaggaagtggtcgtgctgggttcacaagagggggccatgcacaccgcattaacaggcgctactgaaattcagaccagcggaacaactaccatatttgccggccatctgaaatgccgtctaaagatggataaactcacgctgaaggggatcagttatgtcatgtgtacaggatctttcaaacttgagaaggaagtggctgagacccagcacggtactgttttggtgcaggtaaagtacgagggcacagacgccccttgcaaaattccattctccagccaagatgaaaagggggtcacccagaatggacgcctggtgactgcaaaccccatcgttaccgacaaagagagacctgtgaatatagaagccgagccaccctttggcgagtcgtatattgtcgtgggtgctggggaaaaggcgctcaaactgtcttggttcaagaagggctcctcaatcggaaaaatgtttgaggcaacagccaggggcgctcggcgaatggccatccttggggatacggcatgggacttcggaagtattggtggcgtatttaccagcgtggggaagctggttcatcagatcttcggaactgcctacggcgtcttgttttccggtgtgtcttggacaatgaaaattgggataggcatcctcctgacctggttaggactgaacagccgctcaacaagtctatccatgacttgtattgctgtgggcatggtcaccctctacctgggggttatggtgcaggccgatagcggatgcgtgatcaattggaagggcagagaacttaaatgtggttctgggatcttcgtaacgaacgaggtccacacatggaccgaacaatataagtttcaggcagactcaccgaagaggttgagtgcggctattggaaaagcctgggaggagggcgtgtgcggtatacggagcgcaactcgcctggaaaacatcatgtggaagcagatttccaatgagctcaaccatatcctgttagaaaatgacatgaaattcaccgttgtggtcggcgatgtgtctgggattctggcccagggaaagaaaacaatcagacctcaacccatggagcacaagtactcgtggaaaagctggggcaaggctaagataatcggggccgacgttcagaacactacctttattatcgatggaccaaatacacctgaatgtcccgacgatcagagggcatggaacatttgggaggtggaggactatggcttcggtatctttacgaccaatatatggcttaaattgcgtgattcctacactcaggtatgcgaccaccggctcatgtcagctgccattaaggatagtaaagcggtccatgccgacatggggtattggatcgaatctgagaagaacgaaacatggaaactggctcgagccagcttcattgaggtgaagacctgtgtgtggccaaagtcccacactctatggtcaaatggagtcctggaaagcgagatggttatccccaaaatatacggcggtcctatctctcaacataactatagaccaggctacttcacacagaccgcagggccgtggcacctcggaaagctggagcttgattttgacttgtgcgaaggcacgactgtggtagtggatgagcactgcgggaataggggaccctccctgcgcaccacaaccgtcactggcaaaattatccatgaatggtgttgccggagttgtacattacctccactcagattcaagggtgaggacgggtgctggtacggaatggagattaggcccgtgaaagaaaaggaggaaaacctggttaagagcatggtgtctgctggctccggtgaggtcgactcatttagtcttggcctgttgtgtatcagcataatgattgaagaggtgatgcgctcgcgatggtcccggaaaatgctcatgaccgggacactggttgtgttcctactgctcactctgggacagcttacctggaatgatttgatccgtctgtgcatcatggtcggcgccaacgcatctgacaatatggggatgggaacgacatatttagcgctcatggccacctttagaatgaggcctatgttcgctgtaggcctgctttttcgccggctgactagcagagaggtgctactcctgaccgttggtttgtcactggtggccagtgtcgaattaccaaactccctcgatgagctgggggacggacttgcaatgggcattatgatcctgaagttgctcacagatttccaatctcaccagctgtgggctactctactgagccttacctttgtgaaaacgacactctccctgcattacgcctggaagaccatggcaatgattttgtcaatagtaagcctgttacccctctgtctgagtactacatctcagaaaaccacttggcttccggtgctgttgggctccctcgggtgcaagcctctgacaatgttcctaatcaccgaaaacaagatttggggaaggaaaagctggccactgaatgagggtatcatggccgtcggcattgtttcgatccttctctcatctctgttgaagaacgacgtgcccttagctgggcctctgatagcgggaggcatgctcatcgcctgttatgtgattagtggttccagcgcagatctgtctcttgaaaaagctgccaaggtcagctgggaggaggaagccgagcactccggggcttcacataatatcctggtggaaattcaggacgatggaacgatgaaaatcaaggacgaggaacgagatgacactataaccattttgctaaaagcaacactgctcgccatcagtggcgtttaccccatgagcatcccagcgaccctgtttgtatggcacttctggcaaaagaagaaacagcgctctggcgtgctttgggatacaccttcacccccggaggtcgagaaggctgtgttagacgacgggatttatcggatactgcagagaggactcttgggtaggagccaggttggcgtgggggtctttcaagaaggagtgttccacactatgtggcatgtaacccgtggcgccgtcctgatgtaccagggtaaacgcctcgagccgagttgggcaagcgtgaagaaagatctgatctcctatgggggaggctggcggttccagggctcttggaacatgggggaagaggttcaggtgattgccgtcgagcctggaaagaatcccaagaacgtgcaaacggctccaggtacatttaaaacttcggaaggcgaggttggggcaatcgcccttgacttcaagcccggaaccagcggctcacctattgtgaatagagaaggtaaaatcgtcgggctgtacggaaacggcgtggtaacaacctccggcacttacgtgagtgcgatagctcaggccaaggcatctcaggaggggccattgcccgaaatcgaggatgaggtttttaggaaacgaaatctaaccattatggacctgcaccctggaagcggtaagacacggcgctatctcccggccatcgtcagagaagctattaagaggaaattacggacgctggtgcttgccccaactcgagtggtcgcatccgagatggctgaagccctgaagggcatgcccatcagataccaaaccacagcggtaaaatcagagcataccgggaaggaaatagtggatctcatgtgccacgccactttcacaatgcgcttgctgtctcctgttagggtgccaaactataatatgattatcatggacgaggcacattttaccgatcccgctagcatcgccgctcgtggatacattagtacgcgggtcggcatgggtgaggcagccgccatcttcatgactgctacacctccggggtccgtggaagcgtttccccagagcaacgcagttatacaggacgaggaaaaagatattccagagagatcttggaactcaggatatgactggatcaccgatttccctggcaagaccgtgtggtttgtcccctccattaagagtggcaacgacatcgccaattgtctcaggaaaaacgggaagcgcgtgatacagctgagccgaaaaactttcgacacagaataccaaaagaccaaaaacaatgattgggactatgtagtgacaactgatatttcggagatgggagctaactttagagccgaccgggttatcgatccaaggcgctgccttaagcctgtcatcctaaaggacggtcccgagcgtgtgattctggcaggcccaatgccggtgacggtcgcctctgctgcgcagagacgggggaggatcggacgcaatcagaacaaagaaggcgatcagtacatttacatgggtcaacctttgaataacgacgaggatcacgcccactggaccgaagcaaagatgttactggacaatataaacacacccgaggggatcattccagctctcttcgagcccgaacgagagaaatccgccgcaatcgatggcgaatatagactgcggggagaggccaggaagactttcgttgaacttatgcgcagaggcgacctgcctgtgtggctcagctacaaagtagcttcagaggggtttcagtatagtgataggcggtggtgcttcgacggagagcgtaataaccaggtgttggaagagaatatggacgtcgaaatctggaccaaggagggtgaacgcaaaaagctgcgaccaagatggctagatgccaggacatactctgaccccctggcgctccgggagtttaaggagttcgcagccggccgcagatccgtgagcggggatcttattctggaaataggaaaattacctcagcatttgacccaaagggctcagaacgccctggacaatctcgttatgctgcacaactcagagcagggcggtaaggcttatcggcatgcaatggaggaacttccggatactatcgaaacgattatgctgctcgccttgatcgctgtgctgaccgggggcgtcacattatttttcctaagtggacgaggcctggggaaaactagcattggactcctttgtgtaacctcctctagcgccctgttgtggatggcatccgtggagccacactggatcgcggcctcaataatcctggagtttttcctcatggttctgcttattcccgaacctgacagacagcgcacaccccaagataatcagctcgcttacgtggtcatcggtctgttgtttattatcctgaccgtggccgcaaacgagatgggcttactagaaactacaaagaaagacctggggataggacacacggctgccgagaaccatcaccatgcagccatgctcgatgtcgaccttcacccagcttctgcgtggaccctgtatgccgtggcaactacaattatcacccctatgatgaggcataccattgagaatacaactgctaacatcagtttgacggccatagccaatcaggcagctatcctgatgggcctcgataagggttggcccatttcgaagatggacatcggggttccactgcttgccttaggctgctacagccaagtgaaccctctgaccctcacagcggctgtattgatgctggtggcccactacgcaattatcggaccgggcctacaggccaaagctactcgggaagcacagaagcgtaccgccgcggggataatgaaaaatcccacagtcgatggaattgttgctatcgacctggacccagtggtctatgatgccaagttcgagaaacagctcggccaaatcatgcttctgattttgtgtacctcccagatcctgctcatgagaactacgtgggcactgtgcgaatctataacattagccaccggtcctcttactaccctgtgggaggggtcacccggaaagttttggaacacaactattgctgtgagcatggccaatatcttcaggggctcctacctcgccggtgctggcctagcctttagtctgatgaagtctctagggggaggccgccgggggaccggagcgcagggcgaaacactgggtgagaaatggaagcgacagctcaaccaacttagcaaatcacagttcaatacgtataagagatccgggattatcgaggtagacaggagtgaagccaaagagggactgaagcgcggcgaaaccactaagcacgcagtgagccggggtacagctaaattgagatggttcgttgagcgtaacctggtgaagccagaaggcaaagtcatagatctcgggtgtggaaggggcgggtggtcttactattgcgccggattaaagaaagtgaccgaggtcaagggctacactaaaggtgggcctggacatgaggaacccatcccgatggcaacatatggctggaatctggtgaaacttcactccggcaaggacgtatttttcattccacctgagaaatgtgataccctgctatgcgacatcggggaatcaagccccaacccaacgattgaggaaggacggaccctccgcgtactgaagatggtggagccctggttgcgaggtaatcagttttgtatcaaaattctgaacccttacatgccgtcggtcgtggagacactcgaacagatgcaaagaaagcatggcgggatgcttgttaggaatcccctgtctcggaacagtactcacgagatgtactgggtgtcctgcggaaccggcaatatcgtcagcgctgtgaacatgacatcacgcatgttactgaacagattcactatggcccacaggaaaccaacctatgaacgagatgtagacttgggtgccgggacacggcatgtggcggttgagcctgaggtcgctaatctcgatataattggacagcgtatcgaaaacatcaagaatgagcacaagtccacctggcattacgacgaagataacccctataaaacttgggcataccacggctcttatgaggtgaagcctagcggcagtgcctccagcatggtgaatggggtcgttagactgctaacgaaaccatgggacgtgattcccatggtaacacagatagctatgaccgacactaccccttttggacaacagcgcgtgttcaaggaaaaagtcgatacaaggacgccaaaggccaagcggggtaccgcacagatcatggaggtgactgccaaatggctttggggctttctgtctagaaacaagaaaccccgcatttgtacaagggaggagttcacccgaaaggttcggtcaaatgctgcgatcggggccgtgtttgtcgacgagaaccagtggaatagtgcaaaagaagctgtggaggatgaaagattctgggacctcgtaaggcgcgagcgtgagctgcataagcaaggaaagtgcgccacttgcgtttacaacatgatgggcaaacgggaaaagaaattgggtgagtttgggaaggcaaaaggatccagagccatttggtatatgtggctgggcgctaggttcctcgaatttgaggcccttggcttcatgaatgaagatcactggttcagccgcgagaactctctgtcgggggtggagggagaaggtttacacaagctgggctacatcttgcgagacatatcaaaaatcccagggggaaatatgtacgcggatgacacagcaggctgggatacccggattacagaggaagacctccagaacgaggccaagatcactgatattatggagcctgaacatgctctgctagccaccagcatctttaaacttacgtatcagaataaagtcgtgagagtgcagaggccagcaaagaacggtaccgtcatggacgttatatcccgcagagatcaacgggggagtggacaggtgggcacatacggcctgaacactttcaccaatatggaggctcagctcattaggcagatggaatctgaggggatctttagcccctccgaactggagacacctaacttggccggacgtgtattagactggctggagaaacacggtatcgaacgactccgcagaatggctatttcaggcgacgattgtgtggtcaagccaatagacgatcggttcgccactgcacttaccgcgctgaatgacatggggaaagtgaggaaggatatcccccaatgggagccgagtaagggatggaacgactggcagcaggttcctttttgctctcatcacttccaccagctaattatgaaagatggccgcgaaatcgtggtcccctgtagaaatcaagacgagctggtgggtcgggccagggtaagccagggggctggatggtccctccgagaaacggcctgcttgggcaagtcatatgcacagatgtggcaactgatgtactttcatcgtagagatcttcgcctggctgccaacgcaatttgtagcgccgttccagtggactgggtccctacatctcggaccacttggtccatccacgcgcatcaccagtggatgacaaccgaggatatgctcagtgtgtggaatagggtttggatagaggaaaacccctggatggaggacaaaactcatgtgagctcgtgggaagacgtcccatatttaggcaagagagaggatcagtggtgcgggtccctgatcggattgaccgctcgcgccacatgggcaacgaatattcaggtggccatcaaccaagtacggaggctgattggtaatgaaaactacctcgactatatgacctctatgaaacgattcaagaatgagtcagatcccgagggcgctctttggtga

SEQ ID NO: 14176 - RNA, 9879 nt, synthetic construct
  misc_feature 1..9879: note = derived and/or modified CDS sequence (opt3) from DENV-1__KJ755855__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagagccgaaacctggatgtcctctgagggggcttggaaacagatccagagggtggaaacatgggcactccggcaccctggattcactgttattgccctgtttctggctcatgccatcggcacctcgattacacagaagggcatcatattcatcctcttaatgctggtgaccccatcaatggcgatgcgctgcgtcgggattggaagcagagattttgtggagggtcttagtggcgcaacgtgggtagacgttgagttggaacacgggtcctgtgtgactacaatggccaaggataaacccaccctggacatcgagctactcaagactgaagtcacaaaccctgctgtgctgaggaaactttgcattgaggccaagatctctaataccacgaccgatagccggtgtccaacacaaggagaagcaactctggtggaggagcaggacgctaacttcgtctgccgccgaacctttgttgatagaggctggggtaatgggtgtgaattgttcggaaaaggctccctcctgacatgcgccaagtttaagtgcgtgactaaattagagggcaagatagtacagtacgaaaacctgaaatattcagtgattgtcaccgtgcacatcgcggcccagcatcaagttgggaatgagagtacagaacacggaaccactgcaattatcacgccccaggctcctacaaccgagatccagctcactgactacggtgcccttaccctggactgtagcccaaggacaggcttggatttcaacgagatggtgctactgaccatgaaggaaaaatcttggctcgtccataagcagtggtttctggaccttccgctgccctggacttccggggcttcaacaagccaagagacgtggaatcggttgttcctcctggtgacctttaaaactgcccacgcaaagaagcaggaagtagttgtgttaggaagtcaggagggcgccatgcacacagctctgaccggtgcgacagcactacaaactttcgggaccacgaccattttcgccggccatctcaacatacgtctgaaaatggataagcttacattgaaaggaatgtcttatgtcatgtgcactggctcctttaagctggaaaaagaggtggctgagacccagcacgggacaatcctcgtccagattaagtacgaaggaactgacgccccttgtaagatcccattcagcacccaggatgagaaaggtgtgacgcaaaatggccgcctgataacagcaaaccccattgttaccgacaaggaaaaacctgtgaatatcgaggccgagccaccctttggggaatcgtatatcgtaattggagctggcgagaaggcccttaaactgtcttggttcaagaagggttcctcaatcgggaaaatgtttgaagcaactgcgagaggcgctaggcggatggccattttgggagatacagcatgggacttcggcagtatagggggagtctttaccagcgtgggtaagctcgttcatcagatcttcggcactgcctacggggtgctgttttccggagtctcttggaccatgaaaattggcatcggtgtgttactgacatggctagggctcaacagccgatcaacgagtctgtccatgacctgcatcgctgtaggccttgtgactttgtacctgggagttatggtccaggccgatagcggctgtgtgattaattggaaggggcgcgagctcaaatgcggatctggcatattcgtgacaaacgaagtccacacctggacagagcagtataagtttcaagcagactcaccgaagagactgagtgctgccatcggtaaagcgtgggaggaaggggtttgtggaattaggagcgccactcggttagagaacatcatgtggaagcagatttccaatgaactgaaccatatccttttggagaatgatctcaaattcaccgtggtggtaggcgacgtcgctggtatactggcacagggcaagaaaatgatccgccctcagcccatggaacacaagtactcttggaaaaactgggggaaggccaagattatcggagctgacgtgcaaaattcgacgtttattatcgatggcccaaacacacctgagtgcagcgacgatcagagagcctggaatatatgggaggttgaagactatgggttcggaattttcaccactaacatctggctaaaactgagggattcctacacccaggtgtgtgaccaccgtctcatgtcagcagcgattaaggatagtaaagccgtccatgctgacatgggctattggatcgagtctgaaaagaatgagacatggaaactggcccgggcaagctttatagaagtgaagacttgcacctggcccaagtcccacacactttggtcaaacggtgttttggagagcgagatgatcattccaaaaatctacgggggacccatttctcagcataattattcccctggctacttcacgcaaaccgctggtccatggcacctgggcaagttagaactcgattttgacctgtgtgaggggactacagtggtagtcgatgaacactgcggaaaccgaggcccgagtcttagaaccactacagtgaccgggaaaatcatacatgagtggtgctgtaggagctgcacgctgccccctttgcgcttccggggagaggacggctgttggtacggtatggaaattagaccagtgaaggagaaagaagagaatctcgtcaagtctatggtttccgccgggtcaggagaagtggtaagtctgagcctaggcctgctctgcatctcgatcatgattgaggaggtgatgaggtcccgctggtctcgaaagatgctgatgactggtacccttgcagtctttttccggaaaatccgtggccagttgacatggaacgatctgattagattatgtataatggtgggggccaatgctagcgacaggatgggaacccgcactacatatctcgcgctgatggccacctttaagatgcggcccatgttctcagttggccttctgtttagaaggctaacaagtcgagaagtgctcctgttgactatcgggctgtccttagtcgcatctgtggagctccctaacagcctggaagagcttggagttctgttggctatgggcattatgatcctcaccctgctaacggacttccagtcccaccaactgtgggccacacttctctcaatgacctttattaaaactaccttcagcctgcattacacatggaagactatggccatggtgttgagtatcgtctctctgtttccattatgcctctccaccacgagccagaaaacaacctggctgcccgtacttctgggttcgttggggtgtaagccgctcactatgttcctgatagctgaaaacaagatctggggacgcaaatcatggcctctaaatgagggcattatggcagtgggcatcgtttctattctgcttagttccctcctgaagaacgatgtgccattggccgggcccttaatcgcgggaggtatgctgatagcttgctatgtcattagcggctctagcgccgacctctccctggagaaagcagccgaagtgtcatgggaggaagaggctgaacacagtggggcaagccataatatccttgtagaggtgcaggatgacggaacaatgaagatcaaagatgaggaacgggacgataccctgactattttgctaaaggccacactgctcgcggtctctggcgtttaccctctgtccatacccgctacccttttcgtgtggtatttttggcagaaaaagaagcaaagatcaggtgtgttatgggacacgccaagtcctcccaaagtcgagaaggccgtgctggatgacgggatctacaggattatgcagcgtggactcttgggccgcagccaggttggcgtaggggtgttccaggaaaacgtctttcacactatgtggcacgtgacccggggagcagttctgatgtatcaaggtaaaagactcgagccatcctggggcagggtgaagaaagatctgatctcttacgggggaggctggggtcttaaggggtcgtggaatacaggagaggaagtccaggtgattgccgtagagccgggcaagaaccctaaaaatgtccagaccgctcccggcacattcaagactccagaaggggaggtgggagccatcgcactggactttaaacccggtaccagcggctcacctatagttaaccgagaagggaagatcgtgggattgtacggcaatggtgtcgtgacgacatccgggacttatgttagtgctattgcccatgcgaaagcctctcaggagggaccactacccgagaccgaagtggaggcattccggaagcgcaacctgacaatcatggatctccaccctggcagcggcaagaccagaaggtacttaccggctattgtccgggaagccatcaaacgaaagatgagaactctgatacttgctccaacccgcgtggtagcatccgagatggccgaagccctgaaagggatgcccattaggtatcaaacaacggctgtgaagtcagagcatactggaaaagagatcgttgacctcatgtgtcacgcgacctttacaatgcgtttgctgtctcctgtccgggtgccaaattacaacatgatcattatggacgaagcacatttcaccgatcccagcagtctcgccgctagaggttatatctccactagggtgggcatgggggaggccgcagccatatttatgacagctacccctccgggaagcgtcgaagcgttcccccagtctaatgccgtaattcaggacgaggaacgcgatatcccagagcgatcatggaactccggctacgagtggattacggactttcctggtaagactgtgtggttcgttcccagtatcaaggcagggaatgatatagctaactgcctgagaaaaaacggaaagcgggtgattcaacttagcaggaaaacattcgacaccgaatatcagaagaccaaaaataacgattgggactacgtcgtgactacagatatctcggagatgggcgccaattttccagcagaccgcgttatcgatcctcgtagatgtctaaaccccgtgattctgaaggacggcccagaacgggtcatcttggccgggccgatgcctgtgaccgtagcttctgccaatcagaggcgcggacgaattggtagaaaccacaataaggagggcgaccagtacatatatatggggcaacccttaaacaatgatgaggaccacgcgcattggacagaagcaaaaatgctgctcgataacatcaatactccagagggaattatccccgccctgttcgaacctgagcgggaaaagtccgctgccatcgacggcgagtacaggcttcgcggtgaggctagaaaaacgtttgtggaactgatgaggcggggggatctcccagtttggttgagctataaggtcgcatcagagggcttccagtacagtgaccgtcgctggtgctttgatggagaacgaaacaatcaggtgctggaggaaaacatggacgtggagatttggaccaaagagggcgaaagaaagaaactaaggccccggtggctggatgcccgcacatattctgaccctctcgctcttagagagaagaaggaattcgccgcagggaggcggtccgtcagcggagatctgatattagagatcggtaaattgccgcagcacctgactcaacgagcgcagaatgccctcgacaacctggttatgcttcataactcagaacagggcgggagagcttaccgccacgccatggaggagctgccagataccattgaaacactcatgttgctggcattaatcgctgtgctaaccggaggcgtaactctgtttttcctcagtggtaaggggcttggcaaagccggaaatggcctgttgtgcgtgatggcaagctccgccctgctctggatggctaacgtcgagccccactggattgcggcctctatcatactggaatttttccttatggtgctcctgatccctgagcccgacaggcagcggacgccacaagacaatcagttggcatatgttgtgattcgtctgttatttatgatcctaaccgtcgctgccaacgagatggggctgctcgaaacaactaagaaagatcttggaattggtcatgccgcagtagagaatcaccatcacgctgccatgctggacatcgatttgcatcctgcgagcgcttggaccctgtacgccgtggcaacaaccataattactcccatgatgagacacacaatcgaaaacacgaccgccaatatttccctcactgctatcgcaaaccaggccgcgatactgatgggccttgacaaggggtggccaatctcaaagatggatattggagttcctttactggctctcggcttcttgtctcaggtgaatccgctgacactaaccgccgcagtcctgatgctcgtggcccactacgctatcattggtcccgggcttcaagccaaagcaaccagggaggctcagaagcgcacagccgcgggcatcatgaaaaacccaactatagacggaattgtcgccatcgatctggaccctgtggtttatgatgcaaagtttgaaaaacagttgggccaaatcatgctgctcattctgtgtacgagtcagatcttacttatgcggaccacatgggctctgtgcgagtcgataactctcgccaccgggcccctaagcccactgtgggagggatcccctggcaagtcttggaatacaaccattgcagtgtcaatggctaacatcttccgaggtagctacttggccggggccggactggcgttctccctcatgaagagtcttggcggtggcagaagggggactggagctcagggcgaaacgctgggggagaaatggaagcgccagttgaatcaactgtctaaaacagaatttaacacctataagcggagcggaattatggaggtagacagatcagaagcaaaagagggcctcaagcgtggtgagactaccaagcatgccgtgtccagggggacagctaaattacggtggttcgtcgaacgcaatctggttaagcccgagggaaaagtgatcgatcttggctgtggtcgaggcgggtggagttactattgcgccggactgaagaaagtcagcgaagtgagaggctacactaaggggggaccgggccacgaggaaccaatacctatggcaacctatggttgggacctactcaaaaggtgttctgggaaggagtttttctttatccccccagagaagtgcgattccttcctgggagacattggcgaatcaagccccaaccctacaatcgaggaaggccggacggtacgcgtgttgaaaatggttgagccgtggctgagagggaatcagttttgtattaagatcctcaacccctacatgccatcggtggtcgagacccttgaacagatgcagaggaaacatggaggtatgctggtgcgaaaccctttatctcggaatagtactcacgagatgtactgggtctcctgcggcacagggaacattgtgagcgccgttaatatgacctcacgtatgctgttgaacagattcactatggctcaccgcaagcccacatatgaaagggacgtagatctcggagcgggcacccggcatgtggccgtcgagcctgaagtggcaaatctggacatcataggtcaaagaattgagaacatcaaacacgagcataagtccacgtggcactacgatgaagacaatccatataagacctgggcttaccatgggtcttatgaggttaaacccagcggaagtgcctccagcatggtgaacggcgtcgtgaagctacttacaaaaccttgggatgtaatcccaatggtgactcagattgcaatgaccgacacaactccctttggccagcagcgcgttttcaaggaaaaagtcgataccaggacaccgaaggccaagcgagggaccgctcaaataatggaggtgactgcccggtggctgtggtcttttctctcaagaaataaaaagcctaggatctgtacgcgcgaagagttcacacgtaaagtgcggagtaacgcggcaattggagccgtctttgttgacgagaatcagtggaactccgctaaggaagccgtggaggatgacagattctgggatctggtacacagggaacgcgagttgcacaaacagggtaagtgcgcaacctgtgtgtacaatatgatgggcaagcgagaaaaaaagctgggggagttcggaaaagctaagggcagccgggccatctggtatatgtggctcggtgctagatttcttgagttcgaagccctggggtttatgaacgaggaccattggttctctagggaaaattcgttatcaggagtcgagggcgagggcctgcacaaattggggtacattctccgcgacatcagcaagataccaggaggtaacatgtacgcagatgacactgcgggctgggataccagaatcacagaagacgatctgcaaaacgaggccaaaattacggacatcatggaacccgagcatgctctacttgccaagtccatttttaagctgacctatcagaataaagtggttcgggtgcagaggcctgcaaagaacgggactgtcatggatgtgatcagtcgtcgagaccagcgcggatctggccaagtaggtacatacgggctcaataccttcactaacatggaagctcagctgataagacagatggagagcgaggaaattttttccccaaatgagttggaaacacccaacttagccgagcgggttctggattggctcgaaaaatatggagtggagaggcttaagcgcatggcaatctcaggcgacgattgcgtcgtgaaaccgatcgacgatagattcgccaccgcgctgacagctctaaatgacatgggcaaggtgcggaaggacattcctcagtgggagcccagtaaagggtggaacgattggcaacaggtcccattttgctctcaccacttccatcagctggttatgaaggacggaagggaaatagtggtaccttgtcgaaatcaggatgagctcgtgggtcgtgccagagtcagccaaggcgcagggtggtccttgcgcgaaactgcctgcctgggaaaatcatacgctcagatgtggcagcttatgtattttcaccggagggacctgagactcgccgcaaacgctatctgtagcgccgtgcccgttgattgggtgccaacctctcgcacgacctggtccattcatgcgcaccatcagtggatgacaactgaggacatgttaagtgtctggaatcgggtgtggatcgaagagaacccctggatggaggataagaccagggtaagctcgtgggaagacgttccttacctgggcaaacgagaggatcaatggtgcggttccttgattgggctgacagctagagccacttgggcaaccaatatccaggtggccataaaccaggtccggaggctcatcggaaatgaaaactattctgactacatgacgtcaatgaagcgcttcaagaacgagagcgagccagaaggcgctctttggtga

SEQ ID NO: 14177 - RNA, 9879 nt, synthetic construct
  misc_feature 1..9879: note = derived and/or modified CDS sequence (opt3) from DENV-1__KF289073__SS-prME
  source 1..9879: mol_type = other RNA
agcgtgaccatgctgttcatgctccttcccactgcactggcttttcacttgactacgagaggaggggagcctcatatgatcgtctccaagcaggaaagaggaaaatctttactgttcaagacctcagccggtgttaacatgtgcacattgattgccatggacctcggcgagctgtgtgaagatactatgacctacaaatgcccacggataacagaggcggaaccggacgatgtggactgttggtgcaatgctaccgatacttgggtgacatatgggacctgtagtcaaacgggagagcaccgccgagacaagcgtagcgtggcccttgcaccccatgtcggcctgggtttggagactagaaccgaaacatggatgtcctctgagggggcctggaaacagatccagaaggtggaaacttgggctctcaggcaccctggatttaccgttattgcactgttcctggcccatgctatcggcacatcgattacccagaagggcatcatatttatcctcttaatgctggtgacgccatcaatggccatgcggtgcgtcgggattggaaaccgcgatttcgtggagggtcttagcggcgcgacttgggtagacgttgtgttggagcacgggagttgtgtcacaaccatggccaagaataagcccactctggatatcgaactactcaaaacagaggtgaccaaccctgccgtgctgagaaaactttgcattgaagctaaaatctccaagacgaccacagactctaggtgtccaactcaaggagaggccaccctggtcgaggaacaggatgcaaattttgtttgccggcgcacattcgtggaccgaggctggggtaacgggtgtggattgtttggcaagggcagcctcctgacttgcgctaaattcaagtgcgtaaccaaattagaggggaagatagtgcagtacgaaaatctgaaatattccgtcattgtgacagttcacaccggagatcagcatcaagtgggtaacgagactacggaacacggcacaatcgccaccattactccccaggcgcctacctcagagatccagctcacagactacggggcccttaccctggactgtagtccaagaactggattggattttaatgaaatggtcctactgacaatgaaggagaaaagctggctcgtgcataagcagtggttcctggaccttccgctgccctggacgtctggcgcatccacctcacaagagacttggaacaggcaggatttgctcgtaacatttaagaccgctcacgccaaaaagcaggaagttgtggtcctgggtagccaagagggggctatgcacacagccttaactggcgcaaccgaaatccagacgagtggaaccacaactattttcgccggccatctgaaatgccggctaaagatggacaaactcaccctgaaggggatgtcttatgtgatgtgtacaggatccttcaaacttgagaaagaagtcgctgagactcagcacggtaccgtgttggttcaggtgaagtacgagggcacggatgcgccttgcaaaataccaatcagcacacaagacgaaaagggggtaacccagaatggacgtctgattactgcaaaccccatcgtcacagataaagagaagcctgtgaatatagaaaccgagccaccctttggcgagtcgtatattgttatcggtgccggggaaaaggctctcaaactgtcttggttcaagaaaggctcctcaatcggaaagatgtttgaggccactgcacgcggcgccagaaggatggctattcttggggacaccgcctgggatttcggaagtatcggtggcgtgtttacaagcgtcgggaaactggtgcatcaggtattcggaacggcatacggcgtgttgttttccggtgtttcttggaccatgaagattgggataggcgtcctcctgacttggttaggactgaacagccggtcaacaagtctatccatgacctgtatcgcggtgggcatggtgacactctacctgggggtcatggttcaggctgacagcggatgcgtgattaattggaagggccgagaacttaaatgtggttctgggatcttcgtgactaacgaggtacacacctggacggaacaatataagtttcaggccgattcaccgaaacgcttgagtgcagccatcggaaaggcttgggaggagggcgtctgcggtattagaagcgccacaaggctggaaaacataatgtggaaacagatctccaatgagctcaaccatattctgttagaaaatgacatgaagttcaccgtggttgtgggcgacgcaaacgggatcctggctcagggcaagaaaatgattcggcctcaacccatggagcacaagtactcttggaaatcgtggggcaaggccaaaatcataggggcggatatccagaatactacctttattatcgacggaccagatacacctgaatgtcccgacgatcaccgcgcctggaacatttgggaggtcgaggactatggcttcggtatctttactaccaatatatggcttaagttgagagatagctacacacagatgtgcgaccataggctcatgtccgctgcaattaaagattcaaaggccgtgcacgctgacatggggtattggatcgaaagtgagaagaacgaaacgtggaaactggcccgtgcatctttcattgaggttaagacctgtatctggccaaaaagccatactctatggtccaatggagtgctggaatcagagatgataatccccaagatttacggcggtcctatcagccagcacaactatcggccaggctacttcacacaaaccgcggggccgtggcacctcggaaaactggagcttgattttgacttgtgcgaaggcactacagtagtcgtggatgagcattgcgggaatcgaggaccctctctgagaaccacgactgtgaccggcaagattatccacgaatggtgttgcaggtcctgtacattacctccactccgcttcaagggtgaggacgggtgctggtacggaatggagatacggcccgtcaaagaaaaggaggaaaacctggttagaagtatggtgagcgccggctctggtgaggtagactccttttcacttggcctgttgtgtgtgagtattatgatcgaagaggtcatgaggagccgctggtcgcgaaaaatgctcatgaccgggactctggctgtgttcctactgctcatcatgggacagctgacatggaatgatcttattcggttgtgcatcatggttggcgccaacgcatccgaccgtatggggatgggaaccacatatctggctttaatggccacttttaagatgagacctatgttcgcagtgggcctcctgtttaggcgccttacctctcgggaggtcctgctactcacgattggtctgagcttggtggcctcagttgaactgccaaatagtttagaggaactcggggatggactggctatgggcataatgatgcttaaactgttgacagacttccagtcccatcaactctggaccactctgctatctctgacctttatcaagacaactcttagcctcgattacgcgtggaagaccatggccatggtgctgtccattgtctcattgttccccctgtgtttaagcacgacaagtcagaaaaccacttggctcccggtactgcttggctcttttgggtgcaagcctctgacaatgttcttgatcaccgagaacaaaatttggggaagaaagtcctggccactcaacgaaggtatcatggcagtgggcatagttagcatcctgctatcgtcactgcttaaaaatgacgtgcccctcgctgggcctctgattgccggaggcatgttgatcgcctgttatgtcatttctggtagttccgctgatttaagcctggagaaggcagccgaggtgtcttgggaagaggaagcggagcacagcggggcttcccataacatcctcgtagaagtgcaggacgatggaactatgaaaataaaggacgaggagagggatgacacactgaccattcttctgaaggccacgttgctagcagtctcaggcgtttaccccatgagtatcccagccactctgtttgtgtggtatttctggcagaaaaagaaacaacgaagcggcgtgctctgggataccccttctcccccagaagtcgagcgcgctgtgctggacgacgggatctaccggattcttcagagaggattactgggtaggtcccaggttggcgtaggggtgttccaggatggagtctttcacacaatgtggcacgtgacccgtggcgcagttctcatgtatcaaggtaagcgcttggaaccgtcatgggccagtgtgaaaaaggacctgataagctacgggggaggctggcggttccagggctcctggaatatgggggaggaggtccaggtgatcgcggtagaacctggaaagaaccccaaaaatgtccagacaactccaggtacctttaagacgcccgagggcgaagtgggggctattgccctcgatttcaaacctggaacatctggctcgccaatcgttaacagagagggtaagattgtggggctgtacggaaatggcgtcgtgactaccagcggcacatatgtttcagcaatcgcccaagctaaagcctcccaggaagggccccttcctgagatagaggacgaagtgtttaggaagcgaaacctgaccatcatggatttgcatccgggaagtggtaagactcggcgctacctaccagcaattgtcagagaggctatcaaaaggaagctgcggaccctcattttagcccccacacgagtggtagcgtctgaaatggccgaggcactgaaaggcatgcctatcagatatcagacgactgctgtaaagagcgaacacaccgggcgcgagatagttgaccttatgtgccatgccacattcaccatgaggctgctctccccagtccgtgtgcccaattacaacatgattatcatggatgaggctcactttactgaccctgcatcaatcgccgcccggggatatatttctacaagagtgggcatgggtgaagctgcggcaatcttcatgaccgccacgccgcccgggagcgtcgaggcttttccacaaagtaatgccgtaatacaggatgaagagagggacattcctgaacgctcctggaacagcggatacgattggatcactgacttccccggcaaaacagtgtggtttgttccatctattaagtcaggcaatgacatcgcaaactgtttgcgaaagaatgggaaaagagtgatacagctgtcccggaagaccttcgataccgagtatcagaaaactaagaacaacgactgggattacgtcgtgacaaccgacattagtgagatgggagccaatttcagggctgatcgcgttatcgaccctcgtagatgcctcaaacccgtgatcctgaaggatggtccagaacgggtcattcttgcgggcccgatgcctgtgacagtagccagcgcagctcaaaggcgcgggcgaatcggaagaaaccagaataaggagggcgaccagtacgtgtatatgggtcagcccctaaacaatgatgaagaccatgcccactggactgaggcaaaaatgctgttggataacattaatacgccagaggggataatccccgccttatttgaacctgagcggaagaaatcggctgccattgacggcgaatacaggctgcgcggagaggcgagaaagaccttcgttgaactcatgaggcggggcgatctgccagtctggctttcttataaagtggcatccgaggggtttcaatacagcgaccgtcgctggtgcttcgacggagagcgaaacaatcaggtgctggaagagaacatggatgtcgaaatctggacaaaggagggtgaaaggaagaagctcaggccccggtggttggacgcccgcacttattcagatcctctggctctaagagagtttaaggagttcgccgctggcaggcggagtgtttctggggacctgatcctcgaaattggaaaacttccgcagcacctgaccttacgagcacagaaggccttggataatctggtgatgctccataactccgagcaaggcggtaaggcttacagacacgccatggaggaactgccagacacaatagaaacccttatgctgctcgcattgatcgcggtactgactgggggcgtgacgttatttttcctaagcggaaagggcctggggaaaacctcaattggactcctttgtgtcatggccagtagcgctctgttgtggatggcctccgtggagccccattggatcgcagcttctattatcctggagtttttcctcatggttctgcttatacctgaacccgatcgccagaggacaccacaggacaatcagctcgcctatgtggtcatcggtctgttgtttatgattctgactgtagcagccaacgagatgggcttactagaaaccacaaagaaggatctggggatcggacacgtggctgcggagaatcaccatcacgccaccatgctcgacgttgatcttcggcctgcaagcgcttggactctgtacgccgtggccacaacgattatcacccccatgatgcgtcatactatagagaacacaaccgcaaacatttccttgaccgctatcgccaatcaagcggctattctgatgggcctcgacaaaggttggccaatctcaaagatggatataggggtccctctgcttgccttaggctgctactctcaggtgaacccgctgacactcactgcagccgtcttgatgctggtggctcactatgcaatcattggacccggcctacaggccaaagcgacgagagaagctcaaaagaggaccgccgcagggatcatgaaaaatccaacagttgacggaattgtggccatcgacctggatcctgtagtgtacgacgctaagttcgagaagcagctcggccagataatgcttctgattttgtgtaccagtcagatcctgctcatgcgcactacatgggccctgtgcgaatcgatcaccttagcaactggtccccttacgacactgtgggaggggagcccaggaaaattttggaacaccactattgctgtctccatggccaatatcttccggggctcttatctcgcgggtgccggcctagcattctcactgatgaaaagcctagggggaggccgaagagggaccggagctcaaggcgaaacactgggtgagaaatggaagaggcagctcaaccagctttccaaaagtgagtttaatacttacaagcgctctgggataatggaagttgatcggagcgaggccaaggaaggactgaaaagaggcgagaccacaaagcatgcagtgtcacgtggtacggctaaattgaggtggttcgtcgaacggaacctggtgaagcctgagggcaaagtaattgacctcgggtgtggacgcggcgggtggtcctattactgcgccggattaaagaaagtgaccgaggttaagggctatactaagggtgggcccggacacgaggaaccgatcccaatggccacatacggctggaatctggtgaaacttcacagtggcaaggatgtctttttcacccctcccgaaaaatgtgacactctgctatgcgatattggggagagctctccaaaccccacaatcgaagagggacgaaccctcagagtgctgaagatggtcgagccttggttgaggggtaatcagttttgtataaaaatcctgaacccgtacatgccctccgtggttgaaacgctcgagcaaatgcagcggaagcatggcgggatgcttgtacgcaatccactgtcaagaaacagcacccacgaaatgtattgggtgtcgtgcggaacaggcaatattgtctctgcggtgaacatgacaagtaggatgttactgaatcgattcaccatgacacatcggaagcctacttacgagcgtgacgttgatttgggtgctgggaccagacacgtggcagtcgagcccgaagtggccaacctcgacatcattggacagcgcatcgagaacattaaaaatgaacacaagtccacatggcattatgatgaggacaacccttacaaaacctgggcttatcacggcagctacgaagtaaagccatcaggctccgcctctagcatggtgaatggggttgtcaggctgctaactaaaccctgggacgtgatccctatggtgacgcagatagcaatgacagataccactccatttggacaacagcgggtcttcaaggagaaggttgacaccagaacaccccgcgccaaaaggggtacggctcagattatggaggtgaccgcgaagtggctttggggctttctgagtcgaaacaaaaagccgcggatctgtactagagaagagttcacaaggaaagtacgctccaatgccgcaatcggggctgtgtttgtcgatgaaaaccaatggaatagcgccaaggaggcagtggaagacgagcgtttctgggatctcgttcatcgggagagagaactgcacaagcagggaaaatgcgcaacctgcgtgtataacatgatgggcaagagggagaaaaagttgggtgaatttgggaaagctaagggatctcgcgccatttggtacatgtggctgggcgcgcgattcctcgagttcgaagcacttggctttatgaatgaggaccattggttctcacgggagaacagtctgtccggggtcgaaggagagggtttacacaaactgggctacatattgagagatatcagcaagattcctgggggaaatatgtatgccgacgatactacaggctgggacaccaggatcacagaagatgacctccagaacgaggctaagattactgatatcatggagccagaacacgccctgctagcaacctctatatttaaacttacgtaccagaataaggtggtacgcgttcaaagacccgctaaatcgggtaccgtgatggacgtcatctcacggagggaccagcgtgggagcggacaggtgggcacatatggcctgaacactttcaccaatatggaggtgcagctcattcgacaaatggaatccgaggggatctttctgcctagtgaattggagacaccaaacttagccgagcgcgtcctggattggctcgaaaagcatggagttgagagacttaaacggatggctatttctggtgacgattgtgtggtaaagcccactgacgataggttcgccaccgcactgacggcgctaaacgacatgggcaaggtgcgcaaagatatcccgcagtgggaacctagcaaggggtggaatgactggcagcaggtccccttttgctcccaccatttccaccaactgataatgaaagatggaagagagattgtggttccatgtcggaaccaggacgaactcatgggcagggcccgagtgtcacagggtgctgggtggagtttgcgtgagacagcctgcctgggaaagtcttacgcacagatgtggcaacttatgtattttcacagacgcgatctgcggctcgctgccaatgcaatctgtagcgccgtccctgtggactgggtacccacctccaggactacatggtcaatccatgcgcaccatcagtggatgaccactgaggacatgttaagcgtttggaacagagtgtggattgaagagaatccatggatggaagataaaacccacgtctcttcctgggaggacgtgccctacctgggcaagcgcgaagatcagtggtgcggcagtttgatagggctgacagctcgggccacgtgggcaaccaacatccaagttgccattaatcaggtgaggcgactcatcggaaacgagaattatcttgactacatgactagcatgaagagattcaaaaacgagtcggatcctgaaggtgctctgtggtga

SEQ ID NO: 14178 - RNA, 9879 nt, synthetic construct
  misc_feature 1..9879: note = derived and/or modified CDS sequence (opt3) from DENV-1__JQ915072__SS-prME
  source 1..9879: mol_type = other RNA
tccgtgaccatgctgctcatgcttctgcccacagtcttgactttccacttaacgaccaggggaggggagcctcatatgatcgtttccaagcaggaaaggggaaaatctctgttatttaagacatcagccggtgtgaacatgtgcactctcattgctatggacctgggcgagctttgtgatgacaccatgacatacaaatgcccacggataaccgaaactgagccggatgacgtagattgttggtgcaatgcaacagaaacctgggtgacgtatgggacttgtagtcaaaccggagagcaccgccgagacaagcgtagcgtcgccctggcgccccatgtgggcttgggtctcgagacaagaactgaaacctggatgtcctctgagggggcttggaggcagatccagaaagttgaaacatgggccctgcggcaccctggattcaccgtgattgcactgtttctcgcccatgctatcggcacgtcgattactcagaagggcatcatattcatcttactgatgcttgtcacaccatcaatggcaatgcgctgcgtggggattggaaacagagattttgtagagggtttgagcggcgccacctgggttgacgtggtcctggagcacgggagttgtgtgactacaatggctaaggataaacccaccttggacatcgaactcctgaagacggaggtgaccaatcctgccgtccttaggaaactgtgcattgaagcgaagatctccaacacaactaccgattctcggtgtccaacacaaggagaggcaactttggttgaggaacaagacaccaatttcgtgtgccgccgaacatttgtagatagaggctggggtaacgggtgtggactcttcggcaaaggcagcctgataacctgcgccaagtttaagtgcgtgactaaattagaggggaagattgtccagtacgaaaatctgaaatattccgtgatcgttacggtgcacacaggagaccagcatcaagtcggtaacgagaccactgaacacggcaccattgctacaatcacaccccaggcccctacttcagagatccagctcacagactacggggcacttacgctggattgtagtccaaggaccggattggacttcaatgaaatggtgctactgactatgaaggagaaaagctggctcgtacataagcagtggtttctggatcttccgctgccctggacaaccggcgcttctacatcccaagagacttggaaccggcaggacttgctcgttaccttcaaaacggcccacgcgaagaagcaggaagtggtcgtgctgggttcacaagagggggccatgcacaccgcattaacaggcgctactgaaattcagaccagcggaacaactaccatatttgccggccatctgaaatgccgtctaaagatggataaactcacgctgaaggggatcagttatgtcatgtgtacaggatctttcaaacttgagaaggaagtggctgagacccagcacggtactgttttggtgcaggtaaagtacgagggcacagacgccccttgcaaaattccattctccagccaagatgaaaagggggtcacccagaatggacgcctggtgactgcaaaccccatcgttaccgacaaagagaagcctgtgaatatagaagccgagccaccctttggcgagtcgtatattgtcgtgggtgctggggaaaaagcgctcaagctgtcttggttcaagaaaggctcctcaatcggaaagatgtttgaggcaacagccagaggcgctaggcggatggccatccttggggatacggcatgggacttcggaagtattggtggcgtatttaccagcgtggggaaactggttcatcagatcttcggaactgcctacggcgtcttgttttccggtgtgtcttggacaatgaagattgggataggcatcctcctgacctggttaggactgaacagccgatcaacaagtctatccatgacttgtattgctgtgggcatggtcaccctctacctgggggttatggtgcaggccgatagcggatgcgtgatcaattggaaaggccgcgaacttaagtgtggttctgggatcttcgtaacgaacgaggtccacacatggaccgaacaatataagtttcaggcagactcaccgaaaagattgagtgcggctattggaaaggcctgggaggagggcgtgtgcggtataaggagcgcaactcggctggaaaacatcatgtggaaacagatttccaatgagctcaaccatatcctgttagaaaatgacatgaagttcaccgttgtggtcggcgatgtgtctgggattctggcccagggcaagaaaacaatccgccctcaacccatggagcacaaatactcgtggaaaagctggggcaaggctaaaataatcggggccgacgttcagaacactacctttattatcgatggaccaaatacacctgaatgtcccgacgatcagagagcatggaacatttgggaggtggaggactatggcttcggtatctttacgaccaatatatggcttaagttgagggattcctacactcaggtatgcgaccaccgtctcatgtcagctgccattaaagatagtaaggcggtccatgccgacatggggtattggatcgaatctgagaaaaacgaaacatggaagctggctcgggccagcttcattgaggtgaagacctgtgtgtggccaaaatcccacactctatggtcaaatggagtcctggaaagcgagatgatcatacccaagatctacggcggtcctatttctcaacataactatcgaccaggctacttcacacagaccgcagggccgtggcacctcggaaaactggagcttgattttgacttgtgcgaaggcacgactgttgtggtagatgagcactgcgggcatagaggaccctccctgaggaccacaaccgtgactggcaagatcattcacgaatggtgttgccgcagttgtacattacctccactccggttcaaaggtgaggacgggtgctggtacggaatggagatcagacccgtcaaggaaaaggaggaaaatctggtgaaaagcatggtttctgctggctccggtgaggtggactcatttagtcttggcctgttgtgtataagcattatgatcgaagaggtcatgaggtcgcgctggtcccgaaagatgctcatgaccgggacactggtggttttcctactgctcactctgggacagcttacctggaacgatttgatccggctgtgcattatggtgggcgccaatgcatctgacaacatggggatgggaacgacatatttagcgctcatggccacctttcgtatgagacctatgttcgctgtcggcctgctttttaggcgcctgactagccgggaggtactactcctgaccgtgggtttgtcactggttgccagtgtggaattaccaaattccctcgatgagctgggggacggacttgcaatgggcatcatgattctgaaattgctcacagatttccaatctcatcagctgtgggctactctactgagccttacctttgtcaagacgacactctccctgcactacgcctggaaaaccatggcaatgatattgtcaatcgtgagcctgttacccctctgtctgagtactacatctcagaagaccacttggcttccggtactgttgggctccctcgggtgcaagcctctgacaatgttcctaattaccgaaaacaaaatctggggaagaaagagctggccactgaacgagggtattatggccgtgggcatcgtctcgatacttctctcatctctgttgaaaaatgacgttcccttagctgggcctctgatcgcgggaggcatgctcattgcctgttatgtgatcagtggttccagcgcagatctgtctcttgaaaaggctgccaaagtgagctgggaggaggaagccgagcattccggggcttcacacaacattctggtcgaaatccaggacgatggaacgatgaagataaaagacgaggaaagggatgacactattaccatcttgctaaaggcaacactgctcgccatcagtggcgtgtaccccatgagcattccagcgaccctgtttgtttggcacttctggcaaaagaaaaagcagcgatctggcgtactttgggatacaccttcacccccagaggtggagaaagctgtcttagacgacgggatatatcgcatcctgcagcggggactcttgggtagaagccaggtgggcgttggggtgtttcaagaaggagtcttccatactatgtggcacgtgaccaggggcgccgtactgatgtaccagggtaagcgtctcgagccgagttgggcaagcgtcaaaaaggatctgatttcctatgggggaggctggcgcttccagggctcttggaatatgggggaagaggtgcaggttatcgccgtggagcctggaaagaaccccaaaaatgtccaaacggctccaggtacatttaagacttcggaaggcgaggtgggggcaattgcccttgacttcaaacccggaaccagcggctcacctatcgttaaccgggaaggtaagatagtggggctgtacggaaatggcgtcgtgacaacctccggcacttacgtaagtgcgatcgctcaggccaaagcatctcaggaggggccattgcccgaaattgaggatgaggtgtttagaaagaggaacctaaccatcatggacctgcatcctggaagcggtaagacacgacggtatctcccggccattgttcgcgaagctatcaaaagaaagttaaggacgctggtccttgccccaactcgggtggtggcatccgagatggctgaagccctgaaaggcatgcccatacgataccaaaccacagcggtcaagtcagagcacaccgggaaagaaattgtagatctcatgtgccatgccactttcacaatgagattgctgtctcctgtgcgcgttccaaattataacatgatcatcatggacgaggcacactttaccgatcccgctagcattgccgctaggggatacatcagtacgcgtgtgggcatgggtgaggcagccgccatattcatgactgctacacctccggggtccgtcgaagcgtttccccagagcaatgcagtgattcaggacgaggaaaaggatatcccagagcggtcttggaactcaggatatgactggattaccgatttccctggcaagaccgtttggtttgtgccctccatcaaaagtggcaatgacatagccaactgtctcagaaagaatgggaaaagggtcattcagctgagccgcaagactttcgacacagaataccagaagaccaagaacaacgattgggactatgtggtaacaactgatatctcggagatgggagctaattttcgagccgacagagtgatcgatccacggaggtgccttaagcctgttattctaaaagacggtcccgagcgcgtcatcctggcaggcccaatgccggtgacggtggcctctgctgcgcagcgtagagggcggattggaaggaaccagaataaggaaggcgatcagtacatatacatgggtcaacctttgaacaatgacgaggatcacgcccattggaccgaagcaaaaatgttactggacaacatcaatacacccgaggggattatcccagctctcttcgagcccgaacgcgagaagtccgccgcaatcgatggcgaatatcgactgagaggagaggcccggaaaactttcgtcgaacttatgaggcgcggcgacctgcctgtttggctcagctacaaggtggcttcagaggggtttcagtatagtgatagaaggtggtgcttcgacggagagcggaacaatcaggtattggaagagaacatggacgtggaaatttggaccaaagagggtgaacgtaagaagctgcgcccacgatggctagatgccagaacatactctgaccccctggcgctcagggagtttaaagagttcgcagccggccggcgctccgtcagcggggatcttatactggaaatcggaaagttacctcagcacttgacccaaagagctcagaatgccctggacaacctcgtgatgctgcataattcagagcagggcggtaaggcttataggcacgcaatggaggaacttccggatactattgaaacgatcatgctgctcgccttgattgctgttctgaccgggggcgtgacattatttttcctaagtggacggggcctggggaagactagcatcggactcctttgtgtcacctcctctagcgccctgttgtggatggcatccgtagagccacactggatagcggcctcaatcattctggagtttttcctcatggtgctgcttatccccgaacctgaccgacagagaacaccccaagataaccagctcgcttacgttgtgattggtctgttgtttatgatcctgaccgtcgccgcaaatgagatgggcttactagaaactaccaaaaaggacctggggataggacatacggctgccgagaaccaccatcacgcagccatgctcgatgtggaccttcatccagcttctgcgtggaccctgtatgccgtcgcaactacaattatcacccctatgatgcgccacaccattgagaacacaactgctaatatcagtttgacggccatagccaaccaggcagctatcctgatgggcctcgataagggttggcccatttcgaaaatggacatcggggtgccactgcttgccttaggctgctacagccaagttaatcctctgaccctcacagcggctgtgttgatgctggtagcccactacgcaattatcggaccgggcctacaggccaaggctactagggaagcacagaaacggaccgccgcggggataatgaagaaccccacagtggatggaattgtcgctatcgacctggacccagttgtgtatgatgccaaattcgagaagcagctcggccaaatcatgcttctgattttgtgtacctcccagatcctgctcatgcgtactacgtgggcactgtgcgaatctataacattagccaccggtcctcttactaccctgtgggaggggtcacccggaaagttttggaatacaactattgctgtcagcatggccaacatcttcagaggctcctacctcgcaggagctggcctagcctttagtctgatgaaatctctagggggtagcaggcgcggcaccggggcgcagggagaaacactgggcgagaagtggaaacggcagctcaatcaactttcaaagtccgagttcaacatttataaacgaagtggtatcatagaagtggacagaagcgaggccaaggaagggctgaagaggggagagacgaccaaacatgcagtatctcgcggcactgctaagttgcggtggttcgtggaaagaaatctggttaaaccagagggtaaggtgatcgatctcggctgtgggcgtggaggctggtcctactattgcgccgggctaaagaaggtcacagaggtgaaaggatacaccaagggcggtcctgggcacgaggagcccattccgatggcaacttatggatggaacctggtcaaacttcattcaggcaaagacgtgtttttcatcccacctgaaaagtgtgatacactgctatgcgacattggcgagagctcgcccaatccaaccatcgaagaggggaggacgctccgggttctgaaaatggtagagccctggttgcgcggaaaccagttttgtattaagatcctgaatccttacatgccgtctgtggtcgaaaccctcgagcagatgcagcgaaaacacggtggcatgcttgtgagaaaccccctgagtagaaattccacacacgaaatgtactgggttagctgcgggactggaaacatagtgtcagctgtcaatatgacctcccggatgttactgaaccgcttcacaatggcccatagaaagccaacttatgagagggatgtggacttgggcgccggtacccgacacgtagcggtggagcctgaagttgctaacctcgatattatcgggcaacggatcgagaatattaagaacgaacataaatctacatggcactacgacgaggataatccctataagacctgggcataccatggaagctatgaagtcaaacctagtggctccgccagctctatggtgaacggcgtggtccgtctgctaactaagccatgggacgttatacccatggtgacgcagatcgctatgacagacaccactccttttgggcagcaaagagtattcaaagagaaggtggatacccgcacaccaaaggccaaaaggggaacggcacagattatggaggtcaccgccaagtggctttggggttttctgtcacggaataaaaagcccagaatctgtactcgcgaagagttcacaaggaaagtgcgaagtaacgctgcgattggcgccgtttttgtggacgaaaatcagtggaactccgcaaaggaggctgtcgaagatgagcggttctgggacctcgtgagaagggagcgcgaactgcacaagcaggggaaatgcgcaacctgcgtatacaatatgatgggaaagcgtgagaaaaagttgggcgaatttggtaaagcaaaggggagccgggccatctggtatatgtggctgggagctagattcctcgagtttgaagcccttggcttcatgaacgaggatcactggttctctagggaaaattcgctgtcaggcgttgaaggggagggattacataaactgggttacatattgcgcgacatcagcaagattccgggcgggaacatgtacgcggatgacactgcaggatgggatacacgaatcaccgaagaggacctccaaaatgaggccaagattacagatatcatggaacctgagcacgctctgctagccacttccatatttaaacttacctatcagaacaaggtggtccgggtgcagagaccagccaaaaatggcacggtgatggacgtcattagtaggcgcgatcagagaggttctgggcaagttggaacctacggcctgaacacattcactaacatggaagctcagctcatccggcagatggagagcgaaggcatcttttccccctcagagctggagacccctaatttggccgggagggtgttagactggctggaaaagcatggaattgagcgtctccgacgcatggctataagtggtgacgattgtgtagtgaaaccaatcgacgatagattcgccacagcacttactgcgctgaacgacatgggcaaggtccggaaggatattccccagtgggaaccgtctaaagggtggaatgactggcaacaggtgcctttttgcagccaccacttccatcagctaatcatgaaggatggaagggagattgttgtgccctgtcgcaaccaggacgaactggtcggcagagcccgggtgtcccaaggtgctgggtggtcactcagggagaccgcctgcttgggaaaaagctatgcacagatgtggcagctgatgtactttcaccgacgtgatcttagactggctgccaatgcaatctgttctgccgtaccagttgactgggtgcctacgtcccgcacaacctggagtatacatgcgcaccatcaatggatgactacagaggatatgctcagcgtctggaaccgggtgtggatcgaagagaatccctggatggaagacaagacccacgtttcgtcctgggaggacgtgccatatttaggcaaaagggaagatcagtggtgcggctctctgattgggttgactgctagagccacctgggcaacaaacatccaggtcgccattaaacaggtgcgccggctgatcggaaatgagaactacctcgactatatgacgtcaatgaagaggttcaaaaatgagagcgatcccgaaggtgctctttggtga

SEQ ID NO: 14179 - RNA, 9879 nt, synthetic construct
  misc_feature 1..9879: note = derived and/or modified CDS sequence (opt3) from DENV-1__JQ915071__SS-prME
  source 1..9879: mol_type = other RNA
agcgtgaccatgctgctcatgcttctgcccaccgtcttgactttccacttaacgaccagaggcggggagcctcatatgatcgtttccaagcaggaaaggggaaaatctctgttatttaagacatcagccggtgtgaacatgtgcactctcattgctatggacctgggcgagctttgtgatgacaccatgacatacaaatgcccacggataaccgaaactgagccggatgacgtagattgttggtgcaatgcaacagaaacctgggtgacgtatgggacttgtagtcaaaccggagagcaccgccgagacaagcgttccgtcgccctggcgccccatgtgggcttgggtctcgagacaagaactgaaacctggatgtcctctgagggggcttggaggcagatccagaaagttgaaacatgggccctgcggcaccctggattcaccgtgattgcactgtttctcgcccatgctatcggcacgtcgattactcagaagggcatcatattcatcttactgatgcttgtcacaccatcaatggcaatgcgctgcgtggggattggaaacagagattttgtagagggtttgagcggcgccacctgggttgacgtggtcctggagcacgggagttgtgtgactacaatggctaaggataaacccaccctagacatcgaactcctgaagacggaggtgaccaatcctgccgtccttaggaaactgtgcattgaagcgaagatctccaacacaactaccgattctcggtgtccaacacaaggagaggcaactttggttgaggaacaggacaccaatttcgtgtgccgccgaacatttgtagatagaggctggggtaacgggtgtggactcttcggcaaaggcagcctgataacctgcgccaagtttaagtgcgctactaaattagaggggaagattgtgcagtacgaaaatctgaaatattccgtcatcgtgacggttcacacaggagaccagcatcaagtgggtaacgagaccactgaacacggcaccattgccacaatcacaccccaggcacctacttcagagatccagctcacagactacggggctcttacgctggattgtagtccaaggaccggattggacttcaatgaaatggtcctactgactatgaaggagaaaagctggctcgtgcataagcagtggtttctggatcttccgctgccctggacaaccggcgcctctacatcccaagagacttggaaccggcaggacttgctcgtaaccttcaaaacggcgcacgccaagaagcaggaagttgtggtcctgggttcacaagagggggcaatgcacaccgctttaacaggcgccactgaaattcagaccagcggaacaactaccatatttgctggccatctgaaatgccgtctaaagatggataaactcacgctgaaggggatcagttatgtgatgtgtacaggatctttcaaacttgagaaggaagtcgccgagacccagcacggtactgtgttggttcaggtgaagtacgagggcacagacgcaccttgcaaaattccattctccagccaagatgaaaagggggtaacccagaatggacgcctggtcactgccaaccccatcgtgaccgacaaagagagacctgttaatatagaagctgagccaccctttggcgagtcgtatattgtggtcggtgcgggggaaaaggcactcaaactgtcttggttcaagaagggctcctcaatcggaaaaatgtttgaggccacagctaggggcgcccggcgaatggcaatccttggggatacggcctgggacttcggaagtattggtggcgtgtttaccagcgtagggaagctggtgcatcagatcttcggaactgcttacggcgttttgttttccggtgtctcttggacaatgaaaattgggataggcatcctcctgacctggttaggactgaacagccgctcaacaagtctatccatgacttgtattgccgtgggcatggtgaccctctacctgggggtcatggttcaggcagatagcggatgcgtgatcaattggaagggcagagaacttaaatgtggttctgggatcttcgtgacgaacgaggtacacacatggaccgaacaatataagtttcaggcggactcaccgaagaggttgagtgctgccattggaaaagcatgggaggagggcgtctgcggtatacggagcgccactcgcctggaaaacatcatgtggaagcagatttccaatgagctcaaccatatcctgttagaaaatgacatgaaattcaccgtggttgtgggcgatgtctctgggattctggctcagggaaagaaaacaatcagacctcaacccatggagcacaagtactcgtggaaaagctggggcaaggccaagataatcggggcagacgtgcagaacactacctttattatcgatggaccaaatacacctgaatgtcccgacgatcagagggcttggaacatttgggaggttgaggactatggcttcggtatctttacgaccaatatatggcttaaattgcgtgattcctacactcaggtgtgcgaccaccggctcatgtcagccgcgattaaggatagtaaagccgtacatgctgacatggggtattggatcgaatctgagaagaacgaaacatggaaactggcacgagccagcttcattgaggtcaagacctgtgtgtggccaaagtcccacactctatggtcaaatggagtgctggaaagcgagatgatcatacccaaaatctacggcggtcctatttctcaacataactatagaccaggctacttcacacagaccgctgggccgtggcacctcggaaagctggagcttgattttgacttgtgcgaaggcacgactgtcgttgtggatgagcactgcgggaataggggaccctccctgcgcaccacaaccgtaactggcaaaatcattcatgaatggtgttgccggagttgtacattacctccactcagattcaagggtgaggacgggtgctggtacggaatggagatcaggcccgtgaaagaaaaggaggaaaacctggtcaagagcatggtgtctgccggctccggtgaggttgactcatttagtcttggcctgttgtgtataagcattatgatcgaagaggtgatgcgctcgcgatggtcccggaaaatgctcatgaccgggacactggtcgtgttcctactgctcactctgggacagcttacctggaatgatttgatccgtctgtgcattatggttggcgcaaacgcgtctgacaatatggggatgggaacgacatatttagccctcatggctacctttagaatgaggcctatgttcgccgtgggcctgctttttcgccggctgactagcagagaggtcctactcctgaccgtaggtttgtcactggtggcaagtgttgaattaccaaactccctcgatgagctgggggacggacttgctatgggcatcatgattctgaagttgctcacagatttccaatctcaccagctgtgggccactctactgagccttacctttgtgaaaacgacactctccctgcattacgcatggaagaccatggccatgatattgtcaatcgtcagcctgttacccctctgtctgagtactacatctcagaaaaccacttggcttccggtgctgttgggctccctcgggtgcaagcctctgacaatgttcctaattaccgaaaacaagatctggggaaggaaaagctggccactgaatgagggtattatggctgtaggcatcgtgtcgatacttctctcatctctgttgaagaacgacgtccccttagcggggcctctgatcgccggaggcatgctcattgcatgttatgttatcagtggttccagcgctgatctgtctcttgaaaaagccgccaaggtgagctgggaggaggaagctgagcactccggggcatcacataatattctggtggaaatccaggacgatggaacgatgaaaataaaggacgaggaacgagatgacactattaccatcttgctaaaagccacactgctcgcgatcagtggcgtctaccccatgagcattccagctaccctgtttgtgtggcacttctggcaaaagaagaaacagcgctctggcgttctttgggatacaccttcacccccagaggtagagaaggccgtgttagacgacgggatatatcggatcctgcagagaggactcttgggtaggagccaggtcggcgtgggggtttttcaagaaggagtgttccacactatgtggcatgtcacccgtggcgcagtgctgatgtaccagggtaaacgcctcgagccgagttgggccagcgtaaagaaagatctgatttcctatgggggaggctggcggttccagggctcttggaacacgggggaagaggtccaggtgatcgctgttgagcctggaaagaatcccaagaacgtgcaaacagcaccaggtacttttaaaacctcggaaggcgaggtcggggccattgcgcttgacttcaagcccggaacaagcggctcacctatcgtgaatagagaaggtaaaatagttgggctgtacggaaacggcgtggtcaccacttccggcacctacgtgagtgctatcgcccaggcaaaggcctctcaggaggggccattgcccgaaattgaggatgaggtatttaggaaacgaaatctaacaatcatggacctgcaccctggaagcggtaagacgcggcgctatctcccggctattgtgagagaagccatcaagaggaaattacggactctggttcttgcaccaacccgagtcgtggcttccgagatggccgaagcgctgaagggcatgcccataagataccaaacaaccgccgtgaaatcagagcatactgggaaggaaattgtcgatctcatgtgccacgcaacattcaccatgcgcttgctgtctcctgtaagggtgccaaactataatatgatcatcatggacgaggctcattttacggatcccgccagcattgctgcacgtggatacatcagtactcgggttggcatgggtgaggccgccgctatattcatgacagcgacccctccggggtccgtggaagcatttccccagagcaacgccgtcattcaggacgaggaaaaagatatcccagagagatcttggaactcaggatatgactggattaccgatttccctggcaagactgtgtggtttgttccctccatcaagagtggcaacgacatagctaattgtctcaggaaaaacgggaagcgcgtgattcagctgagccgaaaaacattcgacaccgaataccaaaagaccaagaataatgattgggactatgtcgtgactacggatatctcggagatgggagccaactttagagcagaccgggtaatcgatccaaggcgctgccttaagcctgtgattctaaaggacggtcccgagcgtgttatcctggccggcccaatgccggtcaccgtggcttctgcggcccagagacgggggaggattggacgcaatcagaacaaagaaggcgatcagtacatatacatgggtcaacctttgaataacgacgaggatcacgcacactggacagaagctaagatgttactggacaatatcaacactcccgaggggattatcccagccctcttcgagcccgaacgagagaaatccgcagccatcgatggcgaatatagactgcggggagaggctaggaagaccttcgtggaacttatgcgcagaggcgacctgcctgtctggctcagctacaaagttgcctcagaggggtttcagtatagtgataggcggtggtgcttcgacggagagcgtaataaccaggtgttggaagagaatatggacgtagaaatttggacaaaggagggtgaacgcaaaaagctgcgaccaagatggctagatgcgaggacctactctgaccccctggcactccgggagtttaaggagttcgccgctggccgcagatccgtgagctcagatcttatactggaaatcgggaaattacctcagcatttgactcaaagggcccagaacgctctggacaatctcgtcatgctgcacaacagtgagcagggaggcaaggcatatcggcatgccatggaggaacttccggatacgattgaaaccatcatgctgctcgctttgattgccgtgctgacaggtggggttactttatttttcctaagcggccgaggactgggcaaaacctccatcgggctcctttgtgtgacatctagctccgcactgttgtggatggcgaatgtcgagccacactggatagccgcttcaatcattctggagtttttcctcatggtactgcttatccccgaacctgacagacagcgcacaccccaagataaccagctcgcctacgtggttattggactgttgtttatgatcctgactgtggcagctaacgagatgggtttactagaaacaacgaagaaagacctgggcatagggcacaccgccgcagagaatcatcaccatgccgctatgctcgatgtcgaccttcacccagcgtctgcctggactctgtatgcagtggctacaaccattatcacccctatgatgaggcatacaattgagaacactacggccaatatcagtttgaccgccatagcaaaccaggctgccatcctgatgggactcgataagggctggcccatttcgaagatggacatcggtgtcccactgcttgcgttagggtgctacagccaagtgaatcctctgacactcactgctgccgttttgatgctggtggcacactacgccattatcggcccgggactacaggctaaagcaacccgggaagcccagaagcgtacagcggctggcataatgaaaaaccccaccgtagatgggattgtggccatcgacctggacccagtcgtttatgatgcaaagttcgagaaacagctcggacaaatcatgcttctgattttgtgtacttcccagatcctgctcatgagaacgacatgggccctgtgcgaatctataaccttagctactggccctcttaccacactgtgggagggttcacccgggaagttttggaatactaccattgccgtgagcatggcaaacatcttcaggggatcctacctcgctggcgccggtctagcgtttagtctgatgaagtctttgggcgggggacgccggggcacaggggcccagggagaaacgctgggcgagaaatggaagcgacagctcaatcaacttagcaaatcagagttcaacacctataagagatccggtattatcgaagtcgacaggagtgaggcacgcgaagggctgaaacggggagagactacaaagcacgctgtgagcagaggcaccgccaagttgcgttggttcgtagaaaggaatctggtgaaaccagagggtaaggttatagatctcggctgtgggcggggaggctggtcttactattgcgcagggctgaaaaaggtgactgaggtcaaaggatacacaaagggcggtcctgggcatgaggagcccatcccgatggctacctatggatggaacctagtgaaacttcactccggcaaggacgtctttttcattccacctgaaaagtgtgatacgctgctatgcgacatcggcgagtcaagccccaatccaaccattgaagaggggcgcacactccgagtgctgaaaatggttgagccctggttgagaggaaaccagttttgtatcaagattctgaatccttacatgccgtcggtagtggaaactctcgagcagatgcagaggaaacatggtggcatgcttgtccggaaccccctgtctcgcaatagtacccacgaaatgtactgggtgtcctgcgggacaggaaacatcgttagcgccgtgaacatgacttcaagaatgttactgaataggttcaccatggcccaccgaaagccaacatatgagcgggatgtcgacttgggcgcgggtacccgtcatgtggctgtagagcctgaagtggcaaacctcgatataattgggcaaagaatcgagaatatcaaaaacgaacacaagtccacttggcattacgacgaggataatccctataagacgtgggcctaccacggatcttatgaagttaaacctagcggcagtgcttccagcatggtcaacggcgtggtgcgcctgctaacaaagccatgggacgtcattcccatggttacccagatagccatgactgacaccacaccttttgggcagcaaagggtgttcaaagagaaggtagatacgcggaccccaaaagcaaagagaggaactgcccagatcatggaggtgacagctaagtggctttggggttttctgtctcgcaataaaaagcccaggatttgtacccgagaagagttcactcggaaagtcagatcaaacgcggccatcggcgcagtgtttgttgacgaaaatcagtggaacagtgctaaggaggccgtggaagatgagaggttctgggacctcgtccgccgtgagcgggaactgcataaacaggggaagtgcgcaacatgcgtgtacaatatgatgggaaagagagagaaaaagttgggcgaatttggtaaagccaaggggtccagggctatttggtatatgtggctgggagcccgcttcctcgagtttgaagcgcttggcttcatgaacgaggatcactggttcagccgagaaaattctctgtcgggcgtagaaggggagggattacacaaactgggttacatcttgcgggacatatcaaagatcccgggcgggaacatgtacgcagatgacaccgccggatgggatacaagaattactgaagaggacctccaaaatgaggctaaaatcaccgatattatggaacctgagcatgccctgctagcaacgagcatctttaaacttacctatcagaacaaggttgtgagggtccagcgcccagctaaaaacggcacagtgatggacgtgatatccagacgggatcagaggggtagtgggcaagtcggaacttacggcctgaataccttcacaaacatggaagcccagctcattcgtcagatggagtctgaaggcatctttagcccctccgagctggagactcctaatttggctgggcgagttttagactggctggaaaagcacggaatcgagcgcctcagacggatggccatttcaggtgacgattgtgtggtaaaaccaatagacgataggttcgcaaccgcgcttacggccctgaacgacatgggcaaggtgcgcaaagatatcccccagtgggaaccgagtaaggggtggaatgactggcaacaggtccctttttgctctcatcacttccaccagctaattatgaaggatggaagagagatcgtggttccctgtcggaaccaggacgaactggtgggcagggctcgagtcagccaaggtgccgggtggtccctccgtgagacagcatgcttgggaaaatcatatgctcagatgtggcagctgatgtactttcatagacgcgatcttcggctggccgcaaatgccatttgtagcgcggtgccagtagactgggttcctacctctaggactacatggtccatccacgctcatcaccaatggatgaccactgaggatatgctcagtgtgtggaacagagtctggatagaagagaatccctggatggaagacaagacccatgtgagctcgtgggaggacgttccatatttaggcaaacgcgaagatcagtggtgcggctccctgatcgggttgacagcccgggcaacgtgggccaccaacattcaggtggctatcaatcaggtcaggcgactgattggaaacgagaattacctcgactatatgacttctatgaagagattcaaaaacgagtcagatcccgaaggtgccctttggtga

SEQ ID NO: 14180 - RNA, 9879 nt, synthetic construct
  misc_feature 1..9879: note = derived and/or modified CDS sequence (opt3) from DENV-1__JQ915073__SS-prME
  source 1..9879: mol_type = other RNA
agcgtgaccatgctgctcatgcttctgcccaccgtcttgactttccacttaacgaccaggggcggggagcctcatatgatcgtttccaagcaggaaaggggaaaatctctgttatttaagacatcagctggtgtgaacatgtgcactctcattgcaatggacctgggcgagctttgtgatgacaccatgacatacaaatgcccgcggataaccgaaactgagccggatgacgtagattgttggtgcaatgcaacagaaacctgggtgacgtatgggacttgtttccaaaccggagagcaccgccgagacaagcgtagtgtcgccctggcgccccatgtgggcttgggtctcgagacaagaactgaaacctggatgagctccgagggggcttggaggcagatccagaaagttgaaacatgggccctgcggcaccctggatttaccgtgattgcactgttcctcgcccatgctatcggcacgtctattactcagaagggcatcatatttatcttactgatgcttgtcacaccatcgatggcaatgcgctgcgtggggattggaaacagagatttcgtagagggtttgtcaggcgccacctgggttgacgtggtcctggagcacgggagctgtgtgactacaatggctaaggataaacccaccttggacatcgaactcctgaagacggaggtgaccaatcctgccgtccttaggaaactgtgcattgaagcgaagatcagtaacacaactaccgattcccggtgtccaacacaaggagaggcaactttggttgaagaacaagacaccaattttgtgtgccgccgaacattcgtagatagaggctggggtaacgggtgtggactctttggcaaaggctctctgataacctgcgccaagttcaagtgcgtgactaaattagaggggaagattgtccagtacgaaaatctgaaatatagcgtgatcgttacggtgcacacaggagaccagcatcaagtcggtaacgagaccactgaacacggcaccattgctacaatcacaccccaggcccctacttccgagatccagctcacagactacggggcacttacgctggattgttcaccaaggaccggattggactttaatgaaatggtgctactgactatgaaggagaaaagttggctcgtacataagcagtggttcctggatcttccgctgccctggacaaccggcgctagcacatctcaagagacttggaaccggcaggacttgctcgttacctttaaaacggcccacgcgaagaagcaggaagtggtcgtgctgggttcccaagagggggccatgcacaccgcattaacaggcgctactgaaattcagacctcaggaacaactaccatattcgccggccatctgaaatgccgtctaaagatggataaactcacgctgaaggggatcagctatgtcatgtgtacaggaagtttcaaacttgagaaggaagtggctgagacccagcacggtactgttttggtgcaggtaaagtacgagggcacagacgccccttgcaaaattccattttcttcccaagatgaaaagggggtcacccagaatggacgcctggtgactgcaaaccccatcgttaccgacaaagagaagcctgtgaatatagaagccgagccacccttcggcgagagctatattgtcgtgggtgctggggaaaaagcgctcaagctgtcgtggtttaagaaaggatcttccatcggaaagatgttcgaggcaacagccagaggcgctaggcggatggccatccttggggatacggcatgggactttggatcaattggtggcgtattcaccagtgtggggaaactggttcatcagatctttggaactgcctacggcgtcttgttcagcggtgtgtcctggacaatgaagattgggataggcatcctcctgacctggttaggactgaactctcgaagcacatcactaagtatgacttgtattgctgtgggcatggtcaccctctacctgggggttatggtgcaggccgattccggatgcgtgatcaattggaaaggccgcgaacttaagtgtggtagcgggatctttgtaacgaacgaggtccacacatggaccgaacaatataagttccaggcagactctccgaaaagattgtcagcggctattggaaaggcctgggaggagggcgtgtgcggtataaggagtgcaactcggctggaaaacatcatgtggaaacagattagcaatgagctcaaccatatcctgttagaaaatgacatgaagtttaccgttgtggtcggcgatgtgtccgggattctggcccagggcaagaaaacaatccgccctcaacccatggagcacaaatactcttggaagtcgtggggcaaggctaaaataatcggggccgacgttcagaacactaccttcattatcgatggaccaaatacacctgaatgtcccgacgatcagagagcatggaacatttgggaggtggaggactatggctttggtatcttcacgaccaatatatggcttaagttgagggatagctacactcaggtatgcgaccaccgtctcatgtccgctgccattaaagattcaaaggcggtccatgccgacatggggtattggatcgaaagtgagaaaaacgaaacatggaagctggctcgggcatctttcattgaggtgaagacctgtgtgtggccaaaaagccacactctatggtccaatggagtcctggaatcagagatgatcatacccaagatctacggcggtcctattagccaacataactatcgaccaggctactttacacagaccgccgggccgtggcacctcggaaaactggagcttgatttcgacttgtgcgaaggcacgactgttgtggtagatgagcactgcgggcatagaggaccctctctgaggaccacaaccgtgactggcaagatcattcacgaatggtgttgccgctcctgtacattacctccactccggtttaaaggtgaggacgggtgctggtacggaatggagatcagacccgtcaaggaaaaggaggaaaatctggtgaaaagtatggttagcgctggctctggtgaggtggactccttctcacttggcctgttgtgtataagtattatgatcgaagaggtcatgaggagccgctggtcgcgaaagatgctcatgaccgggacactggtggtttttctactgctcactctgggacagcttacctggaacgatttgatccggctgtgcattatggtgggcgccaatgcatccgacaacatggggatgggaacgacatatttagcgctcatggccaccttccgtatgagacctatgtttgctgtcggcctgcttttcaggcgcctgacttctcgggaggtactactcctgaccgtgggtttgagcctggttgcctcagtggaattaccaaatagtctcgatgagctgggggacggacttgcaatgggcatcatgattctgaaattgctcacagattttcaatcccatcagctgtgggctactctactgtctcttaccttcgtcaagacgacactcagcctgcactacgcctggaaaaccatggcaatgatattgtccatcgtgtcactgttacccctctgtctgagcactacaagtcagaagaccacttggcttccggtactgttgggctctctcgggtgcaagcctctgacaatgtttctaattaccgaaaacaaaatctggggaagaaagtcctggccactgaacgagggtattatggccgtgggcatcgtcagcatacttctctcgtcactgttgaaaaatgacgttcccttagctgggcctctgatcgcgggaggcatgctcattgcctgttatgtgatctctggtagttccgcagatctgagccttgaaaaggctgccaaagtgtcttgggaggaggaagccgagcatagcggggcttcccacaacattctggtcgaaatccaggacgatggaacgatgaagataaaagacgaggaaagggatgacactattaccatcttgctaaaggcaacactgctcgccatctcaggcgtgtaccccatgagtattccagcgaccctgttcgtttggcacttttggcaaaagaaaaagcagcgaagcggcgtactttgggatacaccttctcccccagaggtggagaaagctgtcttagacgacgggatatatcgcatcctgcagcggggactcttgggtagatcccaggtgggcgttggggtgttccaagaaggagtcttccatactatgtggcacgtgaccaggggcgccgtactgatgtaccagggtaagcgtctcgagccgtcatgggcaagtgtcaaaaaggatctgattagctatgggggaggctggcgctttcagggctcctggaatacgggggaagaggtgcaggttatcgccgtggagcctggaaagaaccccaaaaatgtccaaacaactccaggtaccttcaagacatctgaaggcgaggtgggggctattgcacttgactttaaacccggaacctcgggcagccctatcgttaaccgggaaggtaagatagtggggctgtacggaaatggcgtcgtgactacctcaggcacatacgtatccgccatcgcgcaggctaaagccagtcaggaggggccattgcccgaaattgaggatgaggtgttcagaaagaggaacctaacgatcatggacctgcatcctggatctggtaagactcgacggtatctcccggcaattgttcgcgaagccatcaaaagaaagttaaggaccctggtccttgctccaacacgggtggtggccagcgagatggcagaagctctgaaaggcatgcccatacgataccaaaccactgccgtcaagtccgagcacacagggaaagaaattgtagatctcatgtgccatgcgacctttacgatgagattgctgtcacctgtgcgcgttccaaattataacatgatcatcatggacgaggcccacttcactgatcccgcatctattgctgccaggggatacatcagcacacgtgtgggcatgggtgaggctgcagccatatttatgaccgccacccctccggggagtgctgaagcgttcccccagtccaatgcagtcattcaggacgaggaaaaggatatcccagagcggagctggaactctggatatgactggattactgattttcctggcaagacagtgtggttcgttccctcaatcaaatccggcaatgacatagccaactgtctcagaaagaatgggaaaagggtgattcagctgagtcgcaagacctttgacacagaataccagaaaactaagaacaacgattgggactatgtcgtgacgaccgatatcagcgagatgggagctaatttccgagccgacagagtaatcgatccacggaggtgccttaagcctgtgattctaaaagacggtcccgagcgcgttatcctggcaggcccaatgccggtcacagtggcctcggctgcgcagcgtagagggcggattggaaggaaccagaataaggaaggcgatcagtacatatacatgggtcaacctttgaacaatgacgaggatcacgcccattggactgaagcaaaaatgttactggacaacatcaatacccccgaggggattatcccagctctcttcgagcccgaacgcgagaagtctgccgcaatcgatggcgaatatcgactgagaggagaggcccggaaaacatttgtggaacttatgaggcgcggcgacctgcctgtctggctctcctacaaggttgctagcgaggggttccagtattcagatagaaggtggtgctttgacggagagcggaacaatcaggtgttggaagagaacatggacgtagaaatttggaccaaagagggtgaacgtaagaagctgcgcccacgatggctagatgccagaacttacagtgaccccctggcgctcagggagttcaaagagtttgcagccggccggcgctctgtgtccggggatcttatactggaaatcggaaagttacctcagcacttgacgcaaagagctcagaatgccctggacaacctcgtcatgctgcataatagcgagcagggcggtaaggcttataggcacgcaatggaggaacttccggataccattgaaacaatcatgctgctcgccttgattgctgtgctgactgggggcgttaccttattctttctatcaggacggggcctggggaagacaagtatcggactcctttgtgtgaccagctcctctgccctgttgtggatggcaagcgtcgagccacactggatagcggcctccatcattctggagttctttctcatggtactgcttatccccgaacctgaccgacagagaactccccaagataaccagctcgcttacgtggttattggtctgttgttcatgatcctgacagtggccgcaaatgagatgggcttactagaaacgaccaaaaaggacctggggataggacatactgctgccgagaaccaccatcacgcagccatgctcgatgtcgaccttcatccagcttcagcgtggacactgtatgccgtggcaaccaccattatcacacctatgatgcgccacactattgagaacacgaccgctaatatctctttgacagccatagccaaccaggcagctatcctgatgggcctcgataagggttggcccattagtaaaatggacatcggggtcccactgcttgccttaggctgctactcgcaagtgaatcctctgactctcaccgcggctgttttgatgctggtggcccactacgcaattatcggaccgggcctacaggccaaggctacaagggaagcacagaaacggaccgccgcggggataatgaagaaccccactgtagatggaattgtggctatcgacctggacccagtcgtttatgatgccaaatttgagaagcagctcggccaaatcatgcttctgattttgtgtacgagccagatcctgctcatgcgtacaacctgggcactgtgcgaatccataactttagccaccggtcctcttacaactctgtgggaggggtctcccggaaagttctggaataccacaattgctgtgtcaatggccaacatctttagaggcagctacctcgccggtgctggcctagccttctccctgatgaaaagtctagggggaggcaggcgcgggacgggagcgcagggcgaaaccctgggtgagaagtggaaacggcagctcaatcaactttctaagagcgagttcaacacttataaacgatcagggattatcgaagtcgacagatccgaggccaaggaaggactgaagaggggcgagacaaccaaacatgcagtgagtcgcggtactgctaagttgcggtggtttgtagaaagaaatctggtgaaaccagagggcaaggttatagatctcgggtgtggacgtggcgggtggagctactattgcgccggactgaaaaaggtgacagaggtcaaaggctacaccaagggtgggcctggacacgaggaacccatcccgatggcaacgtatggctggaacctagtgaaacttcattctggcaaagacgtcttctttattccacctgaaaagtgtgataccctgctatgcgacatcggggagtcctcacccaatccaacaattgaagagggaaggactctccgggtgctgaaaatggttgagccctggttgcgcggtaaccagttctgtatcaagattctgaatccttacatgccgagcgtagtggaaaccctcgagcagatgcagcgaaaacacggcgggatgcttgtcagaaaccccctgtcgagaaattctacacacgaaatgtactgggtgagttgcggaactggcaacatcgtttccgctgtgaatatgaccagccggatgttactgaaccgctttacaatggcccatagaaagccaacctatgagagggatgtcgacttgggtgccgggactcgacacgtggcggtagagcctgaagtggctaacctcgatataattggacaacggatcgagaatatcaagaacgaacataaatcaacgtggcactacgacgaggataatccctataagacatgggcataccatggctcctatgaagttaaaccttctggcagcgccagttccatggtcaacggggtggtgcgtctgctaaccaagccatgggacgtcattcccatggttactcagatagctatgaccgacacaacgcctttcggacagcaaagagtgtttaaagagaaggtagatacccgcactccaaaggccaaaaggggtacagcacagatcatggaggtgaccgccaagtggctttggggcttcctgagccggaataaaaagcccagaatttgtactcgcgaagagtttacaaggaaagtccgatctaacgctgcgatcggggccgtgttcgttgacgaaaatcagtggaactcagcaaaggaggctgtggaagatgagcggttttgggacctcgtcagaagggagcgcgaactgcacaagcagggaaaatgcgcaacctgcgtgtacaatatgatgggcaagcgtgagaaaaagttgggtgagttcgggaaagcaaagggaagtcgggccatttggtatatgtggctgggcgctagatttctcgagttcgaagcccttggcttcatgaacgaggatcactggttttccagggagaatagcctgtctggggtagaaggagagggtttacataaactgggctacatcttgcgcgacatatcgaagatcccagggggaaacatgtacgcggatgacacagcaggctgggatactcgaattaccgaagaggacctccaaaatgaggccaagatcacggatattatggaacctgagcacgctctgctagccacctcaatcttcaaacttacatatcagaacaaggttgtgcgggtccagagaccagccaaaaatggtactgtgatggacgtgataagcaggcgcgatcagagagggtccggacaagtcggcacctacggcctgaacacatttactaacatggaagctcagctcattcggcagatggagagtgaagggatcttctctcccagcgagctggagacccctaatttggccggaagggttttagactggctggaaaagcatggtatcgagcgtctccgacgcatggctatttccggcgacgattgtgtggtaaaaccaatagacgatagatttgccacggcacttacagcgctgaacgacatggggaaggtgcggaaggatatcccccagtgggaaccgtcaaaaggatggaatgactggcaacaggtccctttctgcagtcaccactttcatcagctaattatgaaggatggcagggagatcgtggttccctgtcgcaaccaggacgaactggtgggtagagcccgggtctctcaaggggctggatggagcctcagggagaccgcctgcttgggcaaatcctatgcacagatgtggcagctgatgtacttccaccgacgtgatcttagactggctgccaatgcaatttgttcagccgtgccagtagactgggttcctactagccgcacaacctggtctatccatgcgcaccatcaatggatgactaccgaggatatgctctccgtgtggaaccgggtctggatagaagagaatccctggatggaagacaagacacacgtgagtagctgggaggacgttccatatttaggcaaaagggaagatcagtggtgcgggtcgctgatcggattgacggctagagccacctgggcaactaacattcaggtggccatcaatcaggtccgccggctgattggtaacgagaattacctcgactatatgacatccatgaagaggtttaagaacgagtctgatcccgaaggcgctctttggtga

SEQ ID NO: 14181 - RNA, 9879 nt, synthetic construct
  misc_feature 1..9879: note = derived and/or modified CDS sequence (opt3) from DENV-1__JQ915075__SS-prME
  source 1..9879: mol_type = other RNA
agcgtgaccatgctgctcatgcttctgcccaccgtcttgactttccacttaacgaccagaggcggggagcctcatatgatcgtttccaagcaggaaaggggaaaatctctgctatttaagacatcagccggtgtgaatatgtgcactctcattgctatggacctgggcgagctttgtgatgacaccatgacatacaaatgcccacggataaccgaaactgagccggatgacgtagattgttggtgcaatgcaacagaaacctgggtgacgtatgggacttgtagtcaaaccggagagcaccgccgagacaagcgttccgtcgccctggcgccccatgtgggcttgggtctcgagacaagaactgaaacctggatgtcctctgagggggcttggaggcagatccagaaagttgaaacatgggccctgcggcaccctggattcaccgtgattgcactgtttctcgcccatgctatcggcacgtcgattactcagaagggcatcatattcatcttactgatgcttgtcacaccatcaatggcaatgcgctgcgtggggattggaaacagagattttgtagagggtttgagcggcgccacctgggttgacgtggtcctggagcacgggagttgtgtgactacaatggctaaggataaacccaccctagacatcgaactcctgaagacggaggtgaccaatcctgccgtccttaggaaactgtgcattgaagcgaagatctccaacacaactaccgattctcggtgtccaacacaaggagaggcaactttggttgaggaacaggacaccaatttcgtgtgccgccgaacatttgtagatagaggctggggtaacgggtgtggactcttcggcaaaggcagcctgataacctgcgccaagtttaagtgcgctactaaattagaggggaagattgtgcagtacgaaaatctgaaatattccgtcatcgtgacggttcacacaggagaccagcatcaagtgggtaacgagaccactgaacacggcaccattgccacaatcacaccccaggcacctacttcagagatccagctcacagactacggggctcttacgctggattgtagtccaaggaccggattggacttcaatgaaatggtcctactgactatgaaggagaaaagctggctcgtgcataagcagtggtttctggatcttccgctgccctggacaaccggcgcctctacatcccaagagacttggaaccggcaggacttgctcgtaaccttcaaaacggcgcacgccaagaagcaggaagttgtggtcctgggttcacaagagggggcaatgcacaccgctttaacaggcgccactgaaattcagaccagcggaacaactaccatatttgctggccatctgaaatgccgtctaaagatggataaactcacgctgaaggggatcagttatgtgatgtgtacaggatctttcaaacttgagaaggaagtcgccgagacccagcacggtactgtgttggttcaggtgaagtacgagggcacagacgcaccttgcaaaattccattctccagccaagatgaaaagggggtaacccagaatggacgcctggtcactgccaaccccatcgtgaccgacaaagagagacctgttaatatagaagctgagccaccctttggcgagtcgtatattgtggtcggtgcgggggaaaaggcactcaaactgtcttggttcaagaagggctcctcaatcggaaaaatgtttgaggccacagctaggggcgcccggcgaatggcaatccttggggatacggcctgggacttcggaagtattggtggcgtgtttaccagcgtagggaagctggtgcatcagatcttcggaactgcttacggcgttttgttttccggtgtctcttggacaatgaaaattgggataggcatcctcctgacctggttaggactgaacagccgctcaacaagtctatccatgacttgtattgccgtgggcatggtgaccctctacctgggggtcatggttcaggcagatagcggatgcgtgatcaattggaagggcagagaacttaaatgtggttctgggatcttcgtgacgaacgaggtacacacatggaccgaacaatataagtttcaggcggactcaccgaagaggttgagtgctgccattggaaaagcatgggaggagggcgtctgcggtatacggagcgccactcgcctggaaaacatcatgtggaagcagatttccaatgagctcaaccatatcctgttagaaaatgacatgaaattcaccgtggttgtgggcgatgtctctgggattctggctcagggaaagaaaacaatcagacctcaacccatggagcacaagtactcgtggaaaagctggggcaaggccaagataatcggggcagacgtgcagaacactacctttattatcgatggaccaaatacacctgaatgtcccgacgatcagagggcttggaacatttgggaggttgaggactatggcttcggtatctttacgaccaatatatggcttaaattgcgtgattcctacactcaggtgtgcgaccaccggctcatgtcagccgcgattaaggatagtaaagccgtacatgctgacatggggtattggatcgaatctgagaagaacgaaacatggaaactggcacgagccagcttcattgaggtcaagacctgtgtgtggccaaagtcccacactctatggtcaaatggagtgctggaaagcgagatgatcatacccaaaatctacggcggtcctatttctcaacataactatagaccaggctacttcacacagaccgctgggccgtggcacctcggaaagctggagcttgattttgacttgtgcgaaggcacgactgtcgttgtggatgagcactgcgggaataggggaccctccctgcgcaccacaaccgtaactggcaaaatcattcatgaatggtgttgccggagttgtacattacctccactcagattcaagggtgaggacgggtgctggtacggaatggagatcaggcccgtgaaagaaaaggaggaaaacctggtcaagagcatggtgtctgccggctccggtgaggttgactcatttagtcttggcctgttgtgtataagcattatgatcgaagaggtgatgcgctcgcgatggtcccggaaaatgctcatgaccgggacactggtcgtgttcctactgctcactctgggacagcttacctggaatgatttgatccgtctgtgcattatggttggcgcaaacgcgtctgacaatatggggatgggaacgacatatttagccctcatggctacctttagaatgaggcctatgttcgccgtgggcctgctttttcgccggctgactagcagagaggtcctactcctgaccgtaggtttgtcactggtggcaagtgttgaattaccaaactccctcgatgagctgggggacggacttgctatgggcatcatgattctgaagttgctcacagatttccaatctcaccagctgtgggccactctactgagccttacctttgtgaaaacgacactctccctgcattacgcatggaagaccatggccatgatattgtcaatcgtcagcctgttccccttatgtctcagtactacatctcagaaaaccacttggctgccggtgcttctgggctccttggggtgcaagcctctcacaatgtttctgattaccgaaaacaagatctggggaaggaaaagctggccactaaatgagggtattatggctgtaggcatcgtgtcgatactgctttcatctctcctgaagaacgacgtccccttggcggggcctttaatcgccggaggcatgctgattgcatgttatgttatcagtggttccagcgctgatctctctctggaaaaagccgccaaggtgagctgggaggaggaagctgagcactccggggcatcacataatattcttgtggaaatccaggacgatggaacgatgaaaataaaggacgaggaacgagatgacactattaccatcctgttgaaagccacactactggcgatcagtggcgtctaccccatgagcattccagctaccctcttcgtgtggcacttttggcaaaagaagaaacagcgctctggcgttctgtgggatacaccttcacccccagaggtagagaaggccgtgcttgacgacgggatatatcggatcttacagagaggactgctcggtaggagccaggtcggcgtgggggttttccaagaaggagtgttccacactatgtggcatgtcacccgtggcgcagtgttgatgtaccagggtaaacgcctggagccgagttgggccagcgtaaagaaagatctcatttcctatgggggaggctggcggtttcagggctcttggaacacgggggaagaggtccaggtgatcgctgttgagcctggaaagaatcccaagaacgtgcaaacagcaccaggtattttcaaaacttcggaaggcgaggtcggggccatcgcgctggactttaagcccggaaccagcggctcacctatagtgaatagagaaggtaaaatcgttgggctttacggaaacggcgtggtcacaacctccggcacttacgtgagtgctattgcccaggcaaaggcctctcaggaggggccactgcccgaaatcgaggatgaggtattcaggaaacgaaatttgaccattatggacctacaccctggaagcggtaagacacggcgctatctgccggctatcgtgagagaagccataaagaggaaactccggacgttagttctggcaccaactcgagtcgtggcttccgagatggccgaagcgcttaagggcatgcccattagataccaaaccacagccgtgaaatcagagcataccgggaaggaaatcgtcgatctgatgtgccacgcaacttttacaatgcgcctcttgtctcctgtaagggtgccaaactataatatgatcattatggacgaggctcatttcaccgatcccgccagcatcgctgcacgtggatacataagtacgcgggttggcatgggtgaggccgccgctatttttatgactgcgacacctccggggtccgtggaagcattcccccagagcaacgccgtcatccaggacgaggaaaaagatattccagagagatcttggaactcaggatatgactggatcaccgattttcctggcaagaccgtgtggttcgttccctccataaagagtggcaacgacattgctaattgtctgaggaaaaacgggaagcgcgtgatccagctcagccgaaaaacttttgacacagaataccaaaagaccaaaaacaatgattgggactatgtcgtgacaactgatatctcggagatgggagccaacttcagagcagaccgggtaattgatccaaggcgctgcctgaagcctgtgatccttaaggacggtcccgagcgtgttattctagccggcccaatgccggtcacggtggcttctgcggcccagagacgggggaggataggacgcaatcagaacaaagaaggcgatcagtacatctacatgggtcaacctctgaataacgacgaggatcacgcacactggaccgaagctaagatgttgttagacaatattaacacacccgaggggatcatcccagccctgttcgagcccgaacgagagaaatccgcagccattgatggcgaatatagactccggggagaggctaggaagacttttgtggaactgatgcgcagaggcgaccttcctgtctggctgagctacaaagttgcctcagaggggttccagtatagtgataggcggtggtgctttgacggagagcgtaataaccaggtgctcgaagagaatatggacgtagaaatatggaccaaggagggtgaacgcaaaaagttgcgaccaagatggctggatgcgaggacatactctgaccccctagcactgcgggagttcaaggagtttgccgctggccgcagatccgtgagctcagatctcatccttgaaattgggaaactgcctcagcatttaacccaaagggcccagaacgctttggacaatctggtcatgctccacaacagtgagcagggaggcaaggcatatcggcatgccatggaagaactgccggatactatcgaaacgattatgcttctggctctcatcgccgtgttgaccggtggggttacactgttctttttaagcggccgaggactaggcaaaacttccatagggctgctctgtgtgacctctagctccgcacttctgtggatggcgaatgtcgagccacactggatcgccgcttcaattatcttggagttctttctgatggtactcctgattcccgaacctgacagacagcgcacaccccaagataaccagcttgcctacgtggttatcggactcctgttcatgatattgaccgtggcagctaacgagatgggtctgttagaaactacaaagaaagacctaggcattgggcacacggccgcagagaatcatcaccatgccgctatgctggatgtcgacctccacccagcgtctgcctggaccctttatgcagtggctactacaatcattacccctatgatgaggcataccatcgagaacacaactgccaatataagtctgacggccatggcaaaccaggctgccatcttgatgggactggataagggctggcccatttcgaagatggacatcggtgtcccactcctggcgcttgggtgctacagccaagtgaatcctttaaccctgacagctgccgttctcatgttggtggcacactacgccattatcggcccgggactgcaggctaaagcaactcgggaagcccagaagcgtaccgcggctggcataatgaaaaaccccacagtagatgggattgtggccatcgacctagacccagtcgtttatgatgcaaagtttgagaaacagctgggacaaatcatgctccttattctgtgtacctcccagatcttgctgatgagaactacgtgggccctctgcgaatctataacactggctaccggccctttaactaccctttgggagggttcacccgggaagttctggaatacaactattgccgtgagcatggcaaacatctttaggggatcctacctggctggcgccggtctcgcgttcagtctaatgaagtctctgggcgggggacgccggggcaccggggcccagggagaaacattgggcgagaaatggaagcgacagctgaatcaactcagcaaatcagagttcaacacgtataagagatccggtattatcgaagtcgacaggagtgaggcacgcgaagggcttaaacggggagagaccactaagcacgctgtgagcagaggcacagccaagctgcgttggtttgtagaaaggaatttggtgaaaccagagggtaaggttatagatctgggctgtgggcggggaggctggtcttactattgcgcagggctcaaaaaggtgaccgaggtcaaaggatacactaagggcggtcctgggcatgaggaacccatcccgatggctacatatggatggaacttagtgaaactgcactccggcaaggacgtcttctttattccacctgaaaagtgtgatacccttctgtgcgacatcggcgagtcaagccccaatccaacgattgaagaggggcgcaccctacgagtgctcaaaatggttgagccctggctgagaggaaaccagttctgtatcaagattttgaatccttacatgccgtcggtagtggaaacactggagcagatgcagaggaaacatggtggcatgctcgtccggaaccccctttctcgcaatagtactcacgaaatgtactgggtgtcctgcgggaccggaaacatcgttagcgccgtgaacatgacatcaagaatgctgttaaataggtttactatggcccaccgaaagccaacctatgagcgggatgtcgacctgggcgcgggtacacgtcatgtggctgtagagcctgaagtggcaaacttggatataattgggcaaagaatcgagaatatcaaaaacgaacacaagtccacctggcattacgacgaggataatccctataagacttgggcctaccacggatcttatgaagttaaacctagcggcagtgcttccagcatggtcaacggcgtggtgcgcctcctgacgaagccatgggacgtcattcccatggttacacagatagccatgaccgacactacccctttcgggcagcaaagggtgtttaaagagaaggtagatacacggacgccaaaagcaaagagaggaaccgcccagatcatggaggtgactgctaagtggctatggggtttcctttctcgcaataaaaagcccaggatttgtacacgagaagagtttacccggaaagtcagatcaaacgcggccatcggcgcagtgttcgttgacgaaaatcagtggaacagtgctaaggaggccgtggaagatgagaggttttgggacctggtccgccgtgagcgggaactccataaacaggggaagtgcgcaacttgcgtgtacaatatgatgggaaagagagagaaaaagctgggcgagttcggtaaagccaaggggtccagggctatttggtatatgtggttgggagcccgctttctggagttcgaagcgctcggcttcatgaacgaggatcactggtttagccgagaaaattctctttcgggcgtagaaggggagggactgcacaaattaggttacatcctgcgggacatatcaaagatcccgggcgggaacatgtacgcagatgacacagccggatgggataccagaattacagaagaggacttgcaaaatgaggctaaaatcactgatattatggaacctgagcatgccctcctggcaaccagcatcttcaagctaacgtatcagaacaaggttgtgagggtccagcgcccagctaaaaacggcaccgtgatggacgtgatatccagacgggatcagaggggtagtgggcaagtcggaacatacggccttaatacttttaccaacatggaagcccagctgattcgtcagatggagtctgaaggcatcttcagcccctccgagctcgagacacctaatctggctgggcgagttttggactggttagaaaagcacggaatcgagcgcctgagacggatggccatttcaggtgacgattgtgtggtaaaaccaatagacgataggtttgcaactgcgctcaccgcccttaacgacatgggcaaggtgcgcaaagatatcccccagtgggaaccgagtaaggggtggaatgactggcaacaggtccctttctgctctcatcactttcaccagctgattatgaaggatggaagagagatcgtggttccctgtcggaaccaggacgagctagtgggcagggctcgagtcagccaaggtgccgggtggtccctgcgtgagacggcatgcctcggaaaatcatatgctcagatgtggcagttgatgtacttccatagacgcgatctgcggcttgccgcaaatgccatttgtagcgcggtgccagtagactgggttcctacatctaggaccacttggtccatccacgctcatcaccaatggatgacaaccgaggatatgctgagtgtgtggaacagagtctggatagaagagaatccctggatggaagacaagactcatgtgagctcgtgggaggacgttccatatctcggcaaacgcgaagatcagtggtgcggctccttaatcgggctgaccgcccgggcaacatgggccacgaacattcaggtggctatcaatcaggtcaggcgattgattggaaacgagaattacctggactatatgacctctatgaagagatttaaaaacgagtcagatcccgaaggtgccctctggtga

SEQ ID NO: 14182 - RNA, 9879 nt, synthetic construct
  misc_feature 1..9879: note = derived and/or modified CDS sequence (opt3) from DENV-1__JQ915076__SS-prME
  source 1..9879: mol_type = other RNA
tccgtgaccatgctgctcatgcttctgcccaccgtcttgactttccacttaacgaccagaggaggggagcctcatatgatcgtttccaagcaggaaaggggaaaatctctgttatttaagacatcagccggtgtgaacatgtgcactctcattgctatggacctgggcgagctttgtgatgacaccatgacatacaaatgcccacggataaccgaaactgagccggatgacgtagattgttggtgcaatgcaacagaaacctgggtgacgtatgggacttgtagtcaaaccggagagcaccgccgagacaagcgtagcgtcgccctggcgccccatgtgggcttgggtctcgagacaagaactgaaacctggatgtcctctgagggggcttggaggcagatccagaaagttgaaacatgggccctgcggcaccctggattcaccgtgattgcactgtttctcgcccatgctatcggcacgtcgattactcagaagggcatcatattcatcttactgatgcttgtcacaccatcaatggcaatgcgctgcgtggggattggaaacagagattttgttgagggtttgagcggcgccacctgggttgacgtggtcctggagcacgggagttgtgtgactacaatggctaaggataaacccaccttggacatcgaactcctgaagacggaggtgaccaatcctgccgtccttaggaaactgtgcattgaagcgaagatctccaacacaactaccgattctcggtgtccaacacaaggagaggcaactttggttgaggaacaagacaccaatttcgtgtgccgccgaacatttgtagatagaggctggggtaacgggtgtggactcttcggcaaaggcagcctgataacctgcgccaagtttaagtgcgtgactaaattagaggggaagattgtccagtacgaaaatctgaaatattccgtgatcgttacggtgcacacaggagaccagcatcaagtcggtaacgagaccactgaacacggcaccattgctacaatcacaccccaggcccctacttcagagatccagctcacagactacggggcacttacgctggattgtagtccaaggaccggattggacttcaatgaaatggtgctactgactatgaaggagaaaagctggctcgtacataagcagtggtttctggatcttccgctgccctggacaaccggcgcttctacatcccaagagacttggaaccggcaggacttgctcgttaccttcaaaacggcccacgcgaagaagcaggaagtggtcgtgctgggttcacaagagggggccatgcacaccgcattaacaggcgctactgaaattcagaccagcggaacaactaccatatttgccggccatctgaaatgccgtctaaagatggataaactcacgctgaaggggatgagttatgtcatgtgtacaggatctttcaaacttgagaaggaagtggctgagacccagcacggtactgttttggtgcaggtaaagtacgagggcacagacgccccttgcaaaatcccattctccagccaagatgaaaagggggtcacccagaatggacgcctggtgactgcaaaccccattgttaccgacaaagagaagcctgtgaatatcgaagccgagccaccctttggcgagtcgtatatagtcgtgggtgctggggaaaaagcgctcaagctgtcttggttcaagaaaggctcctcaattggaaagatgtttgaggcaacagccagaggcgctaggcggatggccatccttggggatacggcatgggacttcggaagtatcggtggcgtatttaccagcgtggggaaactggttcatcagattttcggaactgcctacggcgtcttgttttccggtgtgtcttggacaatgaagatcgggattggcatactcctgacctggttaggactgaacagccgatcaacaagtctatccatgacttgtatcgctgtgggcatggtcaccctctacctgggggttatggtgcaggccgatagcggatgcgtgattaattggaaaggccgcgaacttaagtgtggttctgggatcttcgtaacgaacgaggtccacacatggaccgaacaatataagtttcaggcagactcaccgaaaagattgagtgcggctatcggaaaggcctgggaggagggcgtgtgcggtattaggagcgcaactcggctggaaaacataatgtggaaacagatctccaatgagctcaaccatattctgttagaaaatgacatgaagttcaccgttgtggtcggcgatgtgtctgggatcctggcccagggcaagaagacaattcgccctcaacccatggagcacaaatactcgtggaaaagctggggcaaggctaaaatcataggggccgacgttcagaacactacctttatcattgatggaccaaatacacctgaatgtcccgacgatcagagagcatggaacatctgggaggtggaggactatggcttcggtatttttacgaccaatatctggcttaagttgagggattcctacactcaggtatgcgaccaccgtctcatgtcagctgccataaaagatagtaaggcggtccatgccgacatggggtattggattgaatctgagaaaaacgaaacatggaagctggctcgggccagcttcatcgaggtgaagacctgtgtgtggccaaaatcccacactctatggtcaaatggagtcctggaaagcgagatgattatccccaagatatacggcggtcctatctctcaacataactatcgaccaggctacttcacacagaccgcagggccgtggcacctcggaaaactggagcttgattttgacttgtgcgaaggcacgactgttgtggtagatgagcactgcgggcatagaggaccctccctgaggaccacaaccgtgactggcaagattatccacgaatggtgttgccgcagttgtacattacctccactccggttcaaaggtgaggacgggtgctggtacggaatggagattagacccgtcaaggaaaaggaggaaaatctggtgaaaagcatggtttctgctggctccggtgaggtggactcatttagtcttggcctgttgtgtatcagcataatgattgaagaggtcatgaggtcgcgctggtcccgaaagatgctcatgaccgggacactggtggttttcctactgctcactctgggacagcttacctggaacgatttgatccggctgtgcatcatggtgggcgccaatgcatctgacaacatggggatgggaacgacatatttagcgctcatggccacctttcgtatgagacctatgttcgctgtcggcctgctttttaggcgcctgactagccgggaggtactactcctgaccgtgggtttgtcactggttgccagtgtggaattaccaaattccctcgatgagctgggggacggacttgcaatgggcattatgatcctgaaattgctcacagatttccaatctcatcagctgtgggctactctactgagccttacctttgtcaagacgacactctccctgcactacgcctggaaaaccatggcaatgattttgtcaatagtgagcctgttacccctctgtctgagtactacatctcagaagaccacttggcttccggtactgttgggctccctcgggtgcaagcctctgacaatgttcctaatcaccgaaaacaaaatttggggaagaaagagctggccactgaacgagggtatcatggccgtgggcattgtctcgatccttctctcatctctgttgaaaaatgacgttcccttagctgggcctctgatagcgggaggcatgctcatcgcctgttatgtgattagtggttccagcgcagatctgtctcttgaaaaggctgccaaagtgagctgggaggaggaagccgagcattccggggcttcacacaacatcctggtcgaaattcaggacgatggaacgatgaagatcaaagacgaggaaagggatgacactataaccattttgctaaaggcaacactgctcgccatcagtggcgtgtaccccatgagcatcccagcgaccctgtttgtttggcacttctggcaaaagaaaaagcagcgatctggcgtactttgggatacaccttcacccccggaggtggagaaagctgtcttagacgacgggatttatcgcatactgcagcggggactcttgggtagaagccaggtgggcgttggggtgtttcaagaaggagtcttccatactatgtggcacgtgaccaggggcgccgtactgatgtaccagggtaagcgtctcgagccgagttgggcaagcgtcaaaaaggatctgatctcctatgggggaggctggcgcttccagggctcttggaatacgggggaagaggtgcaggttattgccgtggagcctggaaagaaccccaaaaatgtccaaacagctccaggtacttttaagacctcggaaggcgaggtgggggcaatcgcccttgacttcaaacccggaacaagcggctcacctattgttaaccgggaaggtaagatcgtggggctgtacggaaatggcgtcgtgaccacttccggcacctacgtaagtgcgatagctcaggccaaaacatctcaggaggggccattgcccgaaatcgaggatgaggtgtttagaaagaggaacctaacgattatggacctgcatcctggaagcggtaagactcgacggtatctcccggcaatcgttcgcgaagccattaaaagaaagttaaggaccctggtccttgctccaacacgggtggtggcctccgagatggcagaagctctgaaaggcatgcccatccgataccaaaccactgccgtcaagtcagagcacacagggaaagaaatagtagatctcatgtgccatgcgaccttcacgatgagattgctgtctcctgtgcgcgttccaaattataacatgattatcatggacgaggcccactttactgatcccgcaagcatcgctgccaggggatacattagtacacgtgtgggcatgggtgaggctgcagccatcttcatgaccgccacccctccggggtccgtcgaggcttttccccagagcaatgcggtgatacaggacgaggaaaaggatattccagagcggtcttggaactcaggatatgactggatcactgatttccctggcaagacagtttggtttgtgccctccattaaaagtggcaatgacatcgcaaactgtctcagaaagaatgggaaaagggtcatacagctgagccgcaagaccttcgacacagaataccagaaaactaagaacaacgattgggactatgtggtaacgaccgatatttcggagatgggagccaattttcgagctgacagagtgatcgatccacggaggtgccttaagcctgttatcctaaaagacggtcccgagcgcgtcattctggccggcccaatgccggtgacagtggcatctgccgctcagcgtagagggcggatcggaaggaaccagaataaggaaggcgatcagtacgtctacatgggtcaacctttgaacaatgacgaggatcacgcgcattggactgaagccaaaatgttactggacaacattaatacccccgaggggataatcccagcactcttcgagcccgaacgcgagaagtccgctgccattgatggcgaatatcgactgagaggagaggcacggaaaacattcgttgaacttatgaggcgcggcgacctgcctgtgtggctcagctacaaggtagcctcagaggggtttcagtatagtgatagaaggtggtgcttcgacggagagcggaacaatcaggtgttggaagagaacatggacgtcgaaatctggaccaaagagggtgaacgtaagaagctgcgcccacgatggctagatgctagaacttactctgaccccctggccctcagggagtttaaagagttcgcggcaggccggcgctccgtgagcggggatcttatcctggaaattggaaagttacctcagcacttgacgcaaagagcccagaatgctctggacaacctcgttatgctgcataattcagagcagggcggtaaagcctataggcacgctatggaggaacttccggataccatagaaacaatcatgctgctcgcattgattgccgtgctgactgggggcgtcaccttatttttcctaagtggacggggcctggggaagacaagcatcggactcctttgtgtaacctcctctagcgctctgttgtggatggcctccgtggagccacactggattgcagcgtcaatcatactggagtttttcctcatggttctgcttatccccgaacctgaccgacagagaactccccaagataaccagctcgcctacgtggtcattggtctgttgtttatgatcctgacagtggctgccaatgagatgggcttactagaaacgaccaaaaaggacctggggattggacatactgcagctgagaaccaccatcacgccgcaatgctcgatgtcgaccttcatccagcctctgcttggacactgtatgcggtggccaccaccatcataacacctatgatgcgccacactattgagaacacgaccgcaaatatcagtttgacagctattgccaaccaggccgcaatcctgatgggcctcgataagggttggcccatatcgaaaatggacatcggggttccactgcttgctttaggctgctacagccaagtgaatcctctgactctcaccgccgcggtattgatgctggtggctcactacgccattatcggaccgggcctacaggcaaaggccacaagggaagctcagaaacggaccgcagccgggattatgaagaaccccactgtcgatggaatcgttgcgatagacctggacccagtggtctatgatgctaaattcgagaagcagctcggccaaattatgcttctgatcttgtgtacgtcccagatcctgctcatgcgtacaacctgggccctgtgcgaatctattactttagcaaccggtcctcttacaactctgtgggaggggtcacccggaaagttttggaataccacaatcgccgtgagcatggctaacatattcagaggctcctacctcgccggtgcaggcctagcttttagtctgatgaaatctctagggggaggcaggcgcgggacgggagcccagggcgaaaccctgggtgagaagtggaaacggcagctcaatcaacttagcaagtcagagttcaacatttataaacgatccgggatcattgaagtagacagaagtgaggcgaaggaaggactgaagaggggcgagactacaaaacatgccgtgagccgcggtaccgcaaagttgcggtggttcgttgaaagaaatctggtgaaaccagagggcaaggtcatcgatctcgggtgtggacgtggcgggtggtcttactattgcgctggactaaagaaggtgactgaggtcaaaggctacacaaagggtgggcctggacacgaggaacccataccgatggccacctatggctggaacctggtgaaacttcattccggcaaagacgtatttttcatcccacctgaaaagtgtgatacgctgctatgcgacattggggagtcaagccccaatccaaccatcgaagagggaaggacactccgggtactgaaaatggtggagccctggttgcgcggtaaccagttttgtattaagatcctgaatccttacatgccgtcggtcgtggaaactctcgagcagatgcagcgaaaacacggcgggatgcttgttagaaaccccctgtctaggaatagtacccacgaaatgtactgggtgtcctgcggaacaggcaacattgtcagcgcagtgaatatgacttcacggatgttactgaaccgcttcaccatggctcatagaaagccaacatatgagagggatgtagacttgggtgccgggacccgacacgtggccgttgagcctgaagtcgcgaacctcgatatcataggacaacggattgagaatatcaagaacgaacataaatccacttggcactacgacgaggataatccctataagacgtgggcttaccatggctcttatgaagtgaaacctagcggcagtgcatccagcatggtgaacggggtcgttcgtctgctaacaaagccatgggacgtgatccccatggtaacccagattgccatgactgacaccacaccttttggacagcaaagagtgttcaaagagaaggtcgatacgcgcaccccaaaggctaaaaggggtactgcccagataatggaggtgacagcaaagtggctttggggctttctgtctcggaataaaaagcccagaatctgtacccgcgaagagttcactaggaaagttcgatcaaacgccgctattggggcggtgtttgtcgacgaaaatcagtggaacagtgccaaggaggcagtggaagatgagcggttctgggacctcgtaagaagggagcgcgaactgcacaagcagggaaaatgcgctacatgcgtttacaatatgatgggcaagcgtgagaaaaagttgggtgaatttgggaaagccaagggatcccgggcaatctggtatatgtggctgggcgccagattcctcgagtttgaagctcttggcttcatgaacgaggatcactggttcagcagggaaaattctctgtcgggggtggaaggagagggtttacataaactgggctacattttgcgcgacatctcaaagataccagggggaaacatgtacgccgatgacaccgcgggctgggatacacgaatcactgaagaggacctccaaaatgaggcaaagattaccgatatcatggaacctgagcacgccctgctagctacgagcatttttaaacttacctatcagaacaaggtcgtgcgggtgcagagaccagccaaaaatggtacagtcatggacgttatctccaggcgcgatcagagagggagtggacaagtgggcacttacggcctgaacaccttcacaaacatggaagcacagctcatacggcagatggagtctgaagggatttttagcccctccgagctggagactcctaatttggctggaagggtattagactggctggaaaagcatggtatcgagcgtctccgacgcatggccatctcaggcgacgattgtgtggtcaaaccaattgacgatagattcgctaccgcccttacggcactgaacgacatggggaaggtgcggaaggatataccccagtgggaaccgagtaaaggatggaatgactggcaacaggttcctttttgctctcaccacttccatcagctaatcatgaaggatggcagggagattgtggtcccctgtcgcaaccaggacgaactggtgggtagagcgcgggtaagccaaggggccggatggtccctcagggagacagcttgcttgggcaaatcatatgcccagatgtggcagctgatgtactttcaccgacgtgatcttagactggcagctaatgccatctgtagcgcagttccagtggactgggtccctacctctcgcactacatggtccattcatgcccaccatcaatggatgaccactgaggatatgctcagtgtgtggaaccgggtttggatcgaagagaatccctggatggaagacaagacccacgtgagctcgtgggaggacgtcccatatttaggcaaaagggaagatcagtggtgcgggtccctgataggattgacagcgagagctacgtgggccaccaacatccaggtggcaattaatcaggtacgccggctgatcggtaacgagaattacctcgactatatgacttctatgaagaggttcaagaacgagtcagatcccgaaggcgccctttggtga

SEQ ID NO: 14183 - RNA, 9879 nt, synthetic construct
  misc_feature 1..9879: note = derived and/or modified CDS sequence (opt3) from DENV-1__KF289072__SS-prME
  source 1..9879: mol_type = other RNA
agcgtgaccatgctgctcatgcttctgcccactgcattggctttccacttaactacgagaggaggggagcctcatatgatcgtctccaagcaggaaagaggaaaatctctgttgtttaagacctcagccggtgttaacatgtgcacactcattgccatggacctgggagagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggttgacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaagggggtgtcttatgtcatgtgtacaggatccttcaaattggagaaggaagtggctgagactcagcacggtaccgttctggtgcaggtaaagtacgagggcacggatgcgccttgcaaaataccaatcagcacacaagacgaaaagggggtcacccagaacggacgcctcattactgcaaatcccatcgtgacagataaagagaagcctgttaacatagaaaccgagccacccttcggcgagtcgtatattgtgatcggtgccggggaaaaagctctgaaactttcttggtttaagaaaggctcctcaatcggaaagatgttcgaggccactgcaagaggcgccaggcggatggctattctgggggacaccgcctgggattttggaagtatcggtggcgtcttcacaagcgtggggaaattggtacatcaggtgtttggaacggcatacggcgttctcttctccggtgtctcttggaccatgaagattgggataggcatcctgttaacttggctgggactaaatagccgatcaacaagtctctccatgacctgtattgcggtgggcatggtgacactgtaccttggggtcatggttcaggctgacagcggatgcgtgatcaactggaaaggccgcgaattgaagtgtggttctgggatctttgtgactaacgaggtacacacctggacggaacaatataagttccaggccgattcaccgaaaagactgagtgcagccattggaaaggcttgggaggagggcgtctgcggtataaggagcgccacacggctcgaaaatatcatgtggaaacagatttccaacgagctgaatcatatcttactggaaaacgacatgaagtttaccgtggttgtgggcgacgcaaatgggattcttactcagggcaagaaaatgatccgccctcaacccatggagcacaaatactcttggaagtcgtggggcaaggctaaaataatcggggccgatacccagaacacaactttcattatcgacggaccagatacccctgaatgtcccgacgatcagagagcgtggaatatttgggaggtcgaggactatggctttggtgtgttcacaacgaacatctggttgaagctcagggatagctacacccagatgtgcgaccaccgtctgatgtccgccgctataaaagattcaaaggcagttcatgccgacatggggtattggattgaaagtgagaaaaatgaaacttggaagctagctcgggcctcttttatcgaggtgaagacatgtatttggccacgaagccacaccctgtggtccaacggagtactcgaatcagagatgatcatacccaaaatctacggcggtcctattagccaacataattatagaccaggctacttcactcagacagcagggccgtggcacctgggaaaacttgagttggatttcaacctgtgcgaaggcaccacggtcgtggtggacgagcactgcgggaataggggaccctctttacgcactaccacagtcaccggcaaaatcattcatgaatggtgttgccggtcctgtactctccctccactgagatttaagggtgaggatgggtgctggtacggaatggagatcaggcccgttaaagaaaaggaggaaaaccttgtgcgcagtatggtaagcgcgggctctggtgaggtggactccttctcactgggcttgctctgtgtcagtataatgattgaagaggtgatgcgaagccggtggtcgcgtaagatgctgatgacagggaccctagccgtatttttcctgctcatcatgggacagctgacatggaatgaccttatcagattgtgcattatggtgggcgctaacgtctccgataggatggggatgggaactacctatctggccttaatggcaacgtttaaaatgcgccctatgttcgctgtgggcctcctgtttcggagacttacatctagggaggttctgctactcaccatcggtctgagcttggtggcctcagtcgaactgccaaacagtttagaggaactcggggacggactggcaatgggcattatgatgcttaagctgttgactgatttccaatcccaccagctctggaccacactgctatctctgacttttataaaaaccacgcttagcctcgactacgcctggaagacaatggctatggtactgtccatcgtgtcattgttccccctgtgtttaagcaccacaagtcagaaaacaacctggctcccggttctgcttggctcttttgggtgcaagcctctgactatgttcttgattacagagaataagatctggggacgaaaatcctggccactcaacgaaggtattatggcggtgggcatcgtcagcatactgctatcgtcactgcttaagaatgatgtgcccctcgccgggcctctgatcgcaggaggcatgttgattgcttgttatgtaatctctggtagttccgccgacttaagcctggagcgcgccgctgaggtgtcttgggaagaggaagcagagcatagcggggcctcccacaacattctcgtcgaagttcaggatgacggaaccatgaaaatcaaggatgaggagcgggacgatacgctgactatacttctgaaagcgaccttgctagctgtgtcaggcgtgtaccccatgagtattccagccacactgtttgtctggtatttctggcaaaagaaaaagcagagaagcggcgtgctctgggacaccccttctcccccagaagttgagagggcagtactggatgacgggatctaccgtatccttcagcgcggattactgggtcggtcccaggtgggcgtcggggtgttccaagacggagtttttcatacaatgtggcacgtgactagaggcgccgtcctcatgtatcagggtaagaggttggaaccgtcatgggctagtgtgaaaaaggatctgattagctacgggggaggctggcgattccagggctcctggaataccggggaggaggtacaggtcatagcagtggaacctggcaagaaccccaagaatgttcaaacgacaccaggtacttttaaaacccccgagggcgccgtgggggcgatcgctctcgacttcaagcctggaacatctggctcgccaattgtcaaccgggaaggtaagatcgtggggctgtacggaaatggcgttgtgaccactagcggcacctatgtctcagccattgcacaggccaaggcttcccaggaggggccccttcctgaaatcgaggatgaggtgtttaagaaacgcaacctgacaataatggacttgcacccgggaagtggtaagacgagaaggtacctaccagccatcgtacgggaagcaattaaacgaaagctgagaactctcatcttagctcccacccgcgtggttgcctctgagatggcggaagccctgaagggcatgcctattaggtatcaaacaaccgcagtcaaaagcgagcatactgggaaggaaatcgtggatcttatgtgccacgctacattcaccatgcgtctgctctccccagtgcgggtccccaattacaacatgataattatggacgaggcccattttacggatcctgcttcaatcgcagccagaggatatatctctactagggtaggcatgggtgaggccgctgcgattttcatgacagcaaccccgcccgggagcgtggaagcctttccacagagtaatgctgttatccaggacgaggaacgcgatatacctgagcgatcctggaacagcggatacgactggattaccgatttccccggcaaaactgtgtggtttgtcccatctatcaagtcaggcaatgacattgccaactgtttgaggaagaacgggaagcgggtgatccagctgtccaggaagacattcgacaccgaatatcagaaaactaagaataacgattgggactacgttgtgactacggatataagtgagatgggagcaaatttccgcgccgaccgtgtcattgatcctagacggtgcctcaaacccgtgatcctgaaggacggtccagagagggtaatccttgctggcccgatgcctgtgaccgcggccagcgcagctcaacgccgagggagaattggacggaaccagaataaagaaggcgatcagtacatctatatgggtcaacccctaaacaatgacgaggatcacgcccattggacagaagcaaagatgctgttggacaacattaatactccagaggggataatccccgccttatttgagcctgaaagggagaagtcggctgccattgatggcgaataccgcctgagaggagaggcgaggaaaaccttcgttgaactcatgcggcgtggcgacctgccagtctggctttcttataaggtggcatccgaggggtttcagtacagcgatcgccgatggtgcttcgacggagagagaaacaatcaggtgctggaagagaacatggacgtcgaaatctggacaaaagagggtgaaaggaagaaactccggccccgctggttggatgccagaacctattcagaccctctggctctaagggagtttaaggagttcgccgctggccggcgaagtgtttctggggatctgatcctcgaaattggaaaacttccgcagcacctgactttaagagcacaaaatgccttggacaacctggtgatgctccacaattccgagcagggcggtaaggcttaccgccatgccatggaggaactgccagatacgatagaaacccttatgctgctcgcattgatcgcggtactgacagggggcgtgactttatttttcctaagcggaaagggcctggggaaaacctcaattggactcctttgtgtcatggccagtagcgtgctgttgtggatggcttccgttgagccccactggatcgccgcatctattatcctggagtttttcctcatggtgctgcttatacctgaacccgacaggcagcggacaccacaggataaccaactcgcttatgtcgtaatcggtctgttgtttatgattctgaccgtggccgcaaacgagatgggcttactagaaactacaaagaaagacctggggatcggacatgttgtggccgagaatcaccaccatgctacgatgctcgatattgaccttcaccctgcgagcgcctggaccctgtacgcagtcgctactacaatcataacccccatgatgcgtcataccattgagaacacaactgccaatatctccttgacggccattgcaaaccaggctgccatcctgatgggcctcgataagggttggccaatatcaaaaatggacatcggggtgcctctgcttgcgttaggctgctactctcaggtcaatccgctgaccctcacagctgccgtgttgatgctggttgcacactatgccattatcggacccggcctacaagctaaggcaactagagaagcccagaagaggaccgcggctgggattatgaaaaacccaacagtggatggaatcgtagccatagacctggaccctgtggtctacgatgcaaagttcgagaaacagctcggccagattatgcttctgatcttgtgtaccagtcaaatcctgctcatgcgcactacgtgggccctgtgcgaatcgattacattagctaccggtccccttactaccctgtgggaggggagcccaggacggttttggaatacaactatcgccgtttccatggcaaacatattccgaggctcttatctcgctggtgccggcctagcgttctcactgatgaaaagcctagggggaggcagaagggggaccggagcccagggcgaaacactgggtgagaaatggaagcgccagctcaatcagctttccaagagtgagtttaacacgtacaaacggtctgggattatggaagtggacagaagcgaggcaaaggaaggactgaaacgtggcgagaccactaagcatgctgtctcaaggggtacagccaaattgcggtggttcgtggaacgcaatctggtaaagcctgagggcaaggtgatcgatctcgggtgtggacgaggcgggtggtcctattactgcgcaggactgaaaaaggttaccgaggtgaaaggctatactaagggtgggcccggacacgaggaaccgattccaatggctacatacggctggaacatcgtcaaactacacagtggcagagacgtgtttttcacccctcccgaaaagtgtgatacgcttctgtgcgacataggggagagctctccaaatcccaccatcgaagagggaaggacactacgggtcctcaaaatggtggagccttggctgcgcggtaaccaattttgtattaagatcttgaatccgtacatgccctccgttgtagaaactctggagcagatgcagagaaagcatggcgggatgctcgtgaggaacccactttcacgaaatagcacccacgaaatgtattgggtctcgtgcggaacaggcaacattgtgtctgccgttaacatgacaagtcggatgctgttaaatcgtttcaccatgacacatagaaaacctacctacgagcgcgatgtggacctgggtgccgggactaggcacgtcgcggtggagcccgaaatcgctaacttggatattatcggacagcggatagagaatattaagaacgaacacaaatccacgtggcattatgacgaggataatccttacaagacatgggcatatcacggcagctacgaagtaaaaccatcaggctccgcctctagcatggtgaacggggttgtcagactcctgaccaagccctgggacgtgatccctatggtgactcaaatcgctatgaccgacacaacgccatttggacagcagcgcgtcttcaaggagaaagttgataccaggactccccgaccgaagcggggtacagcccaaattatggaggtgaccgcaaaatggctatggggctttcttagtagaaataagaaacctaggatatgtactcgcgaagagttcacacgtaaggtacggtccaacgccgctatcggggcggtgtttgtcgacgaaaatcagtggaacagcgccaaggaggcagtggaagatgagagattctgggacctggttcatagggagcgcgaactccacaaacagggaaagtgcgctacctgcgtgtataatatgatgggcaaacgagagaagaaactgggtgaatttgggaaggccaagggatctcgggcaatttggtacatgtggttgggcgccagattcctggagttcgaagctctcggctttatgaacgaggatcattggttctcaagggagaatagtctttccggggtcgaaggagagggtctgcacaaattaggctacatcctgcgcgacattagcaagatcccagggggaaacatgtatgccgatgacacagcgggctgggatactagaataaccgaagacgatttgcagaatgaggcaaaaatcacggacattatggagcccgaacacgccctcctggctacctctatctttaagctaacataccaaaacaaagtggtacgggttcagaggcctgccaagtcgggtactgtgatggatgtcatttcacgtcgagaccagcgcgggagcggacaggtgggcacctatggccttaacacattcactaatatggaggtgcaactgatcagacagatggaatccgaggggatatttagtccatctgaactcgagaacagcaatctggcagagcgggtcttggactggttagaaaaacatggagttgagaggctgaagcgcatggctatttccggtgatgactgtgtggtaaagcccaccgatgacagattcgccacggctctcacagcccttaacgatatgggcaaagtgcggaaggacatcccgcagtgggaaccttcaaaagggtggaatgattggcagcaagtccccttttgcagtcaccatttccaccagctgatcatgaaggacggaagggagattgtggttccatgtcgaaaccaggatgagttagtgggccgtgcaagagtctctcagggtgcggggtggagcctgcgcgagaccgcctgcctcggaaaatcctacgctcaaatgtggcagttgatgtattttcaccggagggacctgagacttgccgcaaatgctatatgttcagccgtgcctgtagattgggttcccactagccgcacaacctggtctatccatgcacaccatcagtggatgactaccgaggacatgctgtccgtgtggaaccgggtctggattgaagagaatccatggatggaagacaagacacacgtgagtagctgggaggatgttccctacctcggcaagagggaagaccaatggtgcggctcgttaatcgggctgacggcccgagcgacctgggctactaacattcaggtggccatcaatcaggtcagacggttgataggaaacgagaattatctggattacatgacatccatgaaaaggttcaagaacgagtctgactcagaaggtgcactctggtga

SEQ ID NO: 14184 - RNA, 9879 nt, synthetic construct
  misc_feature 1..9879: note = derived and/or modified CDS sequence (opt3) from DENV-1__JQ692085__SS-prME
  source 1..9879: mol_type = other RNA
agcgtgaccatgctgctcatgcttctgcccacagcattggctttccacttaactacgagaggaggggagcctcatatgatcgtctccaagcaagaaaggggaaaatctctgctatttaagacctcagccggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggttgacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaggaacaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaagggggtgtcttatgtcatgtgtacaggatccttcaaattggagaaggaagtggctgagactcagcacggtaccgttctggtgcaggtaaagtacgagggcacggatgcgccttgcaaaataccaatcagcacacaagacgaaaagggggtcacccagaacggacgcctcattactgcaaatcccatcgtgacagataaagagaagcctgttaacatagaaaccgagccacccttcggcgagtcgtatattgtgatcggtgccggggaaaaagctctgaaactttcttggtttaagaaaggctcctcaatcggaaagatgttcgaggccactgcaagaggcgccaggcggatggctattctgggggacaccgcctgggattttggaagtatcggtggcgtcttcacaagcgtggggaaattggtacatcaggtgtttggaacggcatacggcgttctcttctccggtgtctcttggaccatgaagattgggataggcatcctgttaacttggctgggactaaatagccgatcaacaagtctctccatgacctgtattgcggtgggcatggtgacactgtaccttggggtcatggttcaggctgacagcggatgcgtgatcaactggaaaggccgcgaattgaagtgtggttctgggatctttgtgactaacgaggtacacacctggacggaacaatataagttccaggccgattcaccgaaaagactgagtgcagccattggaaaggcttgggaggagggcgtctgcggtataaggagcgccacacggctcgaaaatatcatgtggaaacagatttccaacgagctgaatcatatcttactggaaaacgacatgaagtttaccgtggttgtgggcgacgcaaatgggattcttactcagggcaagaaaatgatccgccctcaacccatggagcacaaatactcttggaagtcgtggggcaaggctaaaataatcggggccgatacccagaacacaactttcattatcgacggaccagatacccctgaatgtcccgacgatcagagagcgtggaatatttgggaggtcgaggactatggctttggtgtgttcacaacgaacatctggttgaagctcagggatagctacacccagatgtgcgaccaccgtctgatgtccgccgctataaaagattcaaaggcagttcatgccgacatggggtattggattgaaagtgagaaaaatgaaacttggaagctagctcgggcctcttttatcgaggtgaagacatgtatttggccacgaagccacaccctgtggtccaacggagtactcgaatcagagatgatcatacccaaaatctacggcggtcctattagccaacataattatagaccaggctacttcactcagacagcagggccgtggcacctgggaaaacttgagttggatttcaacctgtgcgaaggcaccacggtcgtggtggacgagcactgcgggaataggggaccctctttacgcactaccacagtcaccggcaaaatcattcatgaatggtgttgccggtcctgtactctccctccactgagatttaggggtgaggatgggtgctggtacggaatggagatccgccccgttaaggaaaaagaggaaaaccttgtgcgaagtatggtaagcgcgggctctggtgaggtggactccttctcactgggcttgctctgtgtcagtataatgattgaagaggtgatgcggagccgttggtcgagaaagatgctgatgacagggaccctagccgtatttttcctgctcatcatgggacagctgacatggaatgaccttatcaggttgtgcattatggtgggcgctaacgtctccgatcgcatggggatgggaactacctatctggccttaatggcaacgtttaagatgcggcctatgttcgctgtgggcctcctgtttagaaggcttacatctcgagaggttctgctactcaccatcggtctgagcttggtggcctcagtcgaactgccaaacagtttagaggaactcggggacggactggcaatgggcattatgatgcttaaactgttgactgatttccaatcccaccagctctggaccacactgctatctctgacttttataaagaccacgcttagcctcgactacgcctggaaaacaatggctatggtactgtccatcgtgtcattgttccccctgtgtttaagcaccacaagtcagaagacaacctggctcccggttctgcttggctcttttgggtgcaaacctctgactatgttcttgattacagagaataagatctggggacgcaagtcctggccactcaacgaaggtattatggcggtgggcatcgtcagcatactgctatcgtcactgcttaaaaatgatgtgcccctcgccgggcctctgatcgcaggaggcatgttgattgcttgttatgtaatctctggtagttccgccgacttaagcctggagcgggccgctgaggtgtcttgggaagaggaagcagagcatagcggggcctcccacaacattctcgtcgaagttcaggatgacggaaccatgaagatcaaagatgaggagagagacgatacgctgactatacttctgaaggcgaccttgctagctgtgtcaggcgtgtaccccatgagtattccagccacactgtttgtctggtatttctggcagaagaagaaacagaggagcggcgtgctctgggacaccccttctcccccagaagttgagcgtgcagtactggatgacgggatctaccgcatccttcagcggggattactgggtagatcccaggtgggcgtcggggtgttccaagacggagtttttcatacaatgtggcacgtgactaggggcgccgtcctcatgtatcagggtaagcgattggaaccgtcatgggctagtgtgaagaaagatctgattagctacgggggaggctggcggttccagggctcctggaataccggggaggaggtacaggtcatagcagtggaacctggaaagaaccccaaaaatgttcaaacgacaccaggtacttttaagacccccgagggcgccgtgggggcgatcgctctcgacttcaaacctggaacatctggctcgccaattgtcaaccgcgaaggtaagatcgtggggctgtacggaaatggcgttgtgaccactagcggcacctatgtctcagccattgcacaggccaaggcttcccaggaggggccccttcctgaaatcgaggatgaggtgtttaaaaagagaaacctgacaataatggacttgcacccgggaagtggtaaaacgaggcggtacctaccagccatcgtacgagaagcaattaagagaaaactgcgcactctcatcttagctcccaccagggtggttgcctctgagatggcggaagccctgaagggcatgcctattcgttatcaaacaaccgcagtcaagagcgagcatactgggaaagaaatcgtggatcttatgtgccacgctacattcaccatgcggctgctctccccagtgagagtccccaattacaacatgataattatggacgaggcccattttacggatcctgcttcaatcgcagccaggggatatatctctactcgcgtaggcatgggtgaggccgctgcgattttcatgacagcaaccccgcccgggagcgtggaagcctttccacagagtaatgctgttatccaggacgaggaacgagatatacctgagagatcctggaacagcggatacgactggattaccgatttccccggcaagactgtgtggtttgtcccatctatcaaatcaggcaatgacattgccaactgtttgcggaagaacgggaaaagggtgatccagctgtcccgcaagacattcgacaccgaatatcaaaagactaagaataacgattgggactacgttgtgactacggatataagtgagatgggagcaaatttccgtgccgacagagtcattgatcctcggaggtgcctcaagcccgtgatcctgaaagacggtccagagcgcgtaatccttgctggcccgatgcctgtgaccgcggccagcgcagctcagcgaagagggcggattggaaggaaccagaataaggaaggcgatcagtacatctatatgggtcaacccctaaacaatgacgaggatcacgcccattggacagaagcaaaaatgctgttggacaacattaatactccagaggggataatccccgccttatttgagcctgaacgcgagaagtcggctgccattgatggcgaatacagactgaggggagaggcgcggaagaccttcgttgaactcatgcgtcgcggcgacctgccagtctggctttcttataaagtggcatccgaggggtttcagtacagcgatcgaagatggtgcttcgacggagagaggaacaatcaggtgctggaagagaacatggacgtcgaaatctggacaaaggagggtgaacggaaaaagctccgccccagatggttggatgccaggacctattcagaccctctggctctacgggagtttaaagagttcgccgctggccgaagaagtgtttctggggatctgatcctcgaaattggaaaacttccgcagcacctgactttacgcgcacaaaatgccttggacaacctggtgatgctccacaattccgagcagggcggtaaggcttacaggcatgccatggaggaactgccagatacgatagaaacccttatgctgctcgcattgatcgcggtactgacagggggcgtgactttatttttcctaagcggaaagggcctggggaagacctcaattggactcctttgtgtcatggccagtagcgtgctgttgtggatggcttccgttgagccccactggatcgccgcatctattatcctggagtttttcctcatggtgctgcttatacctgaacccgaccggcagcgtacaccacaggataaccaactcgcttatgtcgtaatcggtctgttgtttatgattctgaccgtggccgcaaacgagatgggcttactagaaactactaaaaaggacctggggatcggacatgttgtggccgagaatcaccaccatgctacgatgctcgatattgaccttcaccctgcgagcgcctggaccctgtacgcagtcgctactacaatcataacccccatgatgagacataccattgagaacacaactgccaatatctccttgacggccattgcaaaccaggctgccatcctgatgggcctcgataaaggttggccaatatcaaagatggacatcggggtgcctctgcttgcgttaggctgctactctcaggtcaatccgctgaccctcacagctgccgtgttgatgctggttgcacactatgccattatcggacccggcctacaagctaaagcaactagggaagcccagaagcgcaccgcggctgggattatgaagaacccaacagtggatggaatcgtagccatagacctggaccctgtggtctacgatgcaaaattcgagaagcagctcggccagattatgcttctgatcttgtgtaccagtcaaatcctgctcatgcggactacgtgggccctgtgcgaatcgattacattagctaccggtccccttactaccctgtgggaggggagcccaggacgattttggaatacaactatcgccgtttccatggcaaacatattcagaggctcttatctcgctggtgccggcctagcgttctcactgatgaaaagcctagggggaggcaggcgcgggaccggagcccagggcgaaacactgggtgagaagtggaaacggcagctcaatcagctttccaagagtgagtttaacacgtacaagagatctgggattatggaagtggaccgtagcgaggcaaaagaaggactgaagaggggcgagaccactaaacatgctgtctcacggggtacagccaagttgcgctggttcgtggaacgaaatctggtaaaacctgagggcaaggtgatcgatctcgggtgtggaagaggcgggtggtcctattactgcgcaggattaaagaaagttaccgaggtgaagggctatactaaaggtgggcccggacacgaggaaccgattccaatggctacatacggctggaacatcgtcaagctgcacagtggcagggacgtgtttttcacccctcccgaaaaatgtgatacgcttctgtgcgacataggggagagctctccaaatcccaccatcgaagagggacggacactacgcgtcctcaagatggtggagccttggctgagaggtaaccaattttgtattaaaatcttgaatccgtacatgccctccgttgtagaaactctggagcagatgcagaggaagcatggcgggatgctcgtgcgaaacccactttcacggaatagcacccacgaaatgtattgggtctcgtgcggaacaggcaacattgtgtctgccgttaacatgacaagtcgtatgctgttaaatagattcaccatgacacatcgcaagcctacctacgagagggatgtggacctgggtgccgggactcggcacgtcgcggtggagcccgaaatcgctaacttggatattatcggacagagaatagagaatattaaaaacgaacacaagtccacgtggcattatgacgaggataatccttacaaaacatgggcatatcacggcagctacgaagtaaagccatcaggctccgcctctagcatggtgaacggggttgtccgcctcctgaccaaaccctgggacgtgatccctatggtgactcaaatcgctatgaccgacacaacgccatttggacagcagagggtcttcaaggagaaggttgatacccgaactccccggccgaaaagaggtacagcccaaattatggaggtgaccgcaaagtggctatggggctttcttagtaggaataaaaagcctcgcatatgtactcgtgaagagttcacacggaaagtaagatccaacgccgctgtgggggcggtctttgtggacgaaaatcagtggaacagcgccaaggaggcagttgaagatgagaggttctgggacctggtgcatcgcgagcgagaactccacaagcagggaaaatgcgctacctgcgtctataatatgatgggcaagcgggagaaaaagctgggtgaatttgggaaagccaagggatctagagcaatctggtacatgtggttgggcgccaggttcctggagttcgaagctctcggctttatgaacgaggatcattggttctcacgcgagaatagtctttccggggtggaaggagagggtctgcacaagttaggctacattctgagagacatcagcaaaattccagggggaaacatgtatgccgatgacacagcgggctgggatactcggatcaccgaagacgatttgcagaatgaggcaaagataacggacatcatggagcccgaacacgccctcctggctacctctatttttaaactaacataccaaaacaaggtagttagggtgcagcgtcctgccaaatcgggtactgtcatggatgtgatctcacgacgcgaccagagagggagcggacaggtgggcacctatggccttaacacattcactaatatggaggtccaactgattcggcagatggaatccgaggggatctttagtccaaacgaactcgaaaattctaacctggcagagagggttttggactggttagaaaagcatggagtggagcgcctgaaaagaatggctataagcggtgatgactgtgtagtgaagcccaccgatgaccggttcgccacggctctcacagcccttaatgatatgggcaaggtcaggaaagacattccgcagtgggaaccttccaaggggtggaacgattggcagcaagtgcccttttgctcacaccatttccaccagctgatcatgaaagacggacgagagatcgttgtgccatgtcgtaatcaggatgagttggtcggcagagcacgcgtgagtcagggtgcggggtggtctctgcgggagaccgcctgcctcggaaagagctacgctcaaatgtggcagttgatgtattttcacaggagagacctgcgccttgccgcaaacgctatttgttccgccgtacctgttgattgggtgcccacttcacggacaacctggagcatacatgcacaccatcagtggatgactaccgaggacatgctgtctgtctggaatagggtgtggatcgaagagaacccatggatggaagacaaaacacacgtttccagttgggaggatgtgccctacctcggcaagcgagaagaccaatggtgcggcagcttaattgggctgacggccagagcgacctgggctactaatatccaggtcgccattaaccaggtgcggaggttgatcggaaatgagaactatctggattacatgacatcgatgaagcgcttcaaaaatgagtccgactctgaaggtgcactctggtga

SEQ ID NO: 14185 - RNA, 9879 nt, synthetic construct
  misc_feature 1..9879: note = derived and/or modified CDS sequence (opt3) from DENV-1__JQ917404__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaagggggtgtcttatgtcatgtgtacaggatccttcaaattggagaaggaagtggctgagactcagcacggtaccgttctggtgcaggtaaagtacgagggcacggatgcgccttgcaaaataccaatcagcacacaagacgaaaagggggtcacccagaacggacgcctcattactgcaaatcccatcgtgacagataaagagaagcctgttaacatagaaaccgagccacccttcggcgagtcgtatattgtgatcggtgccggggaaaaagctctgaagctttcttggtttaagaaaggctcctcaatcggaaagatgttcgaggccactgcaagaggcgccaggcggatggctattctgggggacaccgcctgggattttggaagtatcggtggcgtcttcacaagcgtggggaaattggtacatcaggtgtttggaacggcatacggcgttctcttctccggtgtctcttggaccatgaagattgggataggcatcctgttaacttggctgggactaaatagccgatcaacaagtctctccatgacctgtattgcggtgggcatggtgacactgtaccttggggtcatggttcaggctgacagcggatgcgtgatcaactggaaaggccgcgaattgaagtgtggttctgggatctttgtgactaacgaggtacacacctggacggaacaatataagttccaggccgattcaccgaaaagactgagtgcagccattggaaaggcttgggaggagggcgtctgcggtataaggagcgccacacggctcgaaaatatcatgtggaaacagatttccaacgagctgaatcatatcttactggaaaacgacatgaagtttaccgtggttgtgggcgacgcaaatgggattcttactcagggaaaaaagatgatccgccctcaacccatggagcacaaatactcttggaagtcgtggggcaaggctaaaataatcggggccgatacccagaacacaactttcattatcgacggaccagatacccctgaatgtcccgacgatcagagagcgtggaatatttgggaggtcgaggactatggctttggtgtgttcacaacgaacatctggttgaagctcagggatagctacacccagatgtgcgaccaccgtctgatgtccgccgctataaaagattcaaaggcagttcatgccgacatggggtattggattgaaagtgagaaaaatgaaacttggaagctagctcgggcctcttttatcgaggtgaagacatgtatttggccacgaagccacaccctgtggtccaacggagtactcgaatcagagatgatcatacccaaaatctacggcggtcctattagccaacataattatagaccaggctacttcactcagacagcagggccgtggcacctgggaaagcttgagttggatttcaacctgtgcgaaggcaccacggtcgtggtggacgagcactgcgggaataggggaccctctttacgcactaccacagtcaccggcaaaatcattcatgaatggtgttgccggtcctgtactctccctccactgagatttaggggtgaggatgggtgctggtacggaatggagatccgccccgttaaggaaaaagaggaaaaccttgtgcgaagtatggtaagcgcgggctctggtgaggtggactccttctcactgggcttgctctgtgtcagtataatgattgaagaggtgatgcggagccgttggtcgagaaagatgctgatgacagggaccctagccgtttttttcctgctcatcatgggacagctgacatggaatgaccttatcaggttgtgcattatggtgggcgctaacgtctccgatcgcatggggatgggaactacctatctggccttaatggcaacgtttaagatgcggcctatgttcgctgtgggcctcctgtttagaaggcttacatctcgagaggttctgctactcaccatcggtctgagcttggtggcctcagtcgaactgccaaacagtttagaggaactcggggacggactggcaatgggcattatgatgcttaaactgttgactgatttccaatcccaccagctctggaccacactgctatctctgacttttataaagaccacgcttagcctcgactacgcctggaaaacaatggctatggtactgtccatcgtgtcattgttccccctgtgtttaagcaccactagtcagaagacaacctggctcccggttctgcttggctcttttgggtgcaaacctctgactatgttcttgattacagagaataagatctggggacgcaagtcctggccactcaacgaaggtattatggcggtgggcatcgtcagcatactgctatcgtcactgcttaaaaatgatgtgcccctcgccgggcctctgatcgcaggaggcatgttgattgcttgttatgtaatctctggtagttccgccgacttaagcctggagcgggccgctgaggtgtcttgggaagaggaagcagagcatagcggggcctcccacaacattctcgtcgaagttcaggatgacggaaccatgaagatcaaagatgaggagagagacgatacgctgactatacttctgaaggcgaccttgctagctgtgtcaggcgtgtaccccatgagtattccagccacactgtttgtctggtatttctggcaaaaaaagaaacagaggagcggcgtgctctgggacaccccttctcccccagaagttgagcgtgcagtactggatgacgggatctaccgcatccttcagcggggattactgggtagatcccaggtgggcgtcggggtgttccaagacggagtttttcatacaatgtggcacgtgactaggggcgccgtcctcatgtatcagggtaagcgattggaaccgtcatgggctagtgtgaagaaagatctgattagctacgggggaggctggcggttccagggctcctggaataccggggaggaggtacaggtcatagcagtggaacctggaaagaaccccaaaaatgttcaaacgacaccaggtacttttaagacccccgagggcgaagtgggggccatcgcgctcgacttcaaacctggaacatctggctcgccaattgtcaaccgcgagggtaagatcgtggggctgtacggaaatggcgttgtgaccactagcggcacctatgtctcagctattgcccaggcaaaggcctcccaggaagggccccttcctgagatcgaggatgaagtgtttaaaaagagaaacctgacaataatggacttgcacccgggaagtggtaaaacgaggcggtacctaccagctatcgtacgagaggccattaagagaaaactgcgcactctcatcttagcacccaccagggtggttgcttctgaaatggccgaggcgctgaagggcatgcctattcgttatcaaacaaccgccgtcaagagcgaacatactgggaaagagatcgtggatcttatgtgccacgcaacattcaccatgcggctgctctccccagtgagagtccccaattacaacatgataattatggacgaggctcattttacggatcctgcctcaatcgctgcaaggggatatatctctactcgcgtaggcatgggtgaagccgccgctattttcatgacagcgaccccgcccgggagcgtggaggcatttccacagagtaatgccgttatccaggacgaagagcgagatatacctgaaagatcctggaacagcggatacgactggattaccgatttccccggcaagactgtgtggtttgtcccatctatcaaatcaggcaatgacattgctaactgtttgcggaagaacgggaaaagggtgatccagctgtcccgcaagacattcgacaccgagtatcaaaagacaaaaaataacgattgggactacgttgtgactacggatataagtgagatgggagccaatttccgtgcagacagagtcattgatcctcggaggtgcctcaagcccgtgatcctgaaagacggtccagaacgcgtaatccttgccggcccgatgcctgtgaccgctgcgagcgccgcacagcgaagagggcggattggaaggaaccagaataaggagggcgatcagtacatctatatgggtcaacccctaaacaatgacgaagatcacgctcattggacagaggccaaaatgctgttggacaacattaatactccagaggggataatccccgcattatttgaacctgagcgcgaaaagtcggccgctattgatggcgagtacagactgaggggagaagcccggaagaccttcgttgagctcatgcgtcgcggcgacctgccagtctggctttcttataaagtggcgtccgaggggtttcagtacagcgatcgaagatggtgcttcgacggagaaaggaacaatcaggtgctggaggaaaacatggacgtcgagatctggacacgggaaggtgagcgcaagaaactcagacccaggtggttggatgcacggacctattcagaccctctggccctacgagagtttaaggaattcgctgccggcagacgcagtgtttctggggatctgatcctcgagattggaaaacttccgcagcacctgactttaagggctcaaaatgcattggacaacctggtgatgctccacaattccgaacagggcggtaaggcctaccggcatgctatggaggaactgccagatacgatagagacccttatgctgctcgccttgatcgcagtactgacagggggcgtgactttatttttcctaagcggaaaaggcctggggaagacctcaattggactcctttgtgtcatggcgagtagcgtgctgttgtggatggcctccgttgagccccactggatcgctgcctctattatcctggaatttttcctcatggtgctgcttatacctgagcccgaccgtcagagaacaccacaggataaccaactcgcatatgtcgtaatcggtctgttgtttatgattctgaccgtggctgccaacgaaatgggcttactagagactacaaagaaagacctggggatcggacatgttgtggcagagaatcaccaccatgccacgatgctcgatattgaccttcaccctgctagcgcgtggaccctgtacgccgtcgcaactacaatcataacccccatgatgaggcataccattgaaaacacaactgctaatatctccttgacggccattgccaaccaggcagctatcctgatgggcctcgataagggttggccaatatcaaaaatggacatcggggtgcctctgcttgccttaggctgctactctcaggtcaatccgctgaccctcacagcggctgtgttgatgctggttgcccactatgcaattatcggacccggcctacaagccaaggctactcgcgaggcacagaaacggaccgccgcggggattatgaagaacccaacagtggatggaatcgtagctatagacctggaccctgtggtctacgatgccaagttcgaaaaacagctcggccagattatgcttctgatcttgtgtaccagtcaaatcctgctcatgcgaactacgtgggcactgtgcgagtcgattacattagccaccggtccccttactaccctgtgggaagggagcccaggaagattttggaatacaactatcgctgtttccatggccaacatattcaggggctcttatctcgcaggtgctggcctagccttctcactgatgaagagcttggggggaggccgccgggggaccggagcgcagggcgagacactgggtgagaaatggaagagacagctcaatcagctttccaaaagtgaatttaacacgtacaagcgttctgggattatggaggtggacaggagcgaagccaaggagggactgaaacggggcgaaaccactaagcatgcagtctcacgcggtacagctaaattgcgatggttcgtggagagaaatctggtaaagcctgagggcaaagtgatcgatctcgggtgtggaaggggcgggtggtcctattactgcgccggattaaagaaggttaccgaagtgaaaggctatactaagggtgggcccggacacgaggaaccgattccaatggcaacatacggctggaacatcgtcaaactgcacagtggccgggacgtgtttttcacccctcccgagaagtgtgatacgcttctgtgcgacataggggaaagctctccaaatcccaccatcgaggagggacgcacactaagagtcctcaaaatggtggaaccttggctgaggggtaaccaattttgtattaagatcttgaatccgtacatgccctccgttgtagagactctggaacagatgcagcgaaaacatggcgggatgctcgtgcggaacccactttcacgtaatagcacccacgagatgtattgggtctcgtgcggaacaggcaacattgtgtctgctgttaacatgactagtagaatgctgttaaatcgcttcaccatggcccataggaagcctacatacgagcgggatgtggacctgggtgccgggaccagacacgtcgcggtggaacccgagatcgctaacttggatattatcggacagcgcatagaaaatattaagaacgagcacaaatccacttggcattatgacgaagataatccttacaagacgtgggcatatcacggcagctacgaggtaaaaccatcaggctccgcctctagcatggtgaacggggttgtcaggctcctgacaaagccctgggacgtgatccctatggtgacccaaatcgctatgactgacaccacaccatttggacagcagcgagtcttcaaagagaaggttgatacgcggacccccagaccgaagaggggtactgcccaaattatggaagtgacagcaaaatggctatggggctttcttagtcgcaataagaaacctcgtatatgtacccgggaggaattcactagaaaggtaaggtccaacgccgctatcggggcggtgtttgtcgacgagaatcagtggaacagcgccaaagaagcagtggaggatgagcgcttctgggacctggttcatcgagaacgggagctccacaagcagggaaagtgcgctacatgcgtgtataatatgatgggcaaaagagaaaagaaactgggtgagtttgggaaggccaaaggatctagggcaatttggtacatgtggttgggcgcccgcttcctggaattcgaggctctcggctttatgaacgaggatcattggttctcaagagaaaatagtctttccggggtcgagggagaaggtctgcacaagttaggctacatcctgcgggacattagcaagatcccagggggaaacatgtatgccgatgacaccgcgggctgggatacaaggataactgaggacgatttgcagaatgaggcaaaaatcaccgacattatggaacccgagcacgccctcctggctacgtctatctttaagctaacctaccaaaacaaagtggtacgtgttcagcgacctgccaagtcgggtacagtgatggatgtcatttcacgcagagaccagcgggggagcggacaggtgggcacttatggccttaacaccttcacaaatatggaagtgcaactgatcaggcagatggagtccgaagggatatttagtccatctgagctcgagaacagcaatctggcagaacgcgtcttggactggttagagaaacatggagttgaaagactgaagcggatggctatttccggtgatgactgtgtggtaaaacccactgatgacaggttcgccaccgctctcacggcccttaacgatatgggcaaggtgcgaaaggacatcccgcagtgggagccttcaaaagggtggaatgattggcagcaagtccccttttgcagtcaccatttccaccagctgatcatgaaggacggacgtgaaattgtggttccatgtagaaaccaggatgagctagtgggccgcgcacgggtctctcagggtgcggggtggagcctgagggagacagcctgcctcggaaaatcctacgctcaaatgtggcagttgatgtattttcacagacgcgacctgcggcttgccgcaaatgctatatgttcagccgtgcctgtaaactgggttcccaccagcaggactacatggtctatccatgcacaccatcagtggatgaccactgaagatatgctgtccgtgtggaatcgagtctggattgaggaaaacccatggatggaggacaagacccacgtgagtagctgggaagacgttccctacctcggcaaaagagaggatcaatggtgcggctcgttaatcgggctgacagcccgggcgacgtgggctaccaatattcaggtggccatcaaccaggtcaggcgcttgataggaaatgagaactatctggactacatgacttccatgaagcgtttcaagaatgaatctgatcctgagggtgcactctggtga

SEQ ID NO: 14186 - RNA, 9879 nt, synthetic construct
  misc_feature 1..9879: note = derived and/or modified CDS sequence (opt3) from DENV-1__GU370048__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactcttacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaagcagagattttgtggagggtttgagtggcgcgacttgggtagacgttgtgctggagcacgggtcctgtgtcacaaccatggcaaaggataaacccactctagacatcgaactcctgaagacagaggtgaccaaccctgccgtgcttaggaaactgtgcattgaagctaagatctctaatacgaccacagatagccggtgtccaactcaaggagaggccaccttggtcgaagagcaggacgcaaacttcgtttgccgccgaacatttgtggatagaggctggggtaatgggtgtggactcttcggcaaaggctccctgataacttgcgctaagtttaagtgcgtaaccaaattagaggggaagattgtgcagtacgaaaacctgaaatattcagtcatcgtgacagttcacaccggagaccagcatcaagtgggtaatgagagtactgaacacggcacgacagccaccattactccccaggcgcctaccacagagatccagctcaccgactacggggcccttactctggattgtagcccaaggacaggattgaacttcaatgaaatggtcctactgacgatgaaggagaaatcttggctcgtgcataagcagtggtttctggaccttccgctgccctggacctccggcgcatcaactacacaagagacctggaaccggcaggatttgctcgtaacattcaaaactgctcacgccaagaagcaggaagttgtggtcctgggtagccaagagggggctatgcacaccgccttaacgggcgcaaccgaaatccagacaagtggaactaccacaatttttgccggccatctgaaatgccgtctaaagatggacaaactcactctgaaggggatgtcttatgtgatgtgtaccggatccttcaaacttgagaaggaagtcgctgagacgcagcacggtacagtgttggttcagataaagtacgagggcaccgatgcgccttgcaaaatcccattcagcactcaagacgaaaagggggtgacacagaatggacgcctgattaccgcaaaccccatcgtaactgataaagagaagcctgtcaatatagaagccgagccaccctttggcgagtcgtatattgtgatcggtgctggggaaaaagccctcaagctgtcttggttcaagaaaggctcctcaatcggaaagatgtttgaggcaaccgccagaggcgctaggcggatggccattcttggggacacagcatgggatttcggaagtatcggtggcgtttttacgagcgtggggaaactggtccatcagattttcggaaccgcgtacggcgtgttgttttccggtgtatcttggactatgaagatagggatcggcgtgctcctgacatggttaggactgaacagccgatcaaccagtctatccatgacatgtattgctgttggcctcgtcactctgtaccttggggtgatggtgcaggccgacagcggatgcgtcatcaattggaaaggccgcgaattgaagtgtggttctgggatcttcgttaccaacgaggtgcacacgtggacagaacaatataagtttcaggcagattcaccgagaaggctgagtgccgctattggaaaagcctgggaggagggcgtgtgcggtatacggagcgcaacccgcctcgaaaacatcatgtggaagcagatttccaatgagctgaaccatatcttactggaaaatgacatgaaattcactgtagtcgtgggcgacgttgctgggattcttgcccagggaaagaaaatgatcagacctcaacccatggagcacaagtactcttggaaatcgtggggcaaggcgaagataatcggggccgatgtgcagaacaccacatttattatcgacggaccaaatactcctgaatgtcccgatgaccagagggcttggaacatttgggaggtcgaggattatggcttcggtatctttaccacaaatatatggttgaaactccgtgacagctacacgcaggtgtgcgatcaccggctgatgtccgcagccattaaggactcaaaagctgttcatgccgatatggggtattggatcgaaagtgagaagaacgaaacctggaaactagcacgagcgtctttcattgaggtgaagacttgtatctggccaaagagccacacactgtggtccaatggagtactcgaatcagagatgataatccccaaaatttacggcggtcctatcagccaacataactatagaccaggctacttcacccagactgccgggccgtggcacctgggaaagcttgagttggactttgatctgtgcgaaggcacaaccgtcgtggtggacgagcactgcgggaataggggaccctctttacgcacgactaccgtcacaggcaaaattatccatgaatggtgttgccggtcctgtaccctccctccactgagattcaggggtgaggatgggtgctggtacggaatggagatacgccccgttaaggaaaaagaggaaaaccttgtgaagagtatggtaagcgctggctctggtgaggtggactccttttcactgggcttgctctgtattagtatcatgatcgaagaggtcatgcgaagccggtggtcgcgtaagatgctgattactgggacactagccgtgttctttctgctcatcatgggacaggttacctggaatgacctgattagactttgcataatggtgggcgcaaacgcttccgataggatggggatgggaacaacttatttggccctgatggcaaccttcaaaatgcgccctatgtttgccgtcggcttactcttccggagactgacgtctagggaggtgcttctgctaacaatcggtctcagcctggttgcttcagtggaattgccaaatagtctggaggaattaggggacggactcgcgatgggcattatgatcctgaagcttctgaccgattttcaaccccaccagttgtgggccactctcctgtccctaaccttcattaaaacaactttttctctgcattacgcatggaagaccatggctatggtccttagcatcgtatccctcttcccgctgtgtttgtcaacgacaagccagaaaaccacttggctgcctgtgttactcggcagtctggggtgcaagccacttacaatgtttctgatagccgagaacaagatctggggacgaaaatcttggcccttgaacgaaggtattatggccgttggcatcgtgtccattctcctgagctcgctactgaagaatgacgtccctcttgctgggcccctcatcgcaggaggcatgctgatagcctgttatgtgatttcaggttctagtgcggatttgtccttagagaaagctgccgaggtaagctgggaagaggaagcagagcactctggggccagccataacatcctggtggaagtccaggacgatggaaccatgaagatcaaagacgaggagcgcgatgacactctcacaattctgcttaaggctaccctgttggcagtttccggcgtgtacccactatcaatacctgccacgctgttcgtgtggtatttctggcaaaaaaagaagcagcggagtggcgtcctctgggatactcccagcccaccggaagtggagagagcggttctggacgatgggatctacaggattatgcagcgtggacttttaggtcgctctcaggtaggcgtgggggtctttcaagaaaatgtgttccacaccatgtggcacgttacacggggagctgtgctgatgtatcagggcaaaagactcgagccttcctgggcctcagtcaagaaagacttgatcagttacggtgggggatggaggctgcagggcagctggaacaccggcgaggaagtgcaggtaattgcagtcgagcccgggaagaatccaaaaaacgtgcaaacagcccccggaacttttaagacccctgaaggtgaggttggcgctatcgccctcgacttcaagccagggacgtccggatctcccatagtgaatcgagaaggcaaaatcgtcggtctgtacgggaacggagtggttacaacttcgggcacctatgtgagcgcaattgctcaggccaaggcgtcacaggagggccctcttccggagatcgaagatgaggtctttcggaaacgcaatctgacaattatggacttgcatccagggtccggaaagaccagaaggtacctacccgccatcgtgcgggaagcaataaaacgaaagctgagaactctcattttagctcctacccgcgtagtggccagtgagatggctgaagcactgaagggtatgccaatcaggtatcaaacaacggccgttaaatctgagcacactggcaaggagatcgtcgatcttatgtgccatgccaccttcacaatgcgtctgctcagccccgtgcgggtgcctaactacaatatgattatcatggacgaagctcactttaccgatccgtcctcaatagcggcaagagggtatatttctactagggtcggaatgggcgaggccgctgccatcttcatgacagcaacccccccaggtagcgtagaagcctttcctcagagtaacgctgtgattcaggacgaggaacgcgatatccccgagcgatcctggaatagcgggtacgagtggataacggacttcccaggaaaaactgtttggtttgtgccttctattaagtcaggcaacgatatcgcgaattgtttgagaaaaaacggcaagcgggtcatccagctgtccaggaagacattcgacaccgaatatcaaaaaaccaagaacaatgattgggactacgtggttactacagacattagtgagatgggggccaacttccgcgcagatcgtgtgatcgaccccagacggtgcctcaaaccagtcattctgaaggatggaccggaaagggtgatacttgctggtcctatgcccgtaaccgtggccagcgcagcccagcgccgaggcagaatcgggcggaatcataacaaagagggagaccagtacatttatatgggccagccactaaataacgatgaggaccacgctcactggacagaagccaagatgctgttggataatatcaacactcccgagggtatcattcctgcgttatttgaaccagagagggaaaagtcggcagccatagacggggagtaccgcctgagaggcgaggctaggaaaacgttcgttgaactcatgcggcgtggagatctgcccgtctggctttcttataaggtggcctccgagggctttcaatacagcgaccgccgatggtgcttcgatggggaaagaaataaccaggtgctggaggaaaatatggacgtcgagatctggaccaaagagggagaaaggaagaaactccggcctcgctggttggatgctagaacatattcagacccgctggcactaagggagtttaaggaattcgccgctggtcggcgaagtgtttctggcgacctgattctcgagatcgggaaacttccacagcatctgactcagagagcccaaaacgcattagataatttggtgatgctgcacaactccgaacagggaggccgcgcgtacaggcatgccatggaggagctccccgacaccattgaaacactgatgcttctggctctcatcgccgtattgaccggtggggtgactctgtttttcttaagcggccggggactaggcaagacgtcaatagggctgctctgtgtcatggcaagtagcgtgcttctgtggatggcttccgttgagcctcactggatcgccgcatctattatcttggaatttttcctgatggtgctcctgattcccgagccagatcgtcagagaacccctcaggacaatcaacttgcctatgtcgtaatcggactcctgtttatgatattgacagtggctgcgaacgagatgggtctgttagaaactaccaagaaagatctaggcattgggcacgttgccgtggagaaccatcaccatgcagctatgctggacgtcgatctccaccccgccagcgcctggacactttacgcagtggctaccactatcattacaccaatgatgaggcatacgatcgaaaataccactgccaacatatccctgacagcgatcgctaatcaggccgcaattttgatgggactggacaagggctggcctatctcaaaaatggatattggtgtcccgctcctggcccttgggtgctactctcaggtgaaccccttaaccctgaccgctgcagttctcatgttggtggcccactatgcgatcataggcccaggactgcaagctaaggccacacgcgaggcacagaaacggactgccgctggcattatgaagaatcctacggtagacgggatcgtggccatcgatctagaccccgtcgtttacgatgcaaagttcgaaaaacagctgggacagattatgctccttatcctgtgtaccagtcaaatattgctgatgcgaacaacttgggctctctgcgagtcgattaccctggccacaggcccattaaccactctttgggagggtagccctgggaagttttggaacacgacaatcgcggtgtccatggccaatattttcagaggatcttatctggcaggcgctggtctcgccttctcactaatgaaaagcctgggcgggggaaggcgcggcaccggggcacagggagaaactttgggcgagaagtggaaacggcagctgaaccagctctccaagagtgaatttaatacctacaagagatctggtatcatggaggtcgaccgtagcgaagctaaagaggggcttaagaggggagagacaactaaacacgccgtgtcacggggcaccgccaagctgcgctggttcgtagaacgaaacttggtgaaacccgagggtaaggttatagacctgggctgtgggagaggaggctggtcctattactgcgcggggctcaagaaagtgacagaagtcaagggatatacgaaaggcggtccggggcatgaggaaccaatccctatggctacctacggatggaatttagtgaagctgcacagtggcaaagatgtctttttcattcccccagagaagtgtgacactcttctgtgcgatatcggcgagagctctcccaaccctacaattgaagaggggaggaccctacgggtgctcaaaatggttgaaccgtggctgcgcggaaatcaattttgtatcaagattttgaacccctacatgccatccgtagtggagactctggagcagatgcagagaaagcatggtggcatgctcgtcaggaatcctctttcacgaaacagcacacacgaaatgtattgggtgtcgtgcgggaccggaaatatcgtttctgcagtgaacatgacgagtcggatgctgttaaaccgtttcaccatggcccacagaaaacccacatacgagcgcgacgtcgatctgggcgctggtactaggcatgtggccgtagaacctgaggtggcaaatttggacataattgggcagcggatcgaaaacatcaagcacgagcataaatccacctggcactatgatgaggacaatccatacaagacatgggcctatcatggaagctacgaagttaaaccctcaggctccgcttctagcatggtcaacggcgtggtgaagctcctgactaagccttgggatgtcattccaatggttacccaaatagcgatgacagacaccactccctttgggcagcagagagtgttcaaagagaaggtagatacgcgcacaccgaaagccaagaggggaaccgcacaaatcatggaagtgactgctcgatggctatggggttttcttagtcggaataaaaagcctagaatttgtaccagggaggaattcacacgcaaggtccgttccaacgccgcaatcggcgccgtgtttgttgacgagaatcagtggaacagcgctaaagaggccgtggaagacgagcggttctgggatctggtccacagagaaagggagctccacaagcaggggaaatgcgcgacgtgcgtgtataatatgatgggaaagcgcgaaaaaaagctgggcgagtttggtaaggcaaaagggtctcgagccatttggtacatgtggttgggagctcggttcctggagttcgaagccctcggctttatgaacgaggaccattggttctcaagagaaaatagtctttccggcgtagagggggagggactgcacaagttaggttacatcctgagggatataagcaaaatcccaggcgggaacatgtatgcagacgataccgctggatgggacactcgcattacagaagatgacttgcagaatgaggccaagatcaccgatattatggaacccgagcatgctctcctggccaaagcaatctttaagctaacttaccaaaacaaagttgtgagagtccagcggcctgcgaagaatggcacagtgatggacgtgatatctaggcgtgatcagcgaggttcggggcaggtcggaacctatggccttaacacattcactaacatggaagcccaactgattcgccagatggagtcagagggcatctttagcccatccgaactcgagacccccaatctggctgaaagagttttgtactggttagagaagtatggggtggaacggctgaaaaggatggccatcagtggagacgattgtgtagtgaagccgattgacgaccgcttcgcaacggctctcaccgcccttaacgatatgggtaaagtcagaaaggacatacctcagtgggagccctctaaaggctggaatgattggcagcaagtgccattttgcagccaccacttccatcagctgatcatgaaggacgggcgggagattgttgtgccttgtaggaaccaggatgaactagtcggacgagcacgtgtgtcccagggcgccggttggtcactgagagagacagcgtgcctcgggaagagttacgctcaaatgtggcagttgatgtattttcaccgccgggacctgaggcttgccgcaaatgccatctgttctgctgtacccgttgattgggtgccaactagcagaaccacatggtccattcatgcccaccatcagtggatgactaccgaagacatgctgtcagtctggaaccgcgtgtggatcgaggaaaatccctggatggaggataaaacgcacataagctcttgggaggacgttccttacctcggaaagcgggaagatcaatggtgcggctccttaatcggcctgacagcaagggctacctgggccactaacattcaggtggcgatcaatcaggtccgaagattgattgggaacgagaattacctggactatatgacaagtatgaaacggttcaagaacgaaagcgacccagagggagctctctggtga

SEQ ID NO: 14187 - RNA, 9879 nt, synthetic construct
  misc_feature 1..9879: note = derived and/or modified CDS sequence (opt3) from DENV-1__KM403627__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaagggggtgtcttatgtcatgtgtacaggatccttcaaattggagaaggaagtggctgagactcagcacggtaccgttctggtgcaggtaaagtacgagggcacggatgcgccttgcaaaataccaatcagcacacaagacgaaaagggggtcacccagaacggacgcctcattactgcaaatcccatcgtgacagataaagagaagcctgttaacatagaaaccgagccacccttcggcgagtcgtatattgtgatcggtgccggggaaaaagctctgaagctttcttggtttaagaaaggctcctcaatcggaaagatgttcgaggccactgcaagaggcgccaggcggatggctattctgggggacaccgcctgggattttggaagtatcggtggcgtcttcacaagcgtggggaaattggtacatcaggtgtttggaacggcatacggcgttctcttctccggtgtctcttggaccatgaagattgggataggcatcctgttaacttggctgggactaaatagccgatcaacaagtctctccatgacctgtattgcggtgggcatggtgacactgtaccttggggtcatggttcaggctgacagcggatgcgtgatcaactggaaaggccgcgaattgaagtgtggttctgggatctttgtgactaacgaggtacacacctggacggaacaatataagttccaggccgattcaccgaaaagactgagtgcagccattggaaaggcttgggaggagggcgtctgcggtataaggagcgccacacggctcgaaaatatcatgtggaaacagatttccaacgagctgaatcatatcttactggaaaacgacatgaagtttaccgtggttgtgggcgacgcaaatgggattcttactcagggaaaaaagatgatccgccctcaacccatggagcacaaatactcttggaagtcgtggggcaaggctaaaataatcggggccgatattcagaacaccacattcatcattgacggaccagatactcctgaatgtcccgacgatcagagagcgtggaatatctgggaggtcgaggactatggctttggtgtgttcaccacaaacatatggttgaagctcagggatagctacacgcagatgtgcgaccaccgtctgatgtccgccgctattaaagattcaaaggcagttcatgccgacatggggtattggatcgaaagtgagaaaaatgaaacctggaagctagctcgggcctcttttattgaggtgaagacttgtatctggccacgaagccacacactgtggtccaacggagtactcgaatcagagatgataatccccaaaatttacggcggtcctatcagccaacataattatagaccaggctacttcacccagactgcagggccgtggcacctgggaaagcttgagttggatttcaacctgtgcgaaggcacaaccgtcgtggtggacgagcactgcgggaataggggaccctctttacgcacgactaccgtcacaggcaaaattatccatgaatggtgttgccggtcctgtaccctccctccactgagatttaggggtgaggatgggtgctggtacggaatggagatacgccccgttaaggaaaaagaggaaaaccttgtgcgaagtatggtaagcgcgggctctggtgaggtggactccttctcactgggcttgctctgtgtcagtattatgatcgaagaggtgatgcggagccgttggtcgagaaagatgctgatgactgggacactagccgtttttttcctgctcatcatgggacagctgacctggaatgaccttattaggttgtgcatcatggtgggcgctaacgtctccgatcgcatggggatgggaacaacttatctggccttaatggcaacctttaagatgcggcctatgttcgctgtgggcctcctgtttagaaggcttacgtctcgagaggttctgctactcacaattggtctgagcttggtggcctcagtcgaactgccaaacagtttagaggaactcggggacggactggcaatgggcataatgatgcttaaactgttgaccgatttccaatcccaccagctctggactaccctgctatctctgacatttatcaagactacccttagcctcgactacgcctggaaaacgatggctatggtactgtccattgtgtcattgttccccctgtgtttaagcacaaccagtcagaagactacatggctcccggttctgcttggctcttttgggtgcaaacctctgaccatgttcttgatcactgagaataagatttggggacgcaagtcctggccactcaacgaaggtatcatggcggtgggcatagtcagcatcctgctatcgtcactgcttaaaaatgatgtgcccctcgccgggcctctgattgcaggaggcatgttgatcgcttgttatgtaatttctggtagttccgccgacttaagcctggagcgggccgctgaggtgtcttgggaagaggaagcagagcatagcggggcctcccacaacatcctcgtcgaagttcaggatgacggaacaatgaagataaaagatgaggagagagacgataccctgacgattcttctgaaggcgactttgctagctgtgtcaggcgtgtaccccatgagtatcccagccaccctgtttgtctggtatttctggcaaaaaaagaaacagaggagcggcgtgctctgggacacaccttctcccccagaagttgagcgtgcagtactggatgacgggatctaccgcattcttcagcggggattactgggtagatcccaggtgggcgtcggggtgttccaagacggagtttttcataccatgtggcacgtgacaaggggcgccgtcctcatgtatcagggtaagcgattggaaccgtcatgggctagtgtgaagaaagatctgataagctacgggggaggctggcggttccagggctcctggaatactggggaggaggtacaggtcatcgcagtggaacctggaaagaaccccaaaaatgttcaaaccacgccaggtacatttaagactcccgagggcgaagtgggggccattgcgctcgacttcaaacctggaacctctggctcgccaatcgtcaaccgcgagggtaagattgtggggctgtacggaaatggcgttgtgacaaccagcggcacttatgtctcagctatcgcccaggcaaaggcctcccaggaagggccccttcctgagatagaggatgaagtgtttaaaaagagaaacctgaccatcatggacttgcacccgggaagtggtaaaacaaggcggtacctaccagctattgtacgagaggccatcaagagaaaactgcgcacgctcattttagcacccactagggtggttgcttctgaaatggccgaggcgctgaagggcatgcctatccgttatcaaaccacagccgtcaagagcgaacataccgggaaagagatagtggatcttatgtgccacgcaactttcacaatgcggctgctctccccagtgagagtccccaattacaacatgattatcatggacgaggctcattttaccgatcctgcctcaatcgctgcaaggggatatatttctacgcgcgtaggcatgggtgaagccgccgctatcttcatgactgcgacaccgcccgggagcgtggagagttttccacagtccaatgcagttatacaggacgaagagcgagatattcctgaaagaagctggaactctggatacgactggatcaccgatttccccggcaagaccgtgtggtttgtcccatcaattaaatccggcaatgacatcgccaactgtttgcggaagaacgggaaaagggtgatacagctgagtcgcaagactttcgacacagagtatcaaaagaccaaaaataacgattgggactacgttgtgacaactgatattagcgagatgggagctaatttccgtgccgacagagtcatcgatcctcggaggtgcctcaagcccgtgatcctgaaagacggtccagaacgcgtaattcttgcaggcccgatgcctgtgacggccgcttcggcggcccagcgaagagggcggatcggaaggaaccagaataaggagggcgatcagtacatttatatgggtcaacccctaaacaatgacgaagatcacgcacattggaccgaggctaaaatgctgttggacaacataaatacaccagaggggatcattcccgccttatttgaacctgagcgcgaaaagtctgcagccatcgatggcgagtacagactgaggggagaagctcggaagactttcgttgagctcatgcgtcgcggcgacctgccagtctggctttcctataaagtggccagcgaggggtttcagtactcagatcgaagatggtgcttcgacggagaaaggaacaatcaggtgctggaggaaaacatggacgtcgagatctggaccaaggaaggtgagcggaaaaagctccgccccagatggttggatgcgaggacatatagtgaccctctggcactacgggagtttaaagaattcgccgctggccgaagatctgtttccggggatctgattctcgagataggaaagcttccgcagcacctgaccttacgcgcccaaaatgctttggacaacctggtgatgctccacaatagcgaacagggcggtaaagcatacaggcatgccatggaggaactgccagatactatcgagacgcttatgctgctcgctttgattgccgtactgaccgggggcgtgacattatttttcctatcaggaaagggcctggggaagactagtatcggactcctttgtgtcatggcaagctccgtgctgttgtggatggcgtctgttgagccccactggattgccgctagcatcatactggaatttttcctcatggtgctgcttatccctgagcccgaccggcagcgtaccccacaggataaccaactcgcctatgtcgtaattggtctgttgtttatgatcctgacagtggcagctaacgaaatgggcttactagagaccactaaaaaggacctggggattggacatgttgtggccgagaatcaccaccatgcaacaatgctcgatatcgaccttcaccctgcctccgcttggacgctgtacgcggtcgccaccactataattacacccatgatgagacataccatcgaaaacaccacagcaaatatttcattgactgctatcgccaaccaggccgcaatactgatgggcctcgataaaggttggccaatctctaagatggacattggggtgcctctgcttgctttaggctgctacagtcaggtcaatccgctgacgctcaccgccgcggtgttgatgctggttgctcactatgccatcattggacccggcctacaagcaaaagccacaagggaggctcagaagcgcactgcagccgggatcatgaagaacccaaccgtggatggaatagtagcgattgacctggaccctgtggtctacgatgctaaattcgaaaagcagctcggccagatcatgcttctgatcttgtgtacatcgcaaattctgctcatgcggaccacttgggccctgtgcgagagcatcacgttagcaacaggtccccttaccactctgtgggaagggtccccaggaaaattttggaataccacaatagccgtttctatggctaacattttccgaggctcatatctcgccggtgcaggcctagctttcagcctgatgaagtccttggggggaggcagaagggggactggagcccagggcgagaccctgggtgagaaatggaagcgccagctcaatcagcttagtaagtctgaatttaacacatacaaacggagcgggatcatggaggtggacagatcagaagcgaaggagggactgaaacgtggcgaaacgaccaagcatgccgtctccaggggtactgcaaaattgcggtggttcgtggagcgcaatctggtaaagcctgagggcaaggtgattgatctcgggtgtggacgaggcgggtggagttattactgcgctggattaaaaaaggttacagaagtgaaaggctataccaagggtgggcccggacacgaggaaccgatcccaatggccacttacggctggaacatagtcaaactgcacagcggcagagacgtgtttttcacacctcccgagaagtgtgatacccttctgtgcgacatcggggaatcttccccaaatcccacgattgaggagggaaggaccctacgggtcctcaaaatggtggaaccttggctgcgcggtaaccaattttgtatcaagattttgaatccgtacatgccctcagttgtagagacactggaacagatgcagagaaagcatggcgggatgctcgtgaggaacccacttagccgaaattcgactcacgagatgtattgggtctcttgcggaaccggcaacatcgtgagtgcagttaacatgacatcccggatgctgttaaatcgtttcactatggctcatagaaaacctacctacgagcgcgatgtggacctgggtgccgggacaaggcacgtcgccgtggaacccgagattgcgaacttggatatcataggacagcggattgaaaatatcaagaacgagcacaaaagcacctggcattatgacgaagataatccttacaagacttgggcttatcacggctcatacgaggtaaaaccatccggctctgcaagcagtatggtgaacggggttgtcagactcctgacgaagccctgggacgtgatccctatggtgacacaaattgccatgaccgacactaccccatttggacagcagcgcgtcttcaaggagaaagttgatacaaggacgccccgaccgaagcggggtaccgctcaaataatggaagtgactgccaaatggctatggggctttctttccagaaataagaaacctaggatctgtacacgcgaggaattcacccgtaaggtacggagcaacgcagccattggggctgtgtttgtcgacgagaatcagtggaactctgcgaaggaagccgtggaggatgagagattctgggacctggttcatagggaacgcgagctccacaaacagggaaagtgcgcaacttgcgtgtataatatgatgggcaaacgagaaaagaaactgggtgagtttgggaaggctaagggatcacgggccatctggtacatgtggttgggcgcaagattcctggaattcgaggccctcggctttatgaacgaggatcattggttcagtagggaaaattcccttagcggggtcgagggagaaggtctgcacaaattaggctacattctgcgcgacatctctaagataccagggggaaacatgtatgctgatgacacagccggctgggataccagaatcacagaggacgatttgcagaatgaggcgaaaattactgacatcatggaacccgagcacgcactcctggccacctcgatttttaagctaacgtaccaaaacaaagtggtacgggttcagaggcctgctaagtcaggtaccgtgatggatgtcatcagccgtcgagaccagcgcgggtccggacaggtgggcacatatggccttaacactttcaccaatatggaagtgcaactgataagacagatggagagtgaagggattttttctccaagcgagctcgagaactccaatctggccgaacgggtcttggactggttagagaaacatggagttgaaaggctgaagcgcatggcaatctcaggtgatgactgtgtggtaaagcccacagatgacagattcgctactgccctcaccgctcttaacgatatgggcaaagtgcggaaggacatcccgcagtgggagcctagtaaagggtggaatgattggcagcaagtccccttttgctctcaccatttccaccagctgattatgaaggacggaagggaaatagtggttccatgtcgaaaccaggatgagctagtgggccgtgccagagtcagccagggtgcagggtggtccctgcgcgagacggcgtgcctcggaaaatcatacgcccaaatgtggcagttgatgtattttcaccggagggacctgagacttgctgccaatgcaatctgtagcgctgtgcctgtaaactgggttcccacatctcgcaccacttggtccattcatgcccaccatcagtggatgacaaccgaagatatgctgagtgtgtggaatcgggtctggatcgaggaaaacccatggatggaggacaagactcacgtgagctcgtgggaagacgttccctacctcggcaagagggaggatcaatggtgcggctccttaattgggctgaccgcacgagccacatgggcgacgaatatccaggtggctataaaccaggtcagacggttgatcggaaatgagaactatctggactacatgacctctatgaaaaggttcaagaatgaatcagatcctgagggtgccctctggtga

SEQ ID NO: 14188 - RNA, 9879 nt, synthetic construct
  misc_feature 1..9879: note = derived and/or modified CDS sequence (opt3) from DENV-1__KM403584__SS-prME
  source 1..9879: mol_type = other RNA
agcgtgaccatgctgctcatgcttctgcccaccgcattggctttccacttaactacgagaggaggggaacctcatatgatagtctccaagcaagaaaggggaaaatctctgttgtttaagacctcagccggtgttaacatgtgcacactcattgcaatggacctgggcgaactttgtgaagatactatgacctacaaatgcccacggataacagaggcggaaccggacgatgtggactgttggtgcaatgctaccgatacttgggtgacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagaggtccagcttacagactacggggccctgaccttggactgtagtccaaggactggactagatttcaacgaaatggtgctgctcacaatgaaggagaaaagctggctggtacataagcagtggtttcttgacctgccgttgccctggacgtctggcgcatccacctcacaagagacttggaatcggcaggatctcctggttacattcaaaaccgctcacgccaagaagcaggaagtggtcgtgttaggtagccaagagggggctatgcacacagccctgactggcgcaaccgaaatccagacgagtggaaccacaactatctttgccggccatctaaaatgccgtctcaagatggacaaactgacccttaagggggtctcttatgtgatgtgtacaggatccttcaaattggagaaggaagttgctgagactcagcacggtaccgtgctggtacaggtcaagtacgagggcacggatgcgccttgcaaaattccaataagcacacaagacgaaaagggggtgacccagaacggacgcctcatcactgcaaatcccattgttacagataaagagaagcctgtgaacatcgaaaccgagccacccttcggcgagtcgtatatagtcattggtgccggggaaaaagctctgaaactttcttggtttaagaaaggctcctcaatcggaaagatgttcgaggccactgcaagaggcgccaggcggatggctatcctgggggacaccgcctgggattttggaagtattggtggcgtgttcacaagcgtagggaaattggtgcatcaggtttttggaacggcatacggcgtcctcttctccggtgtgtcttggaccatgaagatcgggattggcatactgttaacttggctgggactaaatagccgatcaacaagtctctccatgacctgtatcgcggtgggcatggtcacactgtaccttggggttatggtgcaggctgacagcggatgcgtgattaactggaaaggccgcgaattgaagtgtggttctgggatctttgtaactaacgaggtccacacctggacggaacaatataagttccaggccgattcaccgaaaagactgagtgcagccatcggaaaggcttgggaggagggcgtgtgcggtattaggagcgccacacggctcgaaaatataatgtggaaacagatctccaacgagctgaatcatattttactggaaaacgacatgaagtttaccgttgtggtcggcgacgcatacgggatccttactcagggcaagaaaatgattcgccctcaacccatggagcacaaatattcttggaagtcgtggggcaaggctaaaatcataggggccgatacccagaatacaactttcatcattgacggaccagatacccctgaatgtcccgacgatcagagagcgtggaacatctgggaggtggaggactacggctttggtgttttcacaacgaatatttggttgaagctcagggatagctatacccagatgtgcgaccaccgtctgatgtccgccgctatcaaagattcaaaggcagtgcatgccgacatggggtactggatagaaagtgagaaaaacgaaacttggaagctagctcgggcctcttttattgaggtaaagacatgtatctggccacgaagccacaccctgtggtccaatggagtcctcgaatcagagatgattatccccaaaatatatggcggtcctatcagccaacataactacagaccaggctacttcactcagacagcagggccgtggcacctgggaaaacttgagttggatttcaatctgtgcgaaggcaccacggtggtggtcgacgagcactgcgggaacaggggaccctctttacgcactaccacagttaccggcaaaattatccatgaatggtgttgccggtcctgtactctccctccactgagatttaggggtgaggatgggtgctggtatggaatggagattcgccccgtgaaggaaaaagaggaaaatcttgtacgaagtatggtgagcgcgggctctggtgaggtcgactccttctcactgggcttgctctgtgtgagtatcatgatagaagaggttatgcggagccgttggtcgagaaagatgctgatgacagggaccctagccgtgtttttcctgctcattatgggacagctgacatggaacgaccttatcaggttgtgcatcatggtcggcgctaatgtgtccgatcgcatggggatgggaactacctacctggccttaatggcaacgtttaagatgcggcctatgttcgctgttggcctcctgtttagaaggcttacatctcgagaggtgctgctactcaccattggtctgagcttggtcgcctcagtagaactgccaaacagtttagaggaactcggggacggactggcaatgggcatcatgatgcttaaactgttgactgatttccaatcccaccagctctggaccacactgctatctctgacttttattaagaccacgcttagcctcgactatgcctggaaaacaatggctatggtgctgtccatagtttcattgttccccctgtgtttaagcaccacaagtcagaagacaacctggctcccggtgctgcttggctcttttgggtgcaaacctctgactatgttcttgatcacagagaacaagatttggggacgcaagtcctggccactcaatgaaggtatcatggcggtcggcattgtgagcatcctgctatcgtcactgcttaaaaacgatgtacccctcgccgggcctctgatagcaggaggcatgttgatcgcttgttacgtgatttctggtagttccgccgacttaagcctggagcgggccgctgaggtctcttgggaagaggaagcagagcatagcggggcctcccacaatatcctcgttgaagtgcaggatgacggaaccatgaagattaaagatgaggagagagacgatacgctgactatccttctgaaggcgaccttgctagctgtgtcaggcgtctatcccatgagtataccagccacactgtttgtgtggtacttctggcagaagaagaaacagaggagcggcgttctctgggacaccccttctcccccagaagtagagcgtgcagtgctggatgacgggatttatcgcatccttcagcggggattactgggtagatcccaggtcggcgtgggggttttccaagacggagtgtttcatacaatgtggcacgtcactaggggcgccgtgctcatgtaccagggtaagcgattggaaccgtcatgggctagtgtaaagaaagatctgatcagctacgggggaggctggcggttccagggctcctggaacaccggggaggaggtccaggtgattgcagttgaacctggaaagaatcccaaaaacgtgcaaacgacaccaggtacttttaagacccccgagggcgaagtcggggccatagcgctcgacttcaaacctggaacatctggctcgccaatcgtgaatcgcgagggtaagattgttgggctgtatggaaacggcgtggtcaccactagcggcacctacgtgtcagctatcgcccaggcaaaggcctcccaggaagggccccttcctgagattgaggatgaagtatttaaaaagagaaatctgacaatcatggacttgcacccgggaagtggtaaaacgaggcggtatctaccagctatagtgcgagaggccatcaagagaaaactgcgcactctcattttagcacccaccagggttgtcgcttctgaaatggccgaggcgctgaagggcatgcctatccgttaccaaacaaccgccgtaaagagcgaacatactgggaaagagattgtggatcttatgtgccacgcaacattcaccatgcggctgctctccccagtcagagtacccaactataatatgatcataatggacgaggctcattttacggatcctgcctcaattgctgcaaggggatacatctctactcgcgtgggcatgggtgaagccgccgctatcttcatgacagcgaccccgcccgggagcgttgaggcatttccacagagtaacgccgtgattcaggacgaagaacgagatatccctgaaagatcctggaatagcggatatgactggataaccgatttccccggcaagactgtctggtttgtgccatctattaaatcaggcaacgacatcgctaattgtttgcggaagaacgggaaaagggttattcagctgtcccgcaagacattcgacaccgagtaccaaaagactaagaacaatgattgggactacgtggtcactacggatatcagtgagatgggagccaacttccgtgcagacagagtgatagatcctcggaggtgcctcaagcccgtaattctgaaagacggtccagaacgcgtgatccttgccggcccgatgcctgttaccgctgcgagcgccgcacagcgaagagggcggatcggaaggaatcagaacaaggagggcgatcagtatatttacatgggtcaacccctaaataacgacgaagatcacgctcattggacagaggccaaaatgctgttggacaatatcaacactccagaggggattatacccgcattatttgaacctgagcgcgaaaagtcggccgctatcgatggcgagtatagactgaggggagaagcccggaagaccttcgtcgagctcatgcgtcgcggcgacctgccagtgtggctttcttacaaagtggcgtccgaggggtttcagtatagcgatcgaagatggtgcttcgacggagaaaggaataaccaggtcctggaggaaaatatggacgttgagatttggacaaaggaaggtgagcggaaaaagctccgccccagatggttggatgcaaggacctactcagaccctctggccctacgggagtttaaagagttcgctgccggccgaagaagtgtgtctggggatctgatcctcgagatcggaaaacttccgcagcacctgactttacgcgctcaaaacgcattggacaatctggtaatgctccacaactccgaacagggcggtaaagcctataggcatgctatggaggaactgccagatacgattgagacccttatgctgctcgccttgatagcagtgctgacagggggcgtcactttatttttcctaagcggaaagggcctggggaagacctcaatcggactcctttgtgtgatggcgagtagcgttctgttgtggatggcctccgtggagccccactggattgctgcctctatcattctggaatttttcctcatggtcctgcttatccctgagcccgaccggcagcgtacaccacaggataatcaactcgcatacgtagtgataggtctgttgtttatgatcctgaccgttgctgccaacgaaatgggcttactagagactactaaaaaggacctggggattggacatgtggtcgcagagaaccaccaccatgccacgatgctcgatatcgaccttcaccctgctagcgcgtggaccctgtacgccgtggcaactacaattatcacccccatgatgagacataccatagaaaatacaactgctaacatttccttgacggccatcgccaatcaggcagctattctgatgggcctcgataaaggttggccaatctcaaagatggacataggggtccctctgcttgccttaggctgctattctcaggtgaacccgctgaccctcacagcggctgttttgatgctggtggcccactacgcaatcattggacccggcctacaagccaaagctactagggaggcacagaagcgcaccgccgcggggatcatgaagaatccaacagtagatggaattgtggctatcgacctggaccctgtcgtttatgatgccaaattcgaaaagcagctcggccagataatgcttctgattttgtgtaccagtcaaatcctgctcatgcggactacgtgggcactgtgcgagtcgatcacattagccaccggtccccttactaccctgtgggaagggagcccaggacgattttggaacacaactattgctgtgtccatggccaatatcttcagaggctcttacctcgccggtgctggcctagccttctcactgatgaaaagcctagggggaggcaggcgcgggaccggagcgcagggcgagacactgggtgagaagtggaagcggcagctcaaccagctttccaagagtgaatttaatacgtataagagatctgggataatggaggtcgaccgtagcgaagccaaagagggaatgaagaggggcgaaaccactaaacatgcagtgtcacggggtacagctaagctgcgctggttcgtagagcgaaacttggtgaaacctgagggcaaggttattgatctggggtgtggaagaggcgggtggtcctactattgcgccggactcaagaaagtgaccgaagtcaagggctacactaaaggtgggcccggacacgaggaaccgatcccaatggcaacatacggctggaatattgtgaagttacacagtggcagggacgtctttttcacccctcccgagaaatgtgatacgctgctttgcgacatcggggaaagctctccaaaccccaccatagaggagggacggacactgcgcgtgctaaagatggttgaaccttggctcagaggtaatcaattttgtatcaaaattctgaacccgtatatgccctccgtagtggagactttggaacagatgcagaggaagcatggcgggatgctggtccgaaatccactctcacggaacagcacccacgagatgtactgggtgtcgtgcggaacaggcaatatcgtttctgctgtgaacatgacaagtcgtatgcttctgaacagattcaccatggcccatcgcaagcctacatatgagagggatgtcgacttaggtgccgggacccggcacgtggcggtagaacccgagattgctaatctggatatcattggacagagaatcgaaaacatcaaaaatgagcacaagtccacttggcattacgacgaagataacccttataaaacgtgggcataccacggcagctatgaggtgaagccatcaggctccgcctctagcatggttaatggggtcgtgcgcttgctcacaaaaccctgggacgtgattcctatggtcacccaaatcgctatgactgacaccacaccatttggacagcagagggttttcaaggagaaggtggatacgcgaacaccccggccgaaaagaggtactgcccaaatcatggaagtaacagcaaagtggctgtggggctttctaagtaggaacaaaaagcctcgcatttgtacccgtgaggagttcactcggaaagtgagatccaatgccgctataggggcggtctttgtggacgagaaccagtggaatagcgccaaggaagcagttgaggatgagaggttctgggaccttgtgcatcgcgaacgagagctgcacaagcagggaaaatgcgctacatgcgtctacaacatgatgggcaagcgggagaaaaagctcggtgagtttgggaaagccaagggatctagagcaatctggtacatgtggctgggcgccaggttcttggagttcgaggctctgggctttatgaatgaggatcattggttctcacgcgaaaacagtctctccggggtggagggagaaggtcttcacaagctgggctatattttaagagacatcagcaaaattccagggggaaatatgtacgccgatgacaccgcgggctgggatacacggatcactgaggacgatctgcagaacgaggcaaagataaccgacatcatggaacccgagcacgccttgctcgctacgtctatttttaaactgacctatcaaaataaggtagttagggtgcagcgtcctgccaaatcgggtacagtcatggatgtgatctcacgacgcgaccagagagggagcggacaggtgggcacttacggcctaaacaccttcacaaacatggaagtccaacttattcggcagatggagtccgaagggatctttagtccatctgagctggagaatagcaacctcgcagaaagggttctggactggttggagaagcatggagtggaacgcttaaaaagaatggctatatccggtgatgactgtgtagtgaagcccactgatgaccggttcgccaccgctctgacggccctcaatgatatgggcaaggtcaggaaagacattccgcagtgggagccttcaaaggggtggaacgattggcagcaagtgcccttttgcagtcaccatttccaccagcttatcatgaaagacggacgagaaatcgttgtgccatgtcgtaatcaggatgagctggtcggcagagcacgcgtgtctcagggtgcggggtggagcctacgggagacagcctgcctgggaaagtcctatgctcaaatgtggcagctcatgtactttcacaggagagacttgcgcctggccgcaaacgctatttgttcagccgtacctgttaattgggtgcccaccagccggactacatggtctatacatgcacaccatcagtggatgaccactgaagatatgctttccgtctggaacagggtgtggatcgaggaaaatccatggatggaggacaaaacccacgttagtagctgggaagacgtgccctatctgggcaagcgagaggatcaatggtgcggctcgctcattgggttaacagccagagcgacgtgggctaccaacatccaggtcgccattaatcaggtgcggaggctgatcggaaacgagaattacttggactacatgacttccatgaagcgcttcaaaaacgaatctgatcctgagggtgcactgtggtga

SEQ ID NO: 14189 - RNA, 9879 nt, synthetic construct
  misc_feature 1..9879: note = derived and/or modified CDS sequence (opt3) from DENV-1__KM403633__SS-prME
  source 1..9879: mol_type = other RNA
agcgtgaccatgctgctcatgcttctgcccactgcattggctttccacttaactacgagaggaggggaacctcatatgatcgtctccaagcaggaaaggggaaaatctctgttgtttaagacctcagccggtgttaacatgtgcactctcattgcaatggacctgggcgaactttgtgaagatactatgacctacaaatgcccacggataaccgaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggttgacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgcgggagaaaagctggctggtgcataaacagtggtttcttgacctgccgttgccctggacgtctggcgcatccacctcacaagaaacttggaatcgtcaggatctcctggtaacattcaagaccgctcacgccaaaaagcaggaagttgtggtcttaggtagccaagagggggctatgcacacagccctgactggcgcaaccgaaatccagacgagtggaaccacaactatttttgccggccatctaaagtgccgcctcaaaatggacaagctgacccttaaaggggtgtcttatgtcatgtgtacaggatccttcaagttggagaaagaagtggctgagactcagcacggtaccgttctggtgcaggtaaagtacgagggcacggatgcgccttgcaagataccaatcagcacacaagacgaaaaaggggtcacccagaacggaagactcattactgcaaatcccatcgtgacagataaggagaaacctgttaacatagaaaccgagccacccttcggcgagtcgtatattgtgatcggtgccggggaaaaggctctgaaactttcttggtttaagaagggctcctcaatcggaaaaatgttcgaggccactgcaaggggcgcccggcgaatggctattctgggggacaccgcctgggattttggaagtatcggtggcgtcttcacaagcgtggggaagttggtacatcaggtgtttggaacggcatacggcgttctcttctccggtgtctcttggaccatgaaaattgggataggcatcctgttaacttggctgggactaaatagccgctcaacaagtctctccatgacctgtattgcggtgggcatggtgacactgtaccttggggtcatggttcaggctgacagcggatgcgtgatcaactggaagggcagagaattgaaatgtggttctgggatctttgtgactaacgaggtacacacctggacggaacaatataagttccaggccgattcaccgaagaggctgagtgcagccattggaaaggcttgggaggagggcgtctgcggtatacggagcgccacacgcctcgaaaatatcatgtggaagcagatttccaacgagctgaatcatatcttactggaaaacgacatgaaatttaccgtggttgtgggcgacgcaaatgggattcttactcagggaaagaaaatgatcagacctcaacccatggagcacaagtactcttggaaatcgtggggcaaggctaagataatcggggccgatacccagaacacaactttcattatcgacggaccagatacccctgaatgtcccgacgatcagagggcgtggaatatttgggaggtcgaggactatggctttggtgtgttcacaacgaacatctggttgaaactccgtgatagctacacccagatgtgcgaccaccggctgatgtccgccgctataaaggattcaaaagcagttcatgccgacatggggtattggattgaaagtgagaagaatgaaacttggaaactagctcgagcctcttttatcgaggtgaagacatgtatttggccaagaagccacaccctgtggtccaacggagtactcgaatcagagatgatcatacccaagatctacggcggtcctattagccaacataattataggccaggctacttcactcagacagcagggccgtggcacctgggaaaacttgagttggatttcaacctgtgcgaaggcaccacggtcgtggtggacgagcactgcgggaatcgcggaccctctttacggactaccacagtcaccggcaagatcattcatgaatggtgttgcagatcctgtactctccctccactgaggtttcgcggtgaggatgggtgctggtacggaatggagatccgacccgttaaagaaaaggaggaaaaccttgtgcggagtatggtaagcgcgggctctggtgaggtggactccttctcactgggcttgctctgtgtcagtataatgattgaagaggtgatgcgtagcagatggtcgaggaaaatgctgatgacagggaccctagccgtatttttcctgctcatcatgggacagctgacatggaatgaccttatccgcttgtgcattatggtgggcgctaacgtctccgatcggatggggatgggaactacctatctggccttaatggcaacgtttaagatgagacctatgttcgctgtgggcctcctgtttaggcgacttacatctcgcgaggttctgctactcaccatcggtctgagcttggtggcctcagtcgaactgccaaacagtttagaggaactcggggacggactggcaatgggcattatgatgcttaagctgttgactgatttccaatcccaccagctctggaccacactgctatctctgacttttataaaaaccacgcttagcctcgactacgcctggaagacaatggctatggtactgtccatcgtgtcattgttccccctgtgtttaagcaccacaagtcagaaaacaacctggctcccggttctgcttggctcttttgggtgcaagcctctgactatgttcttgattacagagaataaaatctggggacggaagtcctggccactcaacgaaggtattatggcggtgggcatcgtcagcatactgctatcgtcactgcttaagaatgatgtgcccctcgccgggcctctgatcgcaggaggcatgttgattgcttgttatgtaatctctggtagttccgccgacttaagcctggagagagccgctgaggtgtcttgggaagaggaagcagagcatagcggggcctcccacaacattctcgtcgaagttcaggatgacggaaccatgaaaatcaaggatgaggagagggacgatacgctgactatacttctgaaagcgaccttgctagctgtgtcaggcgtgtaccccatgagtattccagccacactgtttgtctggtatttctggcaaaagaaaaagcagcgtagcggcgtgctctgggacaccccttctcccccagaagttgagcgcgcagtactggatgacgggatctaccggatccttcagagaggattactgggtaggtcccaggtgggcgtcggggtgttccaagacggagtttttcatacaatgtggcacgtgactcgaggcgccgtcctcatgtatcagggtaaacggttggaaccgtcatgggctagtgtgaagaaggatctgattagctacgggggaggctggcgcttccagggctcctggaataccggggaggaggtacaggtcatagcagtggaacctggcaaaaaccccaagaatgttcaaacgacaccaggtacttttaaaacccccgagggcgaagtgggggccatcgcgctcgacttcaagcctggaacatctggctcgccaattgtcaacagagagggtaaaatcgtggggctgtacggaaatggcgttgtgaccactagcggcacctatgtctcagctattgcccaggcaaaggcctcccaggaagggccccttcctgagatcgaggatgaagtgtttaagaaaaggaacctgacaataatggacttgcacccgggaagtggtaagacgcggcgatacctaccagctatcgtaagagaggccattaaacgcaagctgaggactctcatcttagcacccacccgtgtggttgcttctgaaatggccgaggcgctgaaaggcatgcctattcggtatcaaacaaccgccgtcaagagcgaacatactgggaaggagatcgtggatcttatgtgccacgcaacattcaccatgagactgctctccccagtgagggtccccaattacaacatgataattatggacgaggctcattttacggatcctgcctcaatcgctgcacgcggatatatctctactcgagtaggcatgggtgaagccgccgctattttcatgacagcgaccccgcccgggagcgtggaggcatttccacagagtaatgccgttatccaggacgaagagagagatatacctgaacggtcctggaacagcggatacgactggattaccgatttccccggcaaaactgtgtggtttgtcccatctatcaagtcaggcaatgacattgctaactgtttgaggaaaaacgggaagcgcgtgatccagctgtcccgtaaaacattcgacaccgagtatcaaaagacaaagaataacgattgggactacgttgtgactacggatataagtgagatgggagccaatttcagagcagaccgggtcattgatcctaggcgctgcctcaaacccgtgatcctgaaggacggtccagaacgagtaatccttgccggcccgatgcctgtgaccgctgcgagcgccgcacagagacgggggaggattggacgcaaccagaataaagagggcgatcagtacatctatatgggtcaacccctaaacaatgacgaagatcacgctcattggacagaggccaagatgctgttggacaacattaatactccagaggggataatccccgcattatttgaacctgagagagaaaaatcggccgctattgatggcgagtacaggctgcggggagaagcccgtaagaccttcgttgagctcatgcgccgaggcgacctgccagtctggctttcttataaggtggcgtccgaggggtttcagtacagcgatagaaggtggtgcttcgacggagaacggaacaatcaggtgctggaggaaaacatggacgtcgagatctggacaaaagaaggtgagcgcaagaaactcagacccaggtggttggatgcacggacctattcagaccctctggccctacgagagtttaaggagttcgctgccggcagacgcagtgtttctggggatctgatcctcgagattggaaaacttccgcagcacctgactttaagggctcaaaatgcattggacaacctggtgatgctccacaattccgaacagggcggtaaggcctaccggcatgctatggaggaactgccagatacgatagagacccttatgctgctcgccttgatcgcagtactgacagggggcgtgactttatttttcctaagcggaaaaggcctggggaagacctcaattggactcctttgtgtcatggcgagtagcgtgctgttgtggatggcctccgttgagccccactggatcgctgcctctattatcctggaatttttcctcatggtgctgcttatacctgagcccgaccgtcagagaacaccacaggataaccaactcgcatatgtcgtaatcggtctgttgtttatgattctgaccgtggctgccaacgaaatgggcttactagagactacaaagaaagacctggggatcggacatgttgtggcagagaatcaccaccatgccacgatgctcgatattgaccttcaccctgctagcgcgtggaccctgtacgccgtcgcaactacaatcataacccccatgatgaggcataccattgaaaacacaactgctaatatctccttgacggccattgccaaccaggcagctatcctgatgggcctcgataagggttggccaatatcaaaaatggacatcggggtgcctctgcttgccttaggctgctactctcaggtcaatccgctgaccctcacagcggctgtgttgatgctggttgcccactatgcaattatcggacccggcctacaagccaaggctactcgcgaggcacagaaacggaccgccgcggggattatgaagaacccaacagtggatggaatcgtagctatagacctggaccctgtggtctacgatgccaagttcgaaaaacagctcggccagattatgcttctgatcttgtgtaccagtcaaatcctgctcatgcgaactacgtgggcactgtgcgagtcgattacattagccaccggtccccttactaccctgtgggaagggagcccaggaaagttttggaatacaactatcgctgtttccatggccaacatattcagaggctcttatctcgccggtgctggcctagccttctcactgatgaaaagcctagggggaggcaggcgcgggaccggagcgcagggcgagacactgggtgagaagtggaaacggcagctcaatcagctttccaagagtgaatttaacacgtacaagagatctgggattatggaggtggaccgtagcgaagccaaagagggactgaagaggggcgaaaccactaaacatgcagtctcacggggtacagctaagttgcgctggttcgtggagcgaaatctggtaaaacctgagggcaaggtgatcgatctcgggtgtggaagaggcgggtggtcctattactgcgccggattaaagaaagttaccgaagtgaagggctatactaaaggtgggcccggacacgaggaaccgattccaatggcaacatacggctggaacatcgtcaagctgcacagtggcagggacgtgtttttcacccctcccgagaaatgtgatacgcttctgtgcgacataggggaaagctctccaaatcccaccatcgaggagggacggacactacgcgtcctcaagatggtggaaccttggctgagaggtaaccaattttgtattaaaatcttgaatccgtacatgccctccgttgtagagactctggaacagatgcagaggaagcatggcgggatgctcgtgcgaaacccactttcacggaatagcacccacgagatgtattgggtctcgtgcggaacaggcaacattgtgtctgctgttaacatgacaagtcgtatgctgttaaatagattcaccatggcccatcgcaagcctacatacgagagggatgtggacctgggtgccgggacccggcacgtcgcggtggaacccgagatcgctaacttggatattatcggacagagaatagaaaatattaaaaacgagcacaagtccacttggcattatgacgaagataatccttacaaaacgtgggcatatcacggcagctacgaggtaaagccatcaggctccgcctctagcatggtgaacggggttgtccgcctcctgacaaaaccctgggacgtgatccctatggtgacccaaatcgctatgactgacaccacaccatttggacagcagagggtcttcaaggagaaggttgatacgcgaacaccccggccgaaaagaggtactgcccaaattatggaagtgacagcaaagtggctatggggctttcttagtaggaataaaaagcctcgcatatgtacccgtgaggagttcactcggaaagtaagatccaacgccgctatcggggcggtgtttgtcgacgagaatcagtggaacagcgccaaggaagcagtggaggatgagaggttctgggacctggttcatcgcgaacgagagctccacaagcagggaaaatgcgctacatgcgtgtataatatgatgggcaagcgggagaagaaactgggtgagtttgggaaagccaagggatctagagcaatttggtacatgtggttgggcgccaggttcctggagttcgaggctctcggctttatgaacgaggatcattggttctcacgcgaaaatagtctttccggggtcgagggagaaggtctgcacaagttaggctacatcctgagagacattagcaaaatcccagggggaaacatgtatgccgatgacaccgcgggctgggatacacggataactgaggacgatttgcagaatgaggcaaagatcaccgacattatggaacccgagcacgccctcctggctacgtctatctttaaactaacctaccaaaacaaggtggtaagggttcagcgtcctgccaaatcgggtacagtgatggatgtcatttcacgacgcgaccagagagggagcggacaggtgggcacttatggccttaacaccttcacaaatatggaagtgcaactgatccggcagatggagtccgaagggatatttagtccatctgagctcgagaacagcaatctggcagaaagggtcttggactggttagagaagcatggagttgaacgcctgaaaagaatggctatttccggtgatgactgtgtggtaaagcccactgatgaccggttcgccaccgctctcacggcccttaacgatatgggcaaggtgaggaaagacatcccgcagtgggagccttcaaaggggtggaatgattggcagcaagtccccttttgcagtcaccatttccaccagctgatcatgaaagacggacgagaaattgtggttccatgtcgtaaccaggatgagctagtgggcagagcacgcgtctctcagggtgcggggtggagcctgcgggagacagcctgcctcggaaagtcctacgctcaaatgtggcagttgatgtattttcacaggagagacctgcgccttgccgcaaatgctatatgttcagccgtgcctgtaaactgggttcccaccagccggactacatggtctatccatgcacaccatcagtggatgaccactgaagatatgctgtccgtgtggaatagggtctggattgaggaaaacccatggatggaggacaaaacccacgtgagtagctgggaagacgttccctacctcggcaagcgagaggatcaatggtgcggctcgttaatcgggctgacagccagagcgacgtgggctaccaatattcaggtggccatcaaccaggtccggaggttgataggaaatgagaactatctggactacatgacttccatgaagcgcttcaaaaatgaatctgatcctgagggtgcactctggtga

SEQ ID NO: 14190 - RNA, 9879 nt, synthetic construct
  misc_feature 1..9879: note = derived and/or modified CDS sequence (opt3) from DENV-1__KM403592__SS-prME
  source 1..9879: mol_type = other RNA
agcgtgaccatgctgctcatgcttctgcccacagcattggctttccacttaactacgagaggcggggaacctcatatgatcgtctccaagcaagaaaggggaaaatctctgttatttaagacctcagccggtgttaacatgtgcacactcattgccatggacctgggcgagctttgtgaagatactatgacctacaaatgcccacggataacagaggcggaaccggacgatgtggactgttggtgcaatgctaccgatacttgggtgacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggttgacgttgtgctggagcacgggagttgtgtcacaaccatggcaaagaataaacccactttggatatcgaactcctgaagacagaggtgaccaaccctgccgtgcttaggaaactgtgcattgaagctaagatctccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaagggggtgtcttatgtcatgtgtacaggatccttcaaattggagaaggaagtggctgagactcagcacggtaccgttctggtgcaggtaaagtacgagggcacggatgcgccttgcaaaataccaatcagcacacaagacgaaaagggggtcgcacagaacggacgcctcattaccgccaatcccatcgtgactgataaagagaagcctgttaacatagaaacagagccacccttcggcgagtcgtatattgtgatcggtgctggggaaaaagccctgaaactttcttggtttaagaaaggctcctcaatcggaaagatgttcgaggcaaccgccagaggcgctaggcggatggccattctgggggacactgcatgggattttggaagtatcggtggcgtcttcaccagcgtggggaaattggtacatcaggtgtttggaacagcgtacggcgttctcttctccggtgtctcttggacgatgaagattgggataggcatcctgttaacctggctgggactaaatagccgatcaacaagtctctccatgacatgtattgctgtgggcatggtgaccctgtaccttggggtcatggttcaggccgacagcggatgcgtgatcaactggaaaggccgcgaattgaagtgtggttctgggatctttgtgacaaacgaggtacacacttggaccgaacaatataagttccaggcagattcaccgaaaagactgagtgccgctattggaaaggcctgggaggagggcgtctgcggtataaggagcgcaacgcggctcgaaaatatcatgtggaaacagatttccaacgagctgaatcatatcttactggaaaacgacatgaagtttacagtggttgtgggcgacgctaatgggattcttacccagggcaagaaaatgatccgccctcaacccatggagcacaaatactcttggaagtcgtggggcaaggccaaaataatcggggcggatactcagaacaccacattcattatcgacggaccagatactcctgaatgtcccgacgatcagagagcctggaatatttgggaggtcgaggactatggctttggtgtgttcaccacaaacatctggttgaagctcagggatagctacacgcagatgtgcgaccaccgtctgatgtccgctgcaataaaagattcaaaggccgttcatgctgacatggggtattggattgaaagtgagaaaaatgaaacctggaagctagcccgggcatcttttatcgaggtgaagacttgtatttggccacgaagccacacactgtggtccaacggagtactcgaatcagagatgatcatacccaaaatctacggcggtcctattagccaacataattatagaccaggctacttcacccagactgcggggccgtggcacctgggaaaacttgagttggatttcaacctgtgcgaaggcacaaccgtcgtggtggacgagcactgcgggaataggggaccctctttacgcacgactaccgtcacaggcaaaatcattcatgaatggtgttgccggtcctgtaccctccctccactgagatttaggggtgaggatgggtgctggtacggaatggagatccgccccgttaaggaaaaagaggaaaaccttgtgcgaagtatggtaagcgccggctctggtgaggtggactccttctcactgggcttgctctgtgtcagtataatgattgaagaggtgatgcggagccgttggtcgagaaagatgctgatgactgggacactagctgtatttttcctgctcatcatgggacagctgacctggaatgaccttgtgaggttgtgcatcatggtcggcgccaacgtgtccgatcgcatggggatgggaacaacttatctggcattaatggctacctttaagatgcggcctatgttcgccgttggcctcctgtttagaaggcttacgtctcgagaggtgctgctactcacaattggtctgagcttggtcgcatcagtagaactgccaaacagtttagaggaactcggggacggactggccatgggcatcatgatgcttaaactgttgaccgatttccaatcccaccagctctggactaccctgctatctctgacatttattaagactacccttagcctcgactacgcttggaaaacgatggcgatggtgctgtccatagtttcattgttccccctgtgtttaagcacaaccagtcagaagactacatggctcccggtgctgcttggctcttttgggtgcaaacctctgaccatgttcttgatcactgagaataagatttggggacgcaagtcctggccactcaacgaaggtatcatggccgtcggcattgtgagcatcctgctatcgtcactgcttaaaaatgatgtacccctcgcagggcctctgatagctggaggcatgttgatcgcctgttatgtgatttctggtagttccgccgacttaagcctggagcgggctgcagaggtctcttgggaagaggaagccgagcatagcggggcgtcccacaacatcctcgttgaagtgcaggatgacggaacaatgaagattaaagatgaggagagagacgataccctgacgatccttctgaaggctactttgctagccgtgtcaggcgtctaccccatgagtataccagcaaccctgtttgtgtggtatttctggcagaagaagaaacagaggagcggcgttctctgggacacaccttctcccccagaagtagagcgtgccgtgctggatgacgggatttaccgcatccttcagcggggattactgggtagatcccaggtcggcgtgggggttttccaagacggagtgtttcataccatgtggcacgtcacaaggggcgctgtgctcatgtatcagggtaagcgattggaaccgtcatgggcaagtgtaaagaaagatctgatcagctacgggggaggctggcggttccagggctcctggaatactggggaggaggtccaggtgattgccgttgaacctggaaagaaccccaaaaatgtgcaaaccatgccaggtacgtttaagacacccgagggcgaagtcggggcgatagctctcgacttcaaacctggaacttctggctcgccaatcgtgaaccgcgagggtaagattgttgggctgtacggaaatggcgtggtcaccacaagcggcacctatgtgtcagccatcgcacaggccaaggcttcccaggaagggccccttcctgagattgaggatgaagtatttaaaaagagaaacctgactatcatggacttgcacccgggaagtggtaaaaccaggcggtacctaccagccatagtgcgagaggcaatcaagagaaaactgcgcacactcattttagctcccacgagggttgtcgcctctgaaatggcggaggccctgaagggcatgcctatccgttatcaaactaccgcagtaaagagcgaacatacagggaaagagattgtggatcttatgtgccacgctaccttcactatgcggctgctctccccagtcagagtacccaattacaacatgatcataatggacgaggcccattttacagatcctgcttcaattgcagccaggggatatatctctacccgcgtgggcatgggtgaagccgctgcgatcttcatgacggcaactccgcccgggagcgttgaggcctttccacagagtaatgctgtgattcaggacgaagaacgagatatccctgaaagatcctggaacagcggatacgactggataacagatttccccggcaagaccgtctggtttgtgccatctattaaatcaggcaatgacatcgccaactgtttgcggaagaacgggaaaagggttattcagctgtcccgcaagaccttcgacactgagtatcaaaagactaagaataacgattgggactacgtggtcaccacagatatcagtgagatgggagcaaatttccgtgccgacagagtgatagatcctcggaggtgcctcaagcccgtaattctgaaagacggtccagaacgcgtgatccttgctggcccgatgcctgttactgcggccagcgcagctcagcgaagagggcggatcggaaggaaccagaataaggagggcgatcagtacatttatatgggtcaacccctaaacaatgacgaagatcacgcccattggacggaggcaaaaatgctgttggacaacatcaataccccagaggggattatacccgccttatttgaacctgagcgcgaaaagtcggctgccatcgatggcgagtacagactgaggggagaagcgcggaagacattcgtcgagctcatgcgtcgcggcgacctgccagtgtggctttcttataaagtggcatccgaggggtttcagtacagcgatcgaagatggtgcttcgacggagaaaggaacaatcaggtcctggaggaaaacatggacgttgagatttggactaaggaaggtgagcggaaaaagctccgccccagatggttggatgccaggacctattcagaccctctggctctacgggagtttaaagagttcgccgctggccgaagaagtgtgtctggggatctgatcctcgagatcggaaaacttccgcagcacctgacattacgcgcacaaaatgccttggacaacctggtaatgctccacaattccgaacagggcggtaaggcttacaggcatgccatggaggaactgccagataccattgagactcttatgctgctcgcattgatagcggtgctgaccgggggagtcaccttatttttcctaagcggaaagggcctggggaagacatcaatcggactcctttgtgtgatggccagtagcgttctgttgtggatggcttccgtggagccccactggattgccgcatctatcattctggaatttttcctcatggtcctgcttatccctgagcccgaccggcagcgtactccacaggataaccaactcgcttatgtagtgataggtctgttgtttatgatcctgaccgttgccgcaaacgaaatgggcttactagagacaaccaaaaaggacctggggattggacatgtggtcgccgagaatcaccaccatgctactatgctcgatatcgaccttcaccctgcgagcgcctggacactgtacgcagtggctacgaccattatcactcccatgatgagacatacaatagaaaacaccaccgccaatatttccttgacagccatcgcaaaccaggctgccattctgatgggcctcgataaaggttggccaatctcaaagatggacataggggtccctctgcttgcgttaggctgctactctcaggtgaatccgctgactctcacggctgccgttttgatgctggtggcacactatgccatcattggacccggcctacaagctaaagcaaccagggaggcccagaagcgcacagcggctgggatcatgaagaacccaactgtagatggaattgtggccatcgacctggaccctgtcgtttacgatgcaaaattcgaaaagcagctcggccagataatgcttctgattttgtgtaccagtcaaatcctgctcatgcggacaacctgggccctgtgcgagtcgatcactttagctacgggtccccttacaaccctgtgggaagggagcccaggaaaattttggaatactaccattgccgtgtccatggcaaacatcttccgaggctcttatctcgctggtgccggcctagcgttctcactgatgaaaagcctagggggaggcagaagggggacaggagcccagggcgagactctgggtgagaaatggaagcgccagctcaatcagctttccaagagtgaatttaacacctacaaacggtctgggataatggaggtcgacagaagcgaagcaaaggagggactgaaacgtggcgaaacaacgaagcatgctgtgtcaaggggtaccgccaaattgcggtggttcgtagagcgcaatctggtgaagcctgagggcaaggttattgatctcgggtgtggacgaggcgggtggtcctattactgcgcaggactaaagaaggtgactgaagtcaaaggctatacaaagggtgggcccggacacgaggaaccgatcccaatggctacctacggctggaacattgtgaaactgcacagtggcagagacgtctttttcactcctcccgagaagtgtgatacacttctgtgcgacatcggggaaagctctccaaatcccaccatagaggagggaaggacgctacgggtgctcaaaatggttgaaccttggctgcgcggtaaccaattttgtatcaagattttgaatccgtacatgccctccgtagtggagaccctggaacagatgcagagaaagcatggcgggatgctcgtcaggaacccactttcacgaaatagcacacacgagatgtattgggtgtcgtgcggaactggcaacatcgtttctgccgtgaacatgaccagtcggatgctgttaaatcgtttcacaatggcccatagaaaacctacttacgagcgcgatgtcgacctgggtgcggggaccaggcacgtggctgtagaacccgagattgcaaacttggatatcattggacagcggatcgaaaatataaagaacgagcacaaatccacatggcattatgacgaagataatccttacaagacctgggcctatcacggcagctacgaggtgaaaccatcaggctccgcttctagcatggttaacggggtcgtgagactcctgactaagccctgggacgtgattcctatggtcacgcaaatcgccatgacagacaccactccatttggacagcagcgcgttttcaaggagaaagtggataccaggacaccccgaccgaagcggggtacggcacaaatcatggaagtaaccgccaaatggctatggggctttcttagtagaaataagaaacctaggatttgtactcgcgaggagttcacacgtaaggtgcggtccaacgctgcgataggggccgtctttgtggacgagaatcagtggaacagcgcaaaggaagctgttgaggatgagagattctgggacctggtgcatagggaacgcgagctccacaaacagggaaagtgcgccacgtgcgtctataatatgatgggcaaacgagaaaagaaactgggtgagtttgggaaggcaaagggatctcgggccatctggtacatgtggttgggcgctagattcctggagttcgaggccctcggctttatgaacgaggatcattggttctcaagggaaaatagtctttccggggtggagggagaaggtctgcacaaattaggctacattctgcgcgacatcagcaagattccagggggaaacatgtatgcggatgacactgcaggctgggatacaagaatcaccgaggacgatttgcagaatgaggccaaaataacagacatcatggaacccgagcacgctctcctggccacttctatttttaagctaacctaccaaaacaaagtagttcgggtgcagaggcctgcaaagtcgggtacggtcatggatgtgatctcacgtcgagaccagcgcgggagcggacaggtgggcacctatggccttaacacattcactaatatggaagtccaactgattagacagatggagtccgaagggatctttagtccatctgagctcgagaacagcaatctggctgaacgggttttggactggttagagaaacatggagtggaaaggctgaagcgcatggccatatccggtgatgactgtgtagtgaagcccaccgatgacagattcgctacagccctcactgcacttaacgatatgggcaaagtccggaaggacattccgcagtgggagccttcaaaagggtggaatgattggcagcaagtgcccttttgcagtcaccatttccaccagctgatcatgaaggacggaagggaaatcgttgtgccatgtcgaaaccaggatgagctagtcggccgtgcgagagtgtctcagggtgccgggtggagcctgcgcgagaccgcttgcctcggaaaatcctacgcccaaatgtggcagttgatgtattttcaccggagggacctgagacttgcagctaatgccatttgttcagcagtacctgttaactgggtgcccacgagccgcacaacctggtctatacatgcccaccatcagtggatgactacagaagatatgctgtccgtctggaatcgggtgtggatcgaggaaaacccatggatggaggacaagacccacgttagtagctgggaagacgtgccctacctcggcaagagggaggatcaatggtgcggctcgttaattgggctgactgcgcgagctacctgggccacaaatatccaggtcgcaattaaccaggtgagacggttgatcggaaatgagaactatctggactacatgacgtccatgaaaaggttcaagaatgaatctgatcctgagggtgccctctggtga

SEQ ID NO: 14191 - RNA, 9879 nt, synthetic construct
  misc_feature 1..9879: note = derived and/or modified CDS sequence (opt3) from DENV-1__KM403593__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaagggggtgtcttatgtcatgtgtacaggatccttcaaattggagaaggaagtggctgagactcagcacggtaccgttctggtgcaggtaaagtacgagggcacggatgcgccttgcaaaataccaatcagcacacaagacgaaaagggggtcgcacagaacggacgcctcattaccgccaatcccatcgtgactgataaagagaagcctgttaacatagaaacagagccacccttcggcgagtcgtatattgtgatcggtgctggggaaaaagccctgaagctttcttggtttaagaaaggctcctcaatcggaaagatgttcgaggcaaccgccagaggcgctaggcggatggccattctgggggacactgcatgggattttggaagtatcggtggcgtcttcaccagcgtggggaaattggtacatcaggtgtttggaacagcgtacggcgttctcttctccggtgtctcttggacgatgaagattgggataggcatcctgttaacctggctgggactaaatagccgatcaactagtctctccatgacatgtattgctgtgggcatggtgaccctgtaccttggggtcatggttcaggccgacagcggatgcgtgatcaactggaaaggccgcgaattgaagtgtggttctgggatctttgtgacaaacgaggtacacacttggaccgaacaatataagttccaggcagattcaccgaaaagactgagtgccgctattggaaaggcctgggaggagggcgtctgcggtataaggagcgcaacgcggctcgaaaatatcatgtggaaacagatttccaacgagctgaatcatatcttactggaaaacgacatgaagtttacagtggttgtgggcgacgctaatgggattcttacccagggaaaaaagatgatccgccctcaacccatggagcacaaatactcttggaagtcgtggggcaaggccaaaataatcggggcggatactcagaacaccacattcattatcgacggaccagatactcctgaatgtcccgacgatcagagagcctggaatatttgggaggtcgaggactatggctttggtgtgttcaccacaaacatctggttgaagctcagggatagctacacgcagatgtgcgaccaccgtctgatgtccgctgcaataaaagattcaaaggccgttcatgctgacatggggtattggattgaaagtgagaaaaatgaaacctggaagctagcccgggcatcttttatcgaggtgaagacttgtatttggccacgaagccacacactgtggtccaacggagtactcgaatcagagatgatcatacccaaaatctacggcggtcctattagccaacataattatagaccaggctacttcacccagactgcggggccgtggcacctgggaaagcttgagttggatttcaacctgtgcgaaggcacaaccgtcgtggtggacgagcactgcgggaataggggaccctctttacgcacgactaccgtcacaggcaaaatcattcatgaatggtgttgccggtcctgtaccctccctccactgagatttaggggtgaggatgggtgctggtacggaatggagatccgccccgttaaggaaaaagaggaaaaccttgtgcgaagtatggtaagcgccggctctggtgaggtggactccttctcactgggcttgctctgtgtcagtataatgattgaagaggtgatgcggagccgttggtcgagaaagatgctgatgactgggacactagctgtttttttcctgctcatcatgggacagctgacctggaatgaccttatcaggttgtgcattatggtgggcgccaacgtctccgatcgcatggggatgggaacaacttatctggcattaatggctacctttaagatgcggcctatgttcgccgtgggcctcctgtttagaaggcttacgtctcgagaggttctgctactcacaatcggtctgagcttggtggcatcagtcgaactgccaaacagtttagaggaactcggggacggactggccatgggcattatgatgcttaaactgttgaccgatttccaatcccaccagctctggactaccctgctatctctgacatttataaagactacccttagcctcgactacgcttggaaaacgatggcgatggtactgtccatcgtgtcattgttccccctgtgtttaagcacaaccagtcagaagactacatggctcccggttctgcttggctcttttgggtgcaaacctctgaccatgttcttgattactgagaataagatctggggacgcaagtcctggccactcaacgaaggtattatggccgtgggcatcgtcagcatactgctatcgtcactgcttaaaaatgatgtgcccctcgcagggcctctgatcgctggaggcatgttgattgcctgttatgtaatctctggtagttccgccgacttaagcctggagcgggctgcagaggtgtcttgggaagaggaagccgagcatagcggggcgtcccacaacattctcgtcgaagttcaggatgacggaacaatgaagatcaaagatgaggagagagacgataccctgacgatacttctgaaggctactttgctagccgtgtcaggcgtgtaccccatgagtattccagcaaccctgtttgtctggtatttctggcaaaaaaagaaacagaggagcggcgtgctctgggacacaccttctcccccagaagttgagcgtgccgtactggatgacgggatctaccgcatccttcagcggggattactgggtagatcccaggtgggcgtcggggtgttccaagacggagtttttcataccatgtggcacgtgacaaggggcgctgtcctcatgtatcagggtaagcgattggaaccgtcatgggcaagtgtgaagaaagatctgattagctacgggggaggctggcggttccagggctcctggaatactggggaggaggtacaggtcatagccgtggaacctggaaagaaccccaaaaatgttcaaaccacgccaggtacatttaagactcccgagggcgaagtgggggcgatcgctctcgacttcaaacctggaacctctggctcgccaattgtcaaccgcgagggtaagatcgtggggctgtacggaaatggcgttgtgacaaccagcggcacttatgtctcagccattgcacaggccaaggcttcccaggaagggccccttcctgagatcgaggatgaagtgtttaaaaagagaaacctgaccataatggacttgcacccgggaagtggtaaaacaaggcggtacctaccagccatcgtacgagaggcaattaagagaaaactgcgcacgctcatcttagctcccactagggtggttgcctctgaaatggcggaggccctgaagggcatgcctattcgttatcaaaccacagcagtcaagagcgaacataccgggaaagagatcgtggatcttatgtgccacgctactttcacaatgcggctgctctccccagtgagagtccccaattacaacatgataattatggacgaggcccattttaccgatcctgcttcaatcgcagccaggggatatatctctacgcgcgtaggcatgggtgaagccgctgcgattttcatgactgcaacaccgcccgggagcgtggaggcctttccacagagtaatgctgttatccaggacgaagagcgagatatacctgaaagatcctggaacagcggatacgactggattaccgatttccccggcaagaccgtgtggtttgtcccatctatcaaatcaggcaatgacattgccaactgtttgcggaagaacgggaaaagggtgatccagctgtcccgcaagactttcgacacagagtatcaaaagaccaaaaataacgattgggactacgttgtgacaactgatataagtgagatgggagcaaatttccgtgccgacagagtcattgatcctcggaggtgcctcaagcccgtgatcctgaaagacggtccagaacgcgtaatccttgctggcccgatgcctgtgacggcggccagcgcagctcagcgaagagggcggattggaaggaaccagaataaggagggcgatcagtacatctatatgggtcaacccctaaacaatgacgaagatcacgcccattggaccgaggcaaaaatgctgttggacaacattaatacaccagaggggataatccccgccttatttgaacctgagcgcgaaaagtcggctgccattgatggcgagtacagactgaggggagaagcgcggaagactttcgttgagctcatgcgtcgcggcgacctgccagtctggctttcttataaagtggcatccgaggggtttcagtacagcgatcgaagatggtgcttcgacggagaaaggaacaatcaggtgctggaggaaaacatggacgtcgagatctggaccaaggaaggtgagcggaaaaagctccgccccagatggttggatgccaggacatattcagaccctctggctctacgggagtttaaagaattcgccgctggccgaagaagtgtttctggggatctgatcctcgagattggaaagcttccgcagcacctgaccttacgcgcacaaaatgccttggacaacctggtgatgctccacaattccgaacagggcggtaaagcttacaggcatgccatggaggaactgccagatactatagagacgcttatgctgctcgcattgatcgcggtactgaccgggggcgtgacattatttttcctaagcggaaagggcctggggaagacttcaattggactcctttgtgtcatggccagtagcgtgctgttgtggatggcttccgttgagccccactggatcgccgcatctattatcctggaatttttcctcatggtgctgcttatacctgagcccgaccggcagcgtaccccacaggataaccaactcgcttatgtcgtaatcggtctgttgtttatgattctgacagtggccgcaaacgaaatgggcttactagagaccactaaaaaggacctggggatcggacatgttgtggccgagaatcaccaccatgctacaatgctcgatattgaccttcaccctgcgagcgcctggacgctgtacgcagtcgctaccactatcataacacccatgatgagacataccattgaaaacaccacagccaatatctccttgactgccattgcaaaccaggctgccatcctgatgggcctcgataaaggttggccaatatcaaagatggacatcggggtgcctctgcttgcgttaggctgctactctcaggtcaatccgctgacgctcaccgctgccgtgttgatgctggttgcacactatgccattatcggacccggcctacaagctaaagcaacaagggaggcccagaagcgcactgcggctgggattatgaagaacccaaccgtggatggaatcgtagccatagacctggaccctgtggtctacgatgcaaaattcgaaaagcagctcggccagattatgcttctgatcttgtgtacaagtcaaatcctgctcatgcggaccacttgggccctgtgcgagtcgattacgttagctacaggtccccttaccactctgtgggaagggagcccaggaaaattttggaataccacaatcgccgtttccatggcaaacatattccgaggctcttatctcgctggtgccggcctagcgttctcactgatgaagagcttggggggaggcagaagggggactggagcccagggcgagaccctgggtgagaaatggaagcgccagctcaatcagctttccaagagtgaatttaacacatacaaacggtctgggattatggaggtggacagaagcgaagcaaaggagggactgaaacgtggcgaaacgaccaagcatgctgtctcaaggggtactgccaaattgcggtggttcgtggagcgcaatctggtaaagcctgagggcaaggtgatcgatctcgggtgtggacgaggcgggtggtcctattactgcgcaggattaaaaaaggttacagaagtgaaaggctataccaagggtgggcccggacacgaggaaccgattccaatggctacttacggctggaacatcgtcaaactgcacagtggcagagacgtgtttttcacacctcccgagaagtgtgatacccttctgtgcgacataggggaaagctctccaaatcccacgatcgaggagggaaggaccctacgggtcctcaaaatggtggaaccttggctgcgcggtaaccaattttgtattaagatcttgaatccgtacatgccctccgttgtagagacactggaacagatgcagagaaagcatggcgggatgctcgtgaggaacccactttcacgaaatagcactcacgagatgtattgggtctcgtgcggaaccggcaacattgtgtctgccgttaacatgacaagtcggatgctgttaaatcgtttcactatggcccatagaaaacctacctacgagcgcgatgtggacctgggtgcggggacaaggcacgtcgctgtggaacccgagatcgcaaacttggatattatcggacagcggatagaaaatattaagaacgagcacaaatccacctggcattatgacgaagataatccttacaagacttgggcctatcacggcagctacgaggtaaaaccatcaggctccgcttctagcatggtgaacggggttgtcagactcctgacgaagccctgggacgtgatccctatggtgacacaaatcgccatgaccgacactaccccatttggacagcagcgcgtcttcaaggagaaagttgatacaaggacgccccgaccgaagcggggtaccgcacaaattatggaagtgactgccaaatggctatggggctttcttagtagaaataagaaacctaggatatgtacacgcgaggaattcacccgtaaggtacggtccaacgctgcgatcggggccgtgtttgtcgacgagaatcagtggaacagcgcaaaggaagctgtggaggatgagagattctgggacctggttcatagggaacgcgagctccacaaacagggaaagtgcgccacttgcgtgtataatatgatgggcaaacgagaaaagaaactgggtgagtttgggaaggcaaagggatctcgggccatttggtacatgtggttgggcgctagattcctggaattcgaggccctcggctttatgaacgaggatcattggttctcaagggaaaatagtctttccggggtcgagggagaaggtctgcacaaattaggctacatcctgcgcgacattagcaagatcccagggggaaacatgtatgcggatgacacagcaggctgggataccagaataacagaggacgatttgcagaatgaggccaaaatcactgacattatggaacccgagcacgctctcctggccacctctatctttaagctaacgtaccaaaacaaagtggtacgggttcagaggcctgcaaagtcgggtaccgtgatggatgtcatttcacgtcgagaccagcgcgggagcggacaggtgggcacatatggccttaacactttcaccaatatggaagtgcaactgatcagacagatggagtccgaagggatatttagtccatctgagctcgagaacagcaatctggctgaacgggtcttggactggttagagaaacatggagttgaaaggctgaagcgcatggccatttccggtgatgactgtgtggtaaagcccacagatgacagattcgctactgccctcaccgcacttaacgatatgggcaaagtgcggaaggacatcccgcagtgggagccttcaaaagggtggaatgattggcagcaagtccccttttgcagtcaccatttccaccagctgatcatgaaggacggaagggaaattgtggttccatgtcgaaaccaggatgagctagtgggccgtgcgagagtctctcagggtgccgggtggagcctgcgcgagacggcttgcctcggaaaatcctacgcccaaatgtggcagttgatgtattttcaccggagggacctgagacttgcagctaatgccatatgttcagcagtgcctgtaaactgggttcccacaagccgcaccacttggtctatccatgcccaccatcagtggatgacaaccgaagatatgctgtccgtgtggaatcgggtctggattgaggaaaacccatggatggaggacaagactcacgtgagtagctgggaagacgttccctacctcggcaagagggaggatcaatggtgcggctcgttaatcgggctgaccgcgcgagctacatgggccacgaatattcaggtggcaatcaaccaggtcagacggttgataggaaatgagaactatctggactacatgacctccatgaaaaggttcaagaatgaatctgatcctgagggtgccctctggtga

SEQ ID NO: 14192 - RNA, 9879 nt, synthetic construct
  misc_feature 1..9879: note = derived and/or modified CDS sequence (opt3) from DENV-1__KM403603__SS-prME
  source 1..9879: mol_type = other RNA
agcgtgacaatgctgctcatgcttctgcccacagcattggctttccacttaactacgagaggaggggaacctcatatgatcgtctccaagcaagaaaggggaaaatctctgttatttaagacctcagccggtgttaacatgtgcacactcattgcaatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggttgacgttgtgctggagcacgggagttgtgtcacaaccatggcaaagaataaacccactttggatatcgaactcctgaagacagaggtgaccaaccctgccgtgcttaggaaactgtgcattgaagctaagatctccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaagggggtgtcttatgtcatgtgtacaggatccttcaaattggagaaggaagtggctgagactcagcacggtaccgttctggtgcaggtaaagtacgagggcacggatgcgccttgcaaaataccaatcagcacacaagacgaaaagggggtcacccagaacggacgcctcattactgcaaatcccatcgtgacagataaagagaagcctgttaacatagaaaccgagccacccttcggcgagtcgtatattgtgatcggtgccggggaaaaagctctgaaactttcttggtttaagaaaggctcctcaatcggaaagatgttcgaggccactgcaagaggcgccaggcggatggctattctgggggacaccgcctgggattttggaagtatcggtggcgtcttcacaagcgtggggaaattggtacatcaggtgtttggaacggcatacggcgttctcttctccggtgtctcttggaccatgaagattgggataggcatcctgttaacttggctgggactaaatagccgatcaacaagtctctccatgacctgtattgcggtgggcatggtgacactgtaccttggggtcatggttcaggctgacagcggatgcgtgatcaactggaaaggccgcgaattgaagtgtggttctgggatctttgtgactaacgaggtacacacctggacggaacaatataagttccaggccgattcaccgaaaagactgagtgcagccattggaaaggcttgggaggagggcgtctgcggtataaggagcgccacacggctcgaaaatatcatgtggaaacagatttccaacgagctgaatcatatcttactggaaaacgacatgaagtttaccgtggttgtgggcgacgcaaatgggattcttactcagggcaagaagatgatccgccctcaacccatggagcacaaatactcttggaagtcgtggggcaaggctaaaataatcggggccgatacccagaacacaactttcattatcgacggaccagatacccctgaatgtcccgacgatcagagagcgtggaatatttgggaggtcgaggactatggctttggtgtgttcacaacgaacatctggttgaagctcagggatagctacacccagatgtgcgaccaccgtctgatgtccgccgctataaaagattcaaaggcagttcatgccgacatggggtattggattgaaagtgagaaaaatgaaacttggaagctagctcgggcctcttttatcgaggtgaagacatgtatttggccacgaagccacaccctgtggtccaacggagtactcgaatcagagatgatcatacccaaaatctacggcggtcctattagccaacataattatagaccaggctacttcactcagacagcagggccgtggcacctgggaaaacttgagttggatttcaacctgtgcgaaggcaccacggtcgtggtggacgagcactgcgggaataggggaccctctttacgcactaccacagtcaccggcaaaatcattcatgaatggtgttgccggtcctgtactctccctccactgagatttaggggtgaggatgggtgctggtacggaatggagatccgccccgttaaggaaaaagaggaaaaccttgtgcgaagtatggtaagcgcgggctctggtgaggtggactccttctcactgggcttgctctgtgtcagtataatgattgaagaggtgatgcggagccgttggtcgagaaagatgctgatgacagggaccctagccgtatttttcctgctcatcatgggacagctgacatggaatgaccttatcaggttgtgcattatggtgggcgctaacgtctccgatcgcatggggatgggaactacctatctggccttaatggcaacgtttaagatgcggcctatgttcgctgtgggcctcctgtttagaaggcttacatctcgagaggttctgctactcaccatcggtctgagcttggtggcctcagtcgaactgccaaacagtttagaggaactcggggacggactggcaatgggcattatgatgcttaaactgttgactgatttccaatcccaccagctctggaccacactgctatctctgacttttataaagaccacgcttagcctcgactacgcctggaaaacaatggctatggtactgtccatcgtgtcattgttccccctgtgtttaagcaccacaagtcagaagacaacctggctcccggttctgcttggctcttttgggtgcaaacctctgactatgttcttgattacagagaataagatctggggacgcaagtcctggccactcaacgaaggtattatggcggtgggcatcgtcagcatactgctatcgtcactgcttaaaaatgatgtgcccctcgccgggcctctgatcgcaggaggcatgttgattgcttgttatgtaatctctggtagttccgccgacttaagcctggagcgggccgctgaggtgtcttgggaagaggaagcagagcatagcggggcctcccacaacattctcgtcgaagttcaggatgacggaaccatgaagatcaaagatgaggagagagacgatacgctgactatacttctgaaggcgaccttgctagctgtgtcaggcgtgtaccccatgagtattccagccacactgtttgtctggtatttctggcagaagaagaaacagaggagcggcgtgctctgggacaccccttctcccccagaagttgagcgtgcagtactggatgacgggatctaccgcatccttcagcggggattactgggtagatcccaggtgggcgtcggggtgttccaagacggagtttttcatacaatgtggcacgtgactaggggcgccgtcctcatgtatcagggtaagcgattggaaccgtcatgggctagtgtgaagaaagatctgattagctacgggggaggctggcggttccagggctcctggaataccggggaggaggtacaggtcatagcagtggaacctggaaagaaccccaaaaatgttcaaacgacaccaggtacttttaagacccccgagggcgaagtgggggccatcgcgctcgacttcaaacctggaacatctggctcgccaattgtcaaccgcgagggtaagatcgtggggctgtacggaaatggcgttgtgaccactagcggcacctatgtctcagctattgcccaggcaaaggcctcccaggaagggccccttcctgagatcgaggatgaagtgtttaaaaagagaaacctgacaataatggacttgcacccgggaagtggtaaaacgaggcggtacctaccagctatcgtacgagaggccattaagagaaaactgcgcactctcatcttagcacccaccagggtggttgcttctgaaatggccgaggcgctgaagggcatgcctattcgttatcaaacaaccgccgtcaagagcgaacatactgggaaagagatcgtggatcttatgtgccacgcaacattcaccatgcggctgctctccccagtgagagtccccaattacaacatgataattatggacgaggctcattttacggatcctgcctcaatcgctgcaaggggatatatctctactcgcgtaggcatgggtgaagccgccgctattttcatgacagcgaccccgcccgggagcgtggaggcatttccacagagtaatgccgttatccaggacgaagaacgagatatacctgaaagatcctggaacagcggatacgactggattaccgatttccccggcaagactgtgtggtttgtcccatctatcaaatcaggcaatgacattgctaactgtttgcggaagaacgggaaaagggtgatccagctgtcccgcaagacattcgacaccgagtatcaaaagactaagaataacgattgggactacgttgtgactacggatataagtgagatgggagccaatttccgtgcagacagagtcattgatcctcggaggtgcctcaagcccgtgatcctgaaagacggtccagaacgcgtaatccttgccggcccgatgcctgtgaccgctgcgagcgccgcacagcgaagagggcggattggaaggaaccagaataaggagggcgatcagtacatctatatgggtcaacccctaaacaatgacgaagatcacgctcattggacagaggccaaaatgctgttggacaacattaatactccagaggggataatccccgcattatttgaacctgagcgcgaaaagtcggccgctattgatggcgagtacagactgaggggagaagcccggaagaccttcgttgagctcatgcgtcgcggcgacctgccagtctggctttcttataaagtggcgtccgaggggtttcagtacagcgatcgaagatggtgcttcgacggagaaaggaacaatcaggtgctggaggaaaacatggacgtcgagatctggacaaaggaaggtgagcggaaaaagctccgccccagatggttggatgcaaggacctattcagaccctctggccctacgggagtttaaagagttcgctgccggccgaagaagtgtttctggggatctgatcctcgagattggaaaacttccgcagcacctgactttacgcgctcaaaatgcattggacaacctggtgatgctccacaattccgaacagggcggtaaagcctacaggcatgctatggaggaactgccagatacgatagagacccttatgctgctcgccttgatcgcagtactgacagggggcgtgactttatttttcctaagcggaaagggcctggggaagacctcaattggactcctttgtgtcatggcgagtagcgtgctgttgtggatggcctccgttgagccccactggatcgctgcctctattatcctggaatttttcctcatggtgctgcttatacctgagcccgaccggcagcgtacaccacaggataaccaactcgcatatgtcgtaatcggtctgttgtttatgattctgaccgtggctgccaacgaaatgggcttactagagactaccaaaaaggacctggggatcggacatgttgtggcagagaatcaccaccatgccacgatgctcgatattgaccttcaccctgctagcgcgtggaccctgtacgccgtcgcaactacaatcataacccccatgatgagacataccattgaaaacacaactgctaatatctccttgacggccattgccaaccaggcagctatcctgatgggcctcgataaaggttggccaatatcaaagatggacatcggggtgcctctgcttgccttaggctgctactctcaggtcaatccgctgaccctcacagcggctgtgttgatgctggttgcccactatgcaattatcggacccggcctacaagccaaagctactagggaggcacagaagcgcaccgccgcggggattatgaagaacccaacagtggatggaatcgtagctatagacctggaccctgtggtctacgatgccaaattcgaaaagcagctcggccagattatgcttctgatcttgtgtaccagtcaaatcctgctcatgcggactacgtgggcactgtgcgagtcgattacattagccaccggtccccttactaccctgtgggaagggagcccaggaaaattttggaatacaactatcgctgtttccatggccaacatattccgaggctcttatctcgccggtgctggcctagccttctcactgatgaagaccctagggggaggcagaagggggacaggagcgcagggcgagacgctgggtgagaaatggaagcgccagctcaatcagcttagcaagtccgaatttaacacctacaaacggagtgggattatggaggtggacagatctgaagccaaggagggactgaaacgtggcgaaactacaaagcatgcagtcagcaggggtaccgctaaattgcggtggttcgtggagcgcaatctggtaaagcctgagggcaaggtgatcgatctcgggtgtggacgaggcgggtggtcatattactgcgccggactgaaaaaggttactgaagtgaaaggctatacaaagggtgggcccggacacgaggaaccgattccaatggcaacctacggctggaacatcgtcaaactacactccggcagagacgtgtttttcacgcctcccgagaagtgtgatacccttctgtgcgacataggggaaagtagcccaaatcccacaatcgaggagggaaggactctacgggtcctcaaaatggtggaaccttggctgcgcggtaaccaattttgtattaagatcttgaatccgtacatgccctctgttgtagagaccctggaacagatgcagagaaagcatggcgggatgctcgtgaggaacccactttcccgaaattcaacacacgagatgtattgggtcagctgcggaactggcaacattgtgtcggctgttaacatgacctctcggatgctgttaaatcgtttcacaatggcccatagaaaacctacctacgagcgcgatgtggacctgggtgccgggactaggcacgtcgcggtggaacccgagatcgctaacttggatattatcggacagcggatagaaaatattaagaacgagcacaaaagtacgtggcattatgacgaagataatccttacaagacatgggcatatcacggctcctacgaggtaaaaccaagcggctcagcctcctctatggtgaacggggttgtcagactcctgaccaagccctgggacgtgatccctatggtgactcaaatcgctatgaccgacacaacgccatttggacagcagcgcgtcttcaaggagaaagttgataccaggactccccgaccgaagcggggtacagcccaaattatggaagtgaccgcaaaatggctatggggctttcttagcagaaataagaaacctaggatatgtactcgcgaggagttcacacgtaaggtacggagtaacgccgctatcggggcggtgtttgtcgacgagaatcagtggaactccgccaaggaagcagtggaggatgagagattctgggacctggttcatagggaacgcgagctccacaaacagggaaagtgcgctacctgcgtgtataatatgatgggcaaacgagaaaagaaactgggtgagtttgggaaggccaagggaagccgggcaatttggtacatgtggttgggcgccagattcctggagttcgaggctctcggctttatgaacgaggatcattggttctctagggaaaattcacttagtggggtcgagggagaaggtctgcacaaattaggctacatcctgcgcgacatttccaagatcccagggggaaacatgtatgccgatgacacagcgggctgggatactagaataaccgaggacgatttgcagaatgaggcaaaaatcacggacattatggaacccgagcacgccctcctggctaccagcatctttaagctaacataccaaaacaaagtggtacgggttcagaggcctgccaagtctggtactgtgatggatgtcatttcgcgtcgagaccagcgcgggtcaggacaggtgggcacctatggccttaacacattcactaatatggaagtgcaactgatcagacagatggagagcgaagggatattttccccaagtgagctcgagaactctaatctggcagaacgggtcttggactggttagagaaacatggagttgaaaggctgaagcgcatggctattagcggtgatgactgtgtggtaaagcccaccgatgacagattcgccacggctctcacagcccttaacgatatgggcaaagtgcggaaggacatcccgcagtgggagccttccaaagggtggaatgattggcagcaagtccccttttgctcacaccatttccaccagctgatcatgaaggacggaagggaaattgtggttccatgtcgaaaccaggatgagctagtgggccgtgcaagagtcagtcagggtgcggggtggtctctgcgcgagaccgcctgcctcggaaaaagctacgctcaaatgtggcagttgatgtattttcaccggagggacctgagacttgccgcaaatgctatatgttccgccgtgcctgtaaactgggttcccacttcacgcacaacctggagcatccatgcacaccatcagtggatgactaccgaagatatgctgtctgtgtggaatcgggtctggattgaggaaaacccatggatggaggacaagacacacgtgtccagttgggaagacgttccctacctcggcaagagggaggatcaatggtgcggcagcttaatcgggctgacggcccgagcgacctgggctactaatattcaggtggccatcaaccaggtcagacggttgataggaaatgagaactatctggactacatgacatcgatgaaaaggttcaagaatgaatccgatcctgagggtgcactctggtga

SEQ ID NO: 14193 - RNA, 9879 nt, synthetic construct
  misc_feature 1..9879: note = derived and/or modified CDS sequence (opt3) from DENV-1__KM403585__SS-prME
  source 1..9879: mol_type = other RNA
agcgtgaccatgctgctcatgcttctgcccactgcattggctttccacttaactacgagaggaggggaacctcatatgatcgtctccaagcaggaaaggggaaaatctctgttgtttaagacctcagccggtgttaacatgtgcactctcattgcaatggacctgggcgagctttgtgaagatactatgacctacaaatgcccacggataacagaggcggaaccggacgatgtggactgttggtgcaatgctaccgatacttgggtgacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaagtgcgtaaccaaactggaggggaggatagtgcagtacgaaaacctcaagtattccgtcattgtgacagttcacaccggagatcagcatcaagtgggtaatgagactacggaacacggcacaatcgccaccattactccccaggcgcctacctcagaggtccagcttacagactacggggccctgaccttggactgtagtccacggactggactagatttcaacgaaatggtgctgctcacaatgaaagagaaaagctggctggtacataaacagtggtttcttgacctgccgttgccctggacgtctggcgcatccacctcacaagaaacttggaatcgtcaggatctcctggttacattcaagaccgctcacgccaaaaagcaggaagtggtcgtgttaggtagccaagagggggctatgcacacagccctgactggcgcaaccgaaatccagacgagtggaaccacaactatctttgccggccatctaaagtgccgcctcaaaatggacaagctgacccttaaaggggtctcttatgtgatgtgtacaggatccttcaagttggagaaagaagttgctgagactcagcacggtaccgtgctggtacaggtcaagtacgagggcacggatgcgccttgcaagattccaataagcacacaagacgaaaaaggggtgacccagaacggaagactcatcactgcaaatcccattgttacagataaggagaaacctgtgaacatcgaaaccgagccacccttcggcgagtcgtatatagtcattggtgccggggaaaaggctctgaaactttcttggtttaagaagggctcctcaatcggaaaaatgttcgaggccactgcaaggggcgcccggcgaatggctatcctgggggacaccgcctgggattttggaagtattggtggcgtgttcacaagcgtagggaagttggtgcatcaggtttttggaacggcatacggcgtcctcttctccggtgtgtcttggaccatgaaaatcgggattggcatactgttaacttggctgggactaaatagccgctcaacaagtctctccatgacctgtatcgcggtgggcatggtcacactgtaccttggggttatggtgcaggctgacagcggatgcgtgattaactggaagggcagagaattgaaatgtggttctgggatctttgtaactaacgaggtccacacctggacggaacaatataagttccaggccgattcaccgaagaggctgagtgcagccatcggaaaggcttgggaggagggcgtgtgcggtattcggagcgccacacgcctcgaaaatataatgtggaagcagatctccaacgagctgaatcatattttactggaaaacgacatgaaatttaccgttgtggtcggcgacgcatacgggatccttactcagggaaagaaaatgattagacctcaacccatggagcacaagtattcttggaaatcgtggggcaaggctaagatcataggggccgatacccagaatacaactttcatcattgacggaccagatacccctgaatgtcccgacgatcagagggcgtggaacatctgggaggtggaggactacggctttggtgttttcacaacgaatatttggttgaaactccgtgatagctatacccagatgtgcgaccaccggctgatgtccgccgctatcaaggattcaaaagcagtgcatgccgacatggggtactggatagaaagtgagaagaacgaaacttggaaactagctcgagcctcttttattgaggtaaagacatgtatctggccaagaagccacaccctgtggtccaatggagtcctcgaatcagagatgattatccccaagatatatggcggtcctatcagccaacataactacaggccaggctacttcactcagacagcagggccgtggcacctgggaaaacttgagttggatttcaatctgtgcgaaggcaccacggtggtggtcgacgagcactgcgggaaccgcggaccctctttacggactaccacagttaccggcaagattatccatgaatggtgttgcagatcctgtactctccctccactgaggtttcgcggtgaggatgggtgctggtatggaatggagattcgacccgtgaaagaaaaggaggaaaatcttgtacggagtatggtgagcgcgggctctggtgaggtcgactccttctcactgggcttgctctgtgtgagtatcatgatagaagaggttatgcgtagcagatggtcgaggaaaatgctgatgacagggaccctagccgtgtttttcctgctcattatgggacagctgacatggaacgaccttatccgcttgtgcatcatggtcggcgctaatgtgtccgatcggatggggatgggaactacctacctggccttaatggcaacgtttaagatgagacctatgttcgctgttggcctcctgtttaggcgacttacatctcgcgaggtgctgctactcaccattggtctgagcttggtcgcctcagtagaactgccaaacagtttagaggaactcggggacggactggcaatgggcatcatgatgcttaagctgttgactgatttccaatcccaccagctctggaccacactgctatctctgacttttattaaaaccacgcttagcctcgactatgcctggaagacaatggctatggtgctgtccatagtttcattgttccccctgtgtttaagcaccacaagtcagaaaacaacctggctcccggtgctgcttggctcttttgggtgcaagcctctgactatgttcttgatcacagagaacaaaatttggggacggaagtcctggccactcaatgaaggtatcatggcggtcggcattgtgagcatcctgctatcgtcactgcttaagaacgatgtacccctcgccgggcctctgatagcaggaggcatgttgatcgcttgttacgtgatttctggtagttccgccgacttaagcctggagagagccgctgaggtctcttgggaagaggaagcagagcatagcggggcctcccacaatatcctcgttgaagtgcaggatgacggaaccatgaaaattaaggatgaggagagggacgatacgctgactatccttctgaaagcgaccttgctagctgtgtcaggcgtctatcccatgagtataccagccacactgtttgtgtggtacttctggcaaaagaaaaagcagcgtagcggcgttctctgggacaccccttctcccccagaagtagagcgcgcagtgctggatgacgggatttatcggatccttcagagaggattactgggtaggtcccaggtcggcgtgggggttttccaagacggagtgtttcatacaatgtggcacgtcactcgaggcgccgtgctcatgtaccagggtaaacggttggaaccgtcatgggctagtgtaaagaaggatctgatcagctacgggggaggctggcgcttccagggctcctggaacaccggggaggaggtccaggtgattgcagttgaacctggcaagaatcccaagaacgtgcaaacgacaccaggtacttttaaaacccccgagggcgaagtcggggccatagcgctcgacttcaagcctggaacatctggctcgccaatcgtgaatagagagggtaaaattgttgggctgtatggaaacggcgtggtcaccactagcggcacctacgtgtcagctatcgcccaggcaaaggcctcccaggaagggccccttcctgagattgaggatgaagtatttaagaaaaggaatctgacaatcatggacttgcacccgggaagtggtaagacgcggcgatatctaccagctatagtgagagaggccatcaaacgcaagctgaggactctcattttagcacccacccgtgttgtcgcttctgaaatggccgaggcgctgaaaggcatgcctatccggtaccaaacaaccgccgtaaagagcgaacatactgggaaggagattgtggatcttatgtgccacgcaacattcaccatgagactgctctccccagtcagggtacccaactataatatgatcataatggacgaggctcattttacggatcctgcctcaattgctgcacgcggatacatctctactcgagtgggcatgggtgaagccgccgctatcttcatgacagcgaccccgcccgggagcgttgaggcatttccacagagtaacgccgtgattcaggacgaagagagagatatccctgaacggtcctggaatagcggatatgactggataaccgatttccccggcaaaactgtctggtttgtgccatctattaagtcaggcaacgacatcgctaattgtttgaggaaaaacgggaagcgcgttattcagctgtcccgtaaaacattcgacaccgagtaccaaaagacaaagaacaatgattgggactacgtggtcactacggatatcagtgagatgggagccaacttcagagcagaccgggtgatagatcctaggcgctgcctcaaacccgtaattctgaaggacggtccagaacgagtgatccttgccggcccgatgcctgttaccgctgcgagcgccgcacagagacgggggaggatcggacgcaatcagaacaaagagggcgatcagtatatttacatgggtcaacccctaaataacgacgaagatcacgctcattggacagaggccaagatgctgttggacaatatcaacactccagaggggattatacccgcattatttgaacctgagagagaaaaatcggccgctatcgatggcgagtataggctgcggggagaagcccgtaagaccttcgtcgagctcatgcgccgaggcgacctgccagtgtggctttcttacaaggtggcgtccgaggggtttcagtatagcgatagaaggtggtgcttcgacggagaacggaataaccaggtcctggaggaaaatatggacgttgagatttggacaaaagaaggtgagcgcaagaaactcagacccaggtggttggatgcacggacctactcagaccctctggccctacgagagtttaaggagttcgctgccggcagacgcagtgtgtctggggatctgatcctcgagatcggaaaacttccgcagcacctgactttaagggctcaaaacgcattggacaatctggtaatgctccacaactccgaacagggcggtaaggcctatcggcatgctatggaggaactgccagatacgattgagacccttatgctgctcgccttgatagcagtgctgacagggggcgtcactttatttttcctaagcggaaaaggcctggggaagacctcaatcggactcctttgtgtgatggcgagtagcgttctgttgtggatggcctccgtggagccccactggattgctgcctctatcattctggaatttttcctcatggtcctgcttatccctgagcccgaccgtcagagaacaccacaggataatcaactcgcatacgtagtgataggtctgttgtttatgatcctgaccgttgctgccaacgaaatgggcttactagagactacaaagaaagacctggggattggacatgtggtcgcagagaaccaccaccatgccacgatgctcgatatcgaccttcaccctgctagcgcgtggaccctgtacgccgtggcaactacaattatcacccccatgatgaggcataccatagaaaatacaactgctaacatttccttgacggccatcgccaatcaggcagctattctgatgggcctcgataagggttggccaatctcaaaaatggacataggggtccctctgcttgccttaggctgctattctcaggtgaacccgctgaccctcacagcggctgttttgatgctggtggcccactacgcaatcattggacccggcctacaagccaaggctactcgcgaggcacagaaacggaccgccgcggggatcatgaagaatccaacagtagatggaattgtggctatcgacctggaccctgtcgtttatgatgccaagttcgaaaaacagctcggccagataatgcttctgattttgtgtaccagtcaaatcctgctcatgcgaactacgtgggcactgtgcgagtcgatcacattagccaccggtccccttactaccctgtgggaagggagcccaggaagattttggaacacaactattgctgtgtccatggccaatatcttcaggggctcttacctcgccggtgctggcctagccttctcactgatgaaaagcctagggggaggccgccgggggaccggagcgcagggcgagacactgggtgagaaatggaagagacagctcaaccagctttccaaaagtgaatttaatacgtataagcgttctgggatagtcgaggtggacaggagcgaagccaaggagggaatgaaacggggcgaaaccactaagcatgcagtatcacgcggtacagctaaactgcgatggttcgtggagagaaacttggttaagcctgagggcaaagtgattgatctggggtgtggaaggggcgggtggtcctactattgcgccggactcaagaaggtcaccgaagtgaaaggctacactaagggtgggcccggacacgaggaaccgatcccaatggcaacatacggctggaatattgtcaaattacacagtggccgggacgtgtttttcacccctcccgagaagtgtgatacgctgctttgcgacatcggggaaagctctccaaaccccaccatagaggagggacgcacactgagagttctaaaaatggtagaaccttggctcaggggtaatcaattttgtatcaagattctgaacccgtatatgccctccgtggtcgagactttggaacagatgcagcgaaaacatggcgggatgctggtgcggaatccactctcacgtaacagcacccacgagatgtactgggtttcgtgcggaacaggcaatatcgtgtctgctgtcaacatgacaagtagaatgcttctgaaccgcttcaccatggcccataggaagcctacatatgagcgggatgtggacttaggtgccgggaccagacacgtagcggtggaacccgagattgctaatctggatatcattggacagcgcatcgaaaacataaagaatgagcacaaatccacttggcattacgacgaagataacccttataagacgtgggcataccacggcagctatgaggttaaaccatcaggctccgcctctagcatggtcaatggggtggtgaggttgctcacaaagccctgggacgtcattcctatggttacccaaatcgctatgactgacaccacaccatttggacagcagcgagtgttcaaagagaaggtagatacgcggacccccagaccgaagaggggtactgcccaaatcatggaagtgacagcaaaatggctgtggggctttctaagtcgcaacaagaaacctcgtatttgtacccgggaggagttcactagaaaggtcaggtccaatgccgctataggggcggtgtttgttgacgagaaccagtggaatagcgccaaagaagcagtggaggatgagcgcttctgggaccttgtccatcgagaacgggagctgcacaagcagggaaagtgcgctacatgcgtgtacaacatgatgggcaaaagagaaaagaaactcggtgagtttgggaaggccaaaggatctagggcaatctggtacatgtggctgggcgcccgcttcttggagttcgaggctctgggctttatgaatgaggatcattggttctcaagagaaaacagtctctccggggtagagggagaaggtcttcacaagctgggctatattttacgggacatcagcaagattccagggggaaatatgtacgccgatgacaccgcgggctgggatacaaggatcactgaggacgatctgcagaacgaggcaaaaataaccgacatcatggaacccgagcacgccttgctcgctacgtctatttttaagctgacctatcaaaataaagttgtgcgtgtccagcgacctgccaagtcgggtacagtgatggatgtgatctcacgcagagaccagcgggggagcggacaggtcggcacttacggcctaaacaccttcacaaacatggaagttcaacttattaggcagatggagtccgaagggatctttagtccatctgagctggagaatagcaacctcgcagaacgcgtgctggactggttggagaaacatggagtagaaagattaaagcggatggctatatccggtgatgactgtgtggtcaaacccactgatgacaggttcgccaccgctctgacggccctcaatgatatgggcaaggtgcgaaaggacattccgcagtgggagccttcaaaagggtggaacgattggcagcaagttcccttttgcagtcaccatttccaccagcttatcatgaaggacggacgtgaaatcgtggtcccatgtagaaatcaggatgagctggtgggccgcgcacgggtatctcagggtgcggggtggagcctaagggagacagcctgcctgggaaaatcctatgctcaaatgtggcagctcatgtactttcacagacgcgacttgcggctggccgcaaacgctatttgttcagccgttcctgtgaattgggtccccaccagcaggactacatggtctatacatgcacaccatcagtggatgaccactgaagatatgctttccgtgtggaaccgagtttggatcgaggaaaatccatggatggaggacaagacccacgtgagtagctgggaagacgtcccctatctgggcaaaagagaggatcaatggtgcggctcgctcattgggttaacagcccgggcgacgtgggctaccaacatccaggtggccattaatcaggtaaggcgcctgatcggaaacgagaattacttggactacatgacttccatgaagcgtttcaagaacgaatctgatcctgagggtgcactgtggtga

SEQ ID NO: 14194 - RNA, 9879 nt, synthetic construct
  misc_feature 1..9879: note = derived and/or modified CDS sequence (opt3) from DENV-1__KM403595__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagaccgtagaagcgtggccctggcaccccatgtcggcttgggtctcgagactaggaccgaaacatggatgtcctctgagggggcctggcggcagatccagcgcgtggaaacttgggctctgagacaccctggattcaccgttattgcactgtttctcgcccatgctatcggcacatcgattacccagaagggcatcatattcatcttactgatgcttgtgacgccatcaatggccatgaggtgcgtcgggattggaaaccgggattttgtggagggtttgagcggcgcgacttgggtagacgttgtgctggagcacgggagttgtgtcacaaccatggcaaaaaataagcccactctagatatcgaactcctgaagacagaggtgaccaaccctgccgtgcttcgcaaactgtgcattgaagctaagatctccaatacgaccacagactctcgatgtccaactcaaggagaggccaccttggtcgaagagcaggatgcaaacttcgtttgcagaaggacatttgtggaccggggctggggtaatgggtgtggactcttcggcaaaggcagcctgttaacttgcgctaagtttaaatgcgtaaccaagctggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccacgtactggactagatttcaacgaaatggtcctgctcacaatgaaggagaaaagctggctggtgcataagcagtggtttcttgacctgccgttgccctggacgtctggcgcatccacctcacaagagacttggaatcgccaggatctcctggtaacattcaaaaccgctcacgccaagaaacaggaagttgtggtcttaggtagccaagagggggctatgcacacagccctgactggcgcaaccgaaatccagacgagtggaaccacaactatttttgccggccatctaaagtgcagactcaagatggacaaactgacccttaagggggtgtcttatgtcatgtgtacaggatccttcaaattggagaaggaagtggctgagactcagcacggtaccgttctggtgcaggtaaaatacgagggcacggatgcgccttgcaagataccaatcagcacacaagacgaaaagggggtcacccagaacggaaggctcattactgcaaatcccatcgtgacagataaagagaagcctgttaacatagaaattgagccacccttcggcgagtcgtatatcgtgatcggtgccggggaaaaagctctgaagctttcttggtttaaaaagggctcctcaattggaaagatgttcgaggccaccgcacggggcgcccgacgcatggctatcctgggggacactgcctgggattttggaagtattggtggcgtcttcaccagcgtggggaaattggtacatcaggtgtttggaacagcatacggcgttctcttctccggtgtctcttggacgatgaagatagggatcggcattctgttaacctggctgggactaaatagcagatcaactagtctctccatgacatgtatcgcggtgggcatggtgaccctgtaccttggggtcatggttcaggctgacagcggatgcgtgatcaactggaaaggcagggaattgaagtgtggttctgggatttttgtgacaaacgaggtacacacttggaccgaacaatataaattccaggccgattcaccgaagcggctgagtgcagccataggaaaggcttgggaggagggcgtctgcggtatccgcagcgccacgagactcgaaaatattatgtggaaacagatctccaacgagctgaatcatattttactggaaaacgacatgaagtttacagtggttgtgggcgacgcaaatgggatccttacccagggaaaaaagatgataaggcctcaacccatggagcacaaatactcttggaagtcgtggggcaaagctaagatcattggggccgatactcagaacaccacattcatcattgacggaccagatactcctgaatgtcccgacgatcagcgtgcgtggaatatctgggaggtcgaggactatggctttggtgtgttcaccacaaacatatggttgaagctccgggatagctacacgcagatgtgcgaccaccgactgatgtccgccgctattaaagattcaaaggcagttcatgccgacatggggtattggatcgaaagtgagaaaaatgaaacctggaagctagctagagcctcttttattgaggtgaaaacttgtatctggccaaggagccacacactgtggtccaacggagtactcgaatcagagatgataatccccaagatttacggcggtcctatcagccaacataattatcgcccaggctacttcacccagactgcagggccgtggcacctgggaaagcttgagttggatttcaacctgtgcgaaggcacaaccgtcgtggtggacgagcactgcgggaatcggggaccctctttaagaacgactaccgtcacaggcaaaattatccatgaatggtgttgcaggtcctgtaccctccctccactgcgctttcgaggtgaggatgggtgctggtacggaatggagatacggcccgttaaggaaaaagaggaaaaccttgtgcgtagtatggtaagcgcgggctctggtgaggtggactccttctcactgggcttgctctgtgtcagtattatgatcgaagaggtgatgagaagcaggtggtcgcgcaagatgctgatgactgggacactagccatctttttcctgctcattatgggacagctgacctggaatgaccttatccggttgtgcattatggttggcgctaacgtgtccgatagaatggggatgggaacaacttatctggccttaatggcaacctttaaaatgaggcctatgttcgctgtcggcctcctgtttcgacgccttacgtctcgggaggtgctgctactcacaataggtctgagcttggttgcctcagtggaactgccaaacagtttagaggaactcggggacggactggcaatgggcatcatgatgcttaagctgttgaccgatttccaatcccaccagctctggactaccctgctatctctgacatttattaagactacccttagcctcgactacgcctggaaaacgatggctatggtcctgtccatcgtatcattgttccccctgtgtttaagcacaaccagtcagaagactacatggctcccggtgctgcttggctcttttgggtgcaaacctctgaccatgttcttgattactgagaataagatctggggaagaaaatcctggccactcaacgaaggtataatggcggttggcatcgtgagcattctgctatcgtcactgcttaagaatgatgtccccctcgccgggcctctgatcgcaggaggcatgttgattgcttgttatgtgatctctggtagttccgccgacttaagcctggagagggccgctgaggtatcttgggaagaggaagcagagcatagcggggcctcccacaacatactcgtggaagtccaggatgacggaacaatgaagattaaagatgaggagcgtgacgataccctgacgatccttctgaaggcgactttgctagctgtttcaggcgtgtaccccatgagtatcccagccaccctgtttgtgtggtatttctggcaaaaaaagaaacagcgcagcggcgtcctctgggacacaccttctcccccagaagtggagcgggcagttctggatgacgggatttacagaatacttcagaggggattactgggtcgatcccaggtaggcgtgggggtcttccaagacggagtgtttcataccatgtggcacgttacacggggcgccgtgctcatgtatcagggtaagcgcttggaaccgtcatgggctagtgtcaaaaaggatctgatcagctacgggggaggctggagattccagggctcctggaatactggggaggaggtgcaggtaattgcagtcgaacctggaaagaaccccaaaaatgtgcaaaccacgccaggtacatttaagactcccgagggcgaagttggggccatcgcgctcgacttcaaacctggaacctctggctcgccaattgtgaacagggagggtaagatcgtcgggctgtacggaaatggcgtggttacaaccagcggcacttatgtgtcagctatagcccaggcaaaagcctcccaggaagggccccttcctgagatcgaggatgaagtctttaagaagcggaacctgaccattatggacttgcacccgggaagtggtaaaacacgaagatacctaccagctatcgtgcgcgaggccattaagaggaaactgcgtacgctcatcttagcacccactcgggtagtggcttctgaaatggccgaggcgctgaagggcatgcctataagatatcaaaccacagccgttaaaagcgaacataccgggaaggagattgtcgatcttatgtgccacgcaactttcacaatgaggctgctctccccagtgcgcgtgcccaattacaacatgatcatcatggacgaggctcattttaccgatcctgcctcaattgctgcacgaggatatatctctacgagagtcggcatgggtgaagccgccgctatattcatgactgcgacaccgcccgggagcgtagaggcatttccacagagtaatgccgtgattcaggacgaagagcgggatatccctgaaaggtcctggaacagcggatacgactggattaccgatttccccggcaagaccgtttggtttgtgccatctatcaaatcaggcaatgacatagctaactgtttgcgcaagaacgggaaacgtgtcattcagctgtccagaaagactttcgacacagagtatcaaaaaaccaagaataacgattgggactacgtggttacaactgatatcagtgagatgggagccaatttccgggcagacagggtgatcgatcctcgccgatgcctcaagcccgtcattctgaaagacggtccagaaagagtgatccttgccggcccgatgcctgtaacggctgcgagcgccgcacagcggagggggcgcattggaagaaaccagaataaggagggcgatcagtacatatatatgggtcaacccctaaacaatgacgaagatcacgctcattggaccgaggccaaaatgctgttggacaacatcaatacaccagaggggattatccccgcattatttgaacctgagagggaaaagtcggccgctatcgatggcgagtaccggctgcgtggagaagcccgcaaaactttcgtggagctcatgcgaagaggcgacctgccagtttggctttcttataaggtcgcgtccgaggggtttcagtacagcgataggcggtggtgcttcgacggagaacgcaacaatcaggtgctggaggaaaacatggacgtggagatttggaccaaggaaggtgagagaaaaaagctcaggccccggtggttggatgcacgaacatattcagaccctctggccctaagagagtttaaagaattcgctgccggccgcaggagtgtctctggggatctgatactcgagatcggaaagcttccgcagcacctgaccttacgggctcaaaatgcattggacaacctggttatgctccacaattccgaacagggcggtaaagcctaccgtcatgctatggaggaactgccagatactattgagacgcttatgctgctcgccttgatcgcagtgctgaccgggggcgtaacattatttttcctaagcggaaagggcctggggaaaacttcaattggactcctttgtgtgatggcgagtagcgtcctgttgtggatggcctccgtggagccccactggatcgctgcctctataatcctggaatttttcctcatggttctgcttattcctgagcccgacagacagaggaccccacaggataaccaactcgcatatgtggtcatcggtctgttgtttatgattctgacagtagctgccaacgaaatgggcttactagagaccactaagaaggacctggggatcggacatgtggttgcagagaatcaccaccatgccacaatgctcgatatagaccttcaccctgctagcgcgtggacgctgtacgccgtggcaaccactattatcacacccatgatgcgccataccattgaaaacaccacagctaatatctccttgactgccatagccaaccaggcagctatcctgatgggcctcgataaaggttggccaatttcaaagatggacatcggggtccctctgcttgccttaggctgctactctcaggtgaatccgctgacgctcaccgcggctgtcttgatgctggtggcccactatgcaattatcggacccggcctacaagccaaagctacacgggaggcacagaagcgaactgccgcggggataatgaaaaacccaaccgttgatggaattgtggctatcgacctggaccctgtagtgtacgatgccaagttcgaaaagcagctcggccagatcatgcttctgattttgtgtacaagtcaaatcctgctcatgagaaccacttgggcactgtgcgagtcgataacgttagccacaggtccccttaccactctgtgggaagggagcccaggaaaattttggaataccacaattgctgtctccatggccaacatcttcaggggctcttatctcgcaggtgctggcctagccttctcactgatgaagagcttggggggaggccgccgggggactggagcgcagggcgagaccctgggtgagaaatggaagagacagctcaatcagctttccaaaagtgaatttaacacatacaagcgttctgggattatggaggttgacaggagcgaagccaaggagggactgaaacggggcgaaacgaccaagcatgcagtgtcacgcggtactgctaaattgcgatggttcgtcgagagaaatctggtgaagcctgagggcaaagtaatcgatctcgggtgtggaaggggcgggtggtcctattactgcgccggattaaagaaggtgacagaagttaaaggctataccaagggtgggcccggacacgaggaaccgataccaatggcaacttacggctggaacatcgtgaaactgcacagtggccgggacgtctttttcacacctcccgagaagtgtgatacccttctgtgcgacattggggaaagctctccaaatcccacgatcgaggagggacgcaccctaagagtgctcaaaatggtcgaaccttggctgaggggtaaccaattttgtattaagatcttgaatccgtacatgccctccgtggttgagacactggaacagatgcagcgaaaacatggcgggatgctcgtacggaacccactttcacgtaatagcactcacgagatgtattgggtgtcgtgcggaaccggcaacattgtctctgctgtgaacatgacaagtagaatgctgttaaatcgcttcactatggcccataggaagcctacctacgagcgggatgttgacctgggtgccgggacaagacacgtggcggtcgaacccgagaccgctaacttggatatcataggacagcgcattgaaaatatcaagaacgagcacaaatccacttggcattatgacgaagataatccttacaagacgtgggcatatcacggcagctacgaggtgaaaccatcaggctccgcctctagcatggtaaacggggtggttaggctcctgacaaagccctgggacgtcatccctatggtgacccaaattgctatgactgacaccacaccatttggacagcagcgagtgttcaaagagaaggtcgatacgcggacccccagaccgaagaggggtactgcccaaataatggaagttacagcaaaatggctatggggctttcttagtcgcaataagaaacctcgtatctgtacccgggaggaattcactagaaaggtgaggtccaacgccgctattggggcggtatttgtggacgagaatcagtggaacagcgccaaagaagcagtcgaggatgagcgcttctgggacctggtgcatcgagaacgggagctccacaagcagggaaagtgcgctacatgcgtttataatatgatgggcaaaagagaaaagaaactgggtgagtttgggaaggccaaaggatctagggcaatctggtacatgtggttgggcgcccgcttcctggaattcgaggctctcggctttatgaacgaggatcattggttctcaagagaaaatagtctttccggggtggagggagaaggtctgcacaagttaggctacattctgcgggacatcagcaagataccagggggaaacatgtatgccgatgacaccgcgggctgggatacaaggatcactgaggacgatttgcagaatgaggcaaaaattaccgacatcatggaacccgagcacgccctcctggctacgtctatttttaagctaacctaccaaaacaaagtcgtgcgtgtacagcgacctgccaagtcgggtacagttatggatgtgatctcacgcagagaccagcgggggagcggacaggtcggcacttatggccttaacaccttcacaaatatggaagtgcaactgataaggcagatggagtccgaagggatttttagtccatctgagctcgagaacagcaatctggcagaacgcgtgttggactggttagagaaacatggagtcgaaagactgaagcggatggctatctccggtgatgactgtgttgtgaaacccactgatgacaggttcgccaccgctctcacggcccttaacgatatgggcaaggtacgaaaggacatcccgcagtgggagccttcaaaagggtggaatgattggcagcaagtgcccttttgcagtcaccatttccaccagctgattatgaaggacggacgtgaaatagtcgtgccatgtagaaaccaggatgagctagttggccgcgcacgggtgtctcagggtgcggggtggagcctgagggagacagcctgcctcggaaaatcctacgctcaaatgtggcagttgatgtattttcacagacgcgacctgcggcttgccgcaaatgctatctgttcagccgtccctgtgaactgggtacccaccagcaggactacatggtctattcatgcacaccatcagtggatgaccactgaagatatgctgtccgtttggaatcgagtgtggatcgaggaaaacccatggatggaggacaagacccacgtcagtagctgggaagacgtgccctacctcggcaaaagagaggatcaatggtgcggctcgttaattgggctgacagcccgggcgacgtgggctaccaatatccaggttgccataaaccaggtgaggcgcttgatcggaaatgagaactatctggactacatgacttccatgaagcgtttcaagaatgaatctgatcctgagggtgcactctggtga

SEQ ID NO: 14195 - RNA, 9879 nt, synthetic construct
  misc_feature 1..9879: note = derived and/or modified CDS sequence (opt3) from DENV-1__KM403604__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacagggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcacaagcaatggtttcttgacctgccgttgccctggacgtctggcgcatccacctcacaggagacttggaatcggcaggatctcctggtaacattcaaaaccgctcatgccaagaagcaagaagttgtggtcttaggtagccaggagggggctatgcacacagccctgactggcgcaaccgaaatccagacgagtggaaccacaactatttttgccggccacctaaaatgccgtctcaagatggacaaactgacccttaagggggtgtcttatgtcatgtgtacaggatccttcaaattggagaaggaagtggctgagactcagcatggtaccgttctggtgcaagtaaagtacgagggcacggatgcgccttgcaaaataccaatcagcacacaggacgaaaagggggtcacccagaacggacgcctcattactgcaaatcccatcgtgacagataaagagaagcctgttaacatagaaaccgagccacccttcggcgagtcgtatattgtgatcggtgccggggaaaaagctctgaagctttcttggtttaagaaaggctcctcaatcggaaagatgttcgaggccactgcaagaggcgccaggcggatggctattctgggggacaccgcctgggattttggaagtatcggtggcgtcttcacaagcgtggggaaattggtacaccaggtgtttggaacggcatacggcgttctcttctccggtgtctcttggaccatgaagattgggataggcatcctgttaacttggctgggactaaatagccgatcaacaagtctctccatgacctgtattgcggtgggcatggtgacactgtaccttggggtcatggttcaagctgacagcggatgcgtgatcaactggaaaggccgcgaattgaagtgtggttctgggatctttgtgactaacgaggtacatacctggacggaacagtataagttccaggccgattcaccgaaaagactgagtgcagccattggaaaggcttgggaggagggcgtctgcggtataaggagcgccacacggctcgaaaatatcatgtggaaacagatttccaacgagctgaatcacatcttactggaaaacgacatgaagtttaccgtggttgtgggcgacgcaaatgggattcttactcaaggaaaaaagatgatccgccctcagcccatggagcataaatactcttggaagtcgtggggcaaggctaaaataatcggggccgatacccagaacacaactttcattatcgacggaccagatacccctgaatgtcccgacgatcagagagcgtggaatatttgggaggtcgaggactatggctttggtgtgttcacaacgaacatctggttgaagctcagggatagctacacccaaatgtgcgaccaccgtctgatgtccgccgctataaaagattcaaaggcagttcacgccgacatggggtattggattgaaagtgagaaaaatgaaacttggaagctagctcgggcctcttttatcgaggtgaagacatgtatttggccacgaagccataccctgtggtccaacggagtactcgaatcagagatgatcatacccaaaatctacggcggtcctattagccagcacaattatagaccaggctacttcactcagacagcagggccgtggcatctgggaaagcttgagttggatttcaacctgtgcgaaggcaccacggtcgtggtggacgagcactgcgggaataggggaccctctttacgcactaccacagtcaccggcaaaatcattcacgaatggtgttgccggtcctgtactctccctccactgagatttaggggtgaggatgggtgctggtacggaatggagatccgccccgttaaggaaaaagaggaaaaccttgtgcgaagtatggtaagcgcgggctctggtgaggtggactccttctcactgggcttgctctgtgtcagtataatgattgaagaggtgatgcggagccgttggtcgagaaagatgctgatgacagggaccctagccgtttttttcctgctcatcatgggacaactgacatggaatgaccttatcaggttgtgcattatggtgggcgctaacgtctccgatcgcatggggatgggaactacctatctggccttaatggcaacgtttaagatgcggcctatgttcgctgtgggcctcctgtttagaaggcttacatctcgagaggttctgctactcaccatcggtctgagcttggtggcctcagtcgaactgccaaacagtttagaggaactcggggacggactggcaatgggcattatgatgcttaaactgttgactgatttccagtcccatcagctctggaccacactgctatctctgacttttataaagaccacgcttagcctcgactacgcctggaaaacaatggctatggtactgtccatcgtgtcattgttccccctgtgtttaagcaccactagtcagaagacaacctggctcccggttctgcttggctcttttgggtgcaaacctctgactatgttcttgattacagagaataagatctggggacgcaagtcctggccactcaacgaaggtattatggcggtgggcatcgtcagcatactgctatcgtcactgcttaaaaatgatgtgcccctcgccgggcctctgatcgcaggaggcatgttgattgcttgttatgtaatctctggtagttccgccgacttaagcctggagcgggccgctgaggtgtcttgggaagaggaagcagagcacagcggggcctcccataacattctcgtcgaagttcaagatgacggaaccatgaagatcaaagatgaggagagagacgatacgctgactatacttctgaaggcgaccttgctagctgtgtcaggcgtgtaccccatgagtattccagccacactgtttgtctggtatttctggcagaaaaagaaacagaggagcggcgtgctctgggacaccccttctcccccagaagttgagcgtgcagtactggatgacgggatctaccgcatccttcagcggggattactgggtagatcccaagtgggcgtcggggtgttccaggacggagtttttcacacaatgtggcatgtgactaggggcgccgtcctcatgtatcagggtaagcgattggaaccgtcatgggctagtgtgaagaaagatctgattagctacgggggaggctggcggttccagggctcctggaataccggggaggaggtacaagtcatagcagtggaacctggaaagaaccccaaaaatgttcagacgacaccaggtacttttaagacccccgagggcgaagtgggggccatcgcgctcgacttcaaacctggaacatctggctcgccaattgtcaaccgcgagggtaagatcgtggggctgtacggaaatggcgttgtgaccactagcggcacctatgtctcagctattgcccaggcaaaggcctcccaagaagggccccttcctgagatcgaggatgaagtgtttaaaaagagaaacctgacaataatggacttgcacccgggaagtggtaaaacgaggcggtacctaccagctatcgtacgagaggccattaagagaaaactgcgcactctcatcttagcacccaccagggtggttgcttctgaaatggccgaggcgctgaagggcatgcctattcgttatcagacaaccgccgtcaagagcgaacacactgggaaagagatcgtggatcttatgtgccatgcaacattcaccatgcggctgctctccccagtgagagtccccaattacaacatgataattatggacgaggctcactttacggatcctgcctcaatcgctgcaaggggatatatctctactcgcgtaggcatgggtgaagccgccgctattttcatgacagcgaccccgcccgggagcgtggaggcatttccacagagtaatgccgttatccaggacgaagagcgagatatacctgaaagatcctggaacagcggatacgactggattaccgatttccccggcaagactgtgtggtttgtcccatctatcaaatcaggcaatgacattgctaactgtttgcggaagaacgggaaaagggtgatccaactgtcccgcaagacattcgacaccgagtatcagaagacaaaaaataacgattgggactacgttgtgactacggatataagtgagatgggagccaatttccgtgcagacagagtcattgatcctcggaggtgcctcaagcccgtgatcctgaaagacggtccagaacgcgtaatccttgccggcccgatgcctgtgaccgctgcgagcgccgcacagcgaagagggcggattggaaggaaccagaataaggagggcgatcaatacatctatatgggtcagcccctaaacaatgacgaagatcatgctcactggacagaggccaaaatgctgttggacaacattaatactccagaggggataatccccgcattatttgaacctgagcgcgaaaagtcggccgctattgatggcgagtacagactgaggggagaagcccggaagaccttcgttgagctcatgcgtcgcggcgacctgccagtctggctttcttataaagtggcgtccgaggggtttcagtacagcgatcgaagatggtgcttcgacggagaaaggaacaatcaggtgctggaggaaaacatggacgtcgagatctggacaaaggaaggtgagcggaaaaagctccgccccagatggttggatgcaaggacctattcagaccctctggccctacgggagtttaaagaattcgctgccggccgaagaagtgtttctggggatctgatcctcgagattggaaagcttccgcaacatctgactttacgcgctcagaatgcattggacaacctggtgatgctccacaattccgaacagggcggtaaagcctacaggcacgctatggaggaactgccagatacgatagagacccttatgctgctcgccttgatcgcagtactgacagggggcgtgactttatttttcctaagcggaaagggcctggggaagacctcaattggactcctttgtgtcatggcgagtagcgtgctgttgtggatggcctccgttgagccccattggatcgctgcctctattatcctggaatttttcctcatggtgctgcttatacctgagcccgaccggcagcgtacaccacaagataaccagctcgcatatgtcgtaatcggtctgttgtttatgattctgaccgtggctgccaacgaaatgggcttactagagactacaaaaaaggacctggggatcggacacgttgtggcagagaatcatcaccacgccacgatgctcgatattgaccttcatcctgctagcgcgtggaccctgtacgccgtcgcaactacaatcataacccccatgatgagacacaccattgaaaacacaactgctaatatctccttgacggccattgccaaccaggcagctatcctgatgggcctcgataaaggttggccaatatcaaagatggacatcggggtgcctctgcttgccttaggctgctactctcaagtcaatccgctgaccctcacagcggctgtgttgatgctggttgcccattatgcaattatcggacccggcctacaggccaaagctactagggaggcacagaagcgcaccgccgcggggattatgaagaacccaacagtggatggaatcgtagctatagacctggaccctgtggtctacgatgccaaattcgaaaagcagctcggccaaattatgcttctgatcttgtgtaccagtcagatcctgctcatgcggactacgtgggcactgtgcgagtcgattacattagccaccggtccccttactaccctgtgggaagggagcccaggaaaattttggaatacaactatcgctgtttccatggccaacatattccgaggctcttatctcgcaggtgctggcctagccttctcactgatgaagagcttggggggaggcagaagggggaccggagcgcagggcgagacactgggtgagaaatggaagcgccagctcaatcaactttccaagagtgaatttaacacgtacaaacggtctgggattatggaggtggacagaagcgaagccaaggagggactgaaacgtggcgaaaccactaagcacgcagtctcaaggggtacagctaaattgcggtggttcgtggagcgcaatctggtaaagcctgagggcaaggtgatcgatctcgggtgtggacgaggcgggtggtcctattactgcgccggattaaaaaaggttaccgaagtgaaaggctatactaagggtgggcccggacatgaggaaccgattccaatggcaacatacggctggaacatcgtcaaactgcacagtggcagagacgtgtttttcacccctcccgagaagtgtgatacgcttctgtgcgacataggggaaagctctccaaatcccaccatcgaggagggaaggacactacgggtcctcaaaatggtggaaccttggctgcgcggtaaccagttttgtattaagatcttgaatccgtacatgccctccgttgtagagactctggaacagatgcagagaaagcacggcgggatgctcgtgaggaacccactttcacgaaatagcacccatgagatgtattgggtctcgtgcggaacaggcaacattgtgtctgctgttaacatgactagtcggatgctgttaaatcgtttcaccatggcccacagaaaacctacatacgagcgcgatgtggacctgggtgccgggaccaggcatgtcgcggtggaacccgagatcgctaacttggatattatcggacaacggatagaaaatattaagaacgagcacaaatccacttggcactatgacgaagataatccttacaagacgtgggcatatcatggcagctacgaggtaaaaccatcaggctccgcctctagcatggtgaacggggttgtcagactcctgacaaagccctgggacgtgatccctatggtgacccagatcgctatgactgacaccacaccatttggacagcaacgcgtcttcaaggagaaagttgatacgaggaccccccgaccgaagcggggtactgcccagattatggaagtgacagcaaaatggctatggggctttcttagtagaaataagaaacctaggatatgtacccgcgaggaattcactcgtaaggtacggtccaacgccgctatcggggcggtgtttgtcgacgagaatcagtggaacagcgccaaggaagcagtggaggatgagagattctgggacctggttcacagggaacgcgagctccataaacagggaaagtgcgctacatgcgtgtataatatgatgggcaaacgagaaaagaaactgggtgagtttgggaaggccaagggatctcgggcaatttggtacatgtggttgggcgccagattcctggaattcgaggctctcggctttatgaacgaggatcactggttctcaagggaaaatagtctttccggggtcgagggagaaggtctgcataaattaggctacatcctgcgcgacattagcaagatcccagggggaaacatgtatgccgatgacaccgcgggctgggatacaagaataactgaggacgatttgcaaaatgaggcaaaaatcaccgacattatggaacccgagcacgccctcctggctacgtctatctttaagctaacctaccagaacaaagtggtacgggttcagaggcctgccaagtcgggtacagtgatggatgtcatttcacgtcgagaccagcgcgggagcggacaagtgggcacttatggccttaacaccttcacaaatatggaagtgcagctgatcagacagatggagtccgaagggatatttagtccatctgagctcgagaacagcaatctggcagaacgggtcttggactggttagagaaacacggagttgaaaggctgaagcgcatggctatttccggtgatgactgtgtggtaaagcccactgatgacagattcgccaccgctctcatcgcccttaacgatatgggcaaagtgcggaaggacatcccgcagtgggagccttcaaaagggtggaatgattggcaacaggtccccttttgcagtcatcacttccatcagctgattatgaaggacggaagggaaatagtggttccatgtcgaaaccaggatgagctagtgggccgtgcaagagtctctcaaggtgcggggtggagcctgcgcgagacggcctgcctcggaaaatcctacgctcagatgtggcagttgatgtattttcaccggagggacctgagacttgccgcaaatgctatctgttcagccgtgcctgtaaactgggttcccacaagccgcaccacttggtctattcacgcacatcaccaatggatgacaaccgaagatatgctgtccgtgtggaatcgggtctggatcgaggaaaacccatggatggaggacaagactcatgtgagtagctgggaagacgttccctacctcggcaagagggaggatcagtggtgcggctcgttaattgggctgaccgcccgagcgacatgggctacgaatatccaggtggccataaaccaggtcagacggttgatcggaaatgagaactatctggactacatgacctccatgaaaaggttcaagaatgaatctgatcctgagggtgcactctggtga

SEQ ID NO: 14196 - RNA, 9879 nt, synthetic construct
  misc_feature 1..9879: note = derived and/or modified CDS sequence (opt3) from DENV-1__KM403588__SS-prME
  source 1..9879: mol_type = other RNA
agcgtgaccatgctgctcatgcttctgcccactgccttggctttccacttaactacgagaggaggggaacctcatatgatcgtctccaagcaggaaaggggaaaatctctgctatttaagacctcagccggtgttaacatgtgcacactcattgccatggacctgggcgaactttgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggttgacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggggaaactgacccttaagggagtgtcttatgtcatgtgtacaggttccttcaaattggagaaggaagtggctgagactcagcacggcaccgttctggtgcaggtaaagtacgaggggacggacgcgccttgcaaaataccaatcagcacacaagatgaaaagggagtcacccagaacggccgcctcattactgcaaatcccatcgtgacagacaaagagaagcctgttaacatagaaaccgagccacccttcggtgagtcgtatattgtgatcggggccggcgaaaaagctctgaaactttcttggtttaagaaaggatcctcaatcggcaagatgttcgaggccactgcaagaggggccaggcggatggctattctgggagatatcgcctgggactttggtagtattggcggggtcttcaccagcgtgggaaaattggtacatcaggtgtttggcacagcatacggtgttctcttctccggggtctcttggacgatgaagataggcatcggcattctgttaacctggctgggcctaaatagccgatcaacaagtctctccatgacatgtatcgcggtggggatggtgaccctgtaccttggagtcatggttcaggctgatagcggctgcgtgatcaactggaaaggtcgcgaattgaagtgtgggtctggaatttttgtgacaaacgaggtacacacttggaccgaacaatataagttccaggccgactcaccgaaaagactgagtgcagccataggcaaggcttgggaggagggtgtctgcggcatcaggagcgccacgcggctcgaaaatattatgtggaaacagatctccaacgagctgaatcatattttactggaaaacgatatgaagtttacagtggttgtgggggacgcaaatggaatccttacccagggcaaaaagatgatacgccctcaacccatggagcacaaatactcttggaagtcgtgggggaaggctaaaatcattggagccgacactcagaacaccacattcatcattgatggcccagacactcctgaatgtcccgatgaccagagagcgtggaatatctgggaggtcgaggattatggttttggggtgttcaccacaaacatatggttgaagctcagggacagctacacgcagatgtgcgatcaccgtctgatgtccgccgctattcgggactcaaaagcagttcatgccgatatgggatattggatcgaaagtgagaagaatgaaacctggaaactagctcgagcctcttttattgaggtgaagacttgtatctggccaagaagccacacactgtggtccaacggcgtactcgaatcagagatgataatccccaagatttacggtggccctatcagccaacataattataggccagggtacttcacccagactgcaggaccgtggcacctgggcaaacttgagttggacttcaacctgtgcgaagggacaaccgtcgtggtggatgagcactgcggaaatcgcggcccctctttacggacgactaccgtcacaggtaagattatccatgaatggtgttgcagatcctgtaccctccctccactgaggtttcgcggggaggacggatgctggtacggcatggagatacgacccgttaaagaaaaggaggaaaaccttgtgcggagtatggtaagcgcgggttctggcgaggtggattccttctcactggggttgctctgtgtcagtattatgatcgaagaggtgatgcgtagcagatggtcgaggaaaatgctgatgactggaacactagccgtatttttcctgctcatcatgggccagctgacctggaatgaccttattcgcttgtgcatcatggtgggggctaacgtctccgaccggatgggaatgggcacaacttatctggccttaatggcaacctttaagatgagacctatgttcgctgtgggtctcctgtttaggcgacttacgtctcgcgaggttctgctactcacaattgggctgagcttggtggcctcagtcgaactgccaaacagtttagaggaactcggagatggcctggcaatgggcataatgatgcttaagctgttgaccgacttccaatcccaccagctctggactaccctgctatctctgacatttatcaaaactacccttagcctcgattacgcctggaagacgatggctatggtactgtccattgtgtcattgttccccctgtgtttaagcacaaccagtcagaaaactacatggctcccggttctgcttgggtcttttggatgcaagcctctgaccatgttcttgatcactgagaataaaatttggggtcggaagtcctggccactcaacgaaggcatcatggcggtggggatagtcagcatcctgctatcgtcactgcttaagaatgacgtgcccctcgccggacctctgattgcaggcggtatgttgatcgcttgttatgtaatttctgggagttccgccgatttaagcctggagagagccgctgaggtgtcttgggaagaggaagcagagcatagcggagcctcccacaacatcctcgtcgaagttcaggacgatggcacaatgaaaataaaggacgaggagagggatgacaccctgacgattcttctgaaagcgactttgctagctgtgtcaggcgtgtaccccatgagtatcccagccaccctgtttgtctggtatttctggcaaaagaaaaagcagcgtagcggggtgctctgggatacaccttctcccccagaagttgagcgcgcagtactggacgatggaatctaccggattcttcagagaggtttactgggcaggtcccaggtgggggtcggagtgttccaagacggcgtttttcataccatgtggcacgtgacacgaggtgccgtcctcatgtatcaggggaaacggttggaaccgtcatgggctagtgtgaagaaggacctgataagctacggaggcggctggcgcttccaggggtcctggaatactggagaggaggtacaggtcatcgcagtggaacctggtaaaaaccccaagaatgttcaaaccacgccaggcacatttaaaactcccgagggggaagtgggagccattgcgctcgatttcaagcctggcacctctggttcgccaatcgtcaacagagaggggaaaattgtgggactgtacggcaatggcgttgtgacaaccagcgggacttatgtctcagctatcgcccaggcaaaggcctcccaggaaggaccccttcctgagatagaggacgaagtgtttaagaaaaggaacctgaccatcatggatttgcacccgggtagtggcaagacacggcgatacctaccagctattgtaagagaggccatcaaacgcaagctgaggacgctcattttagcacccactcgtgtggttgcttctgaaatggccgaggcgctgaaagggatgcctatccggtatcaaaccacagccgtcaagagcgaacataccggaaaggagatagtggaccttatgtgccacgcaactttcacaatgagactgctctccccagtgagggtccccaattacaacatgattatcatggatgaggctcattttaccgaccctgcctcaatcgctgcacgcggctatatttctacgcgagtaggtatgggggaagccgccgctatcttcatgactgcgacaccgcccggaagcgtggaggcatttccacagagtaatgccgttatacaggatgaagagagagacattcctgaacggtcctggaacagcggctacgattggatcaccgacttccccggcaaaaccgtgtggtttgtcccatctattaagtcagggaatgatatcgctaactgtttgaggaaaaacggaaagcgcgtgatacagctgtcccgtaaaactttcgacacagagtatcaaaagaccaagaataacgactgggattacgttgtgacaactgacattagtgagatgggtgccaatttcagagcagatcgggtcatcgaccctaggcgctgcctcaaacccgtgatcctgaaggatggcccagaacgagtaattcttgccgggccgatgcctgtggctgcggccagcgcagctcagagacggggaaggatcggccgcaaccagaataaagagggtgaccagtacatttatatggggcaacccctaaacaatgatgaagaccacgcccattggacggaggcaaagatgctgttggataacataaataccccagagggcatcattcccgccttatttgaacctgagagagaaaaatcggctgccatcgacggagagtacaggctgcggggcgaagcgcgtaagacattcgttgagctcatgcgccgaggggatctgccagtctggctttcttataaggtggcatccgagggatttcagtacagcgacagaaggtggtgcttcgatggtgaacggaacaatcaggtgctggaggaaaacatggacgtcgagatctggactaaagaaggcgagcgcaagaaactcagacccaggtggttggacgcccggacctattcagatcctctggctctacgagagtttaaggagttcgccgctgggagacgcagtgtttctggagacctgattctcgagataggcaaacttccgcagcacctgacattaagggcacaaaatgccttggataacctggtgatgctccacaattccgaacagggtgggaaggcttaccggcatgccatggaggaactgccagacaccatcgagactcttatgctgctcgcattgattgcggtactgacgggcggagtgaccttatttttcctaagcggcaaagggctgggaaagacatcaatcggtctcctttgtgtcatggccagtagcgtgctgttgtggatggcttccgttgagccccactggattgccgcatctatcatactggaatttttcctcatggtgctgcttatccctgagcccgatcgtcagagaactccacaggacaaccaactcgcttatgtcgtaattggcctgttgtttatgatcctgaccgtggccgcaaacgaaatggggttactagagacaaccaagaaagatctgggaattggccatgttgtggccgagaatcaccaccatgctactatgctcgacatcgatcttcaccctgcgagcgcctggacactgtacgcagtcgctacgaccataattactcccatgatgaggcatacaatcgaaaacaccaccgccaatatttccttgacagccatcgcaaaccaggctgccatactgatgggtctcgacaaggggtggccaatctcaaaaatggatattggcgtgcctctgcttgcgttaggatgctactctcaggtcaatccgctgactctcacggctgccgtgttgatgctggttgcacactatgccatcattggccccgggctacaagctaaggcaacccgcgaggcccagaaacggacagcggctggaatcatgaagaacccaactgtggacggcatagtagccattgatctggaccctgtggtctacgacgcaaagttcgaaaaacagctcggtcagatcatgcttctgatcttgtgtaccagtcaaattctgctcatgcgaacaacctgggccctgtgcgagtcgatcactttagctacggggccccttacaaccctgtgggaaggaagcccaggcaagttttggaatactaccatagccgtttccatggcaaacattttcagaggttcttatctcgctggcgccgggctagcgttctcactgatgaagtccttgggaggcgggaggcgcggaacaggcgcccagggtgagactctgggggagaagtggaaacggcagctcaatcagcttagcaagagtgaatttaacacctacaagagatctggaatcatggaggtggatcgtagcgaagcaaaagagggcctgaagaggggtgaaacaacgaaacatgctgtctcacggggcaccgccaagttgcgctggttcgtggagcgaaatctggtaaaacctgaggggaaggtgattgacctcggatgtggcagagggggatggtcctattactgcgcaggcttaaagaaagttactgaagtgaagggttatacaaaagggggacccggccacgaggaaccgatcccaatggctacctacggctggaacatagtcaagctgcacagtgggagggatgtgtttttcactcctcccgagaaatgtgacacacttctgtgcgatatcggagaaagctctccaaatcccaccattgaggagggtcggacgctacgcgtcctcaagatggtggaaccttggctgagaggcaaccaattttgtatcaaaattttgaatccgtacatgccctccgttgtagagaccctggaacagatgcagaggaagcatgggggaatgctcgtgcgaaacccactttcacggaatagcacacacgagatgtattgggtctcgtgcggcactggtaacatcgtgtctgccgttaacatgaccagtcgtatgctgttaaatagattcacaatggcccatcgcaagcctacttacgagagggacgtggatctgggggcgggaacccggcacgtcgctgtggaacccgagattgcaaacttggacatcataggccagagaattgaaaatatcaaaaacgagcacaagtccacatggcattatgatgaagacaatccttacaaaacctgggcctatcacggcagctacgaggtaaagccatcagggtccgcttctagcatggtgaacggagttgtccgcctcctgactaaaccctgggatgtgatccctatggtgacgcaaattgccatgacagacaccactccatttggtcagcagagggtcttcaaggagaaggttgacacccgaacaccccggccgaaaagaggcacggcacaaataatggaagtgaccgccaagtggctatgggggtttcttagtaggaataaaaagcctcgcatctgtactcgtgaggagttcacacggaaagtaagatccaacgctgcgattggagccgtgtttgtcgatgagaatcagtggaacagcgcaaaggaagctgtggaggacgagaggttctgggatctggttcatcgcgaacgagagctccacaagcagggcaaatgcgcaacctgcgtgtataatatgatgggtaagcgggagaaaaagctgggggagtttggaaaagcaaagggctctagagccatctggtacatgtggttgggcgctaggttcctggagttcgaggccctcgggtttatgaacgaggaccattggttctcacgcgaaaatagtctttccggagtcgagggtgaaggcctgcacaagttagggtacattctgagagatatcagcaaaataccaggaggcaacatgtatgcggacgatactgcaggttgggacacacggatcaccgaggatgacttgcagaatgaggccaagattacagatatcatggaacccgagcacgctctcctggccacttctatttttaaactaacctaccaaaacaaggtggtaagggttcagcgtcctgcaaaatcggggacggtgatggacgtcatctcacgacgcgatcagagaggaagcggccaggtgggcacctatgggcttaacacattcactaatatggaagtgcaactgatacggcagatggagtccgaaggaatttttagtccatctgagctcgagaacagcaatctggctgaaagggtcttggactggttagagaagcatggtgttgaacgcctgaaaagaatggccatctccggcgacgattgtgtggtaaagcccaccgacgatcggttcgctacagccctcactgcacttaacgacatggggaaggtgaggaaagatatcccgcagtgggagccttcaaagggatggaatgactggcagcaagtccccttttgcagtcaccatttccaccagctgattatgaaagatggccgagaaatagtggttccatgtcgtaaccaggacgagctagtgggtagagcgcgcgtctctcagggggccggatggagcctgcgggagaccgcttgcctcggcaagtcctacgcccaaatgtggcagttgatgtattttcacaggagagatctgcgccttgcagctaatgccatctgttcagcagtgcctgtaaactgggttcccacgagccggacaacctggtctattcatgcccaccatcagtggatgactacagaagacatgctgtccgtgtggaatagggtctggatcgaggaaaacccatggatggaggataaaacccacgtgagtagctgggaagacgttccctacctcggcaagcgagaggaccaatggtgcgggtcgttaattggactgactgcgagagctacctgggccacaaatatccaggtggcaataaaccaggtccggaggttgatcggtaatgagaactatctggattacatgacgtccatgaagcgcttcaaaaatgaatctgaccctgagggcgccctctggtga

SEQ ID NO: 14197 - RNA, 9879 nt, synthetic construct
  misc_feature 1..9879: note = derived and/or modified CDS sequence (opt3) from DENV-1__KM403605__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaagggggtgtcttatgtcatgtgtacaggatccttcaaattggagaaggaagtggctgagactcagcacggtaccgttctggtgcaggtaaagtacgagggcacggatgcgccttgcaaaataccaatcagcattcaagacgaaaagggggtcacacagaacggacgcctcatcaccgcaaatcccatagtgactgataaagagaagcctgttaacattgaaacagagccacccttcggcgagtcgtatatcgtgatcggtgccggggaaaaagctctgaagctttcttggtttaagaaaggctcctcaattggaaagatgttcgaggccaccgcaagaggcgccaggcggatggctatcctgggggacactgcctgggattttggaagtattggtggcgtcttcaccagcgtggggaaattggtacatcaggtgtttggaacagcatacggcgttctcttctccggtgtctcttggacgatgaagatagggatcggcattctgttaacctggctgggactaaatagccgatcaactagtctctccatgacatgtatcgcggtgggcatggtgaccctgtaccttggggtcatggttcaggctgacagcggatgcgtgatcaactggaaaggccgcgaattgaagtgtggttctgggatttttgtgacaaacgaggtacacacttggaccgaacaatataagttccaggccgattcaccgaaaagactgagtgcagccataggaaaggcttgggaggagggcgtctgcggtatcaggagcgccacgcggctcgaaaatattatgtggaaacagatctccaacgagctgaatcatattttactggaaaacgacatgaagtttacagtggttgtgggcgacgcaaatgggatccttacccagggaaaaaagatgatacgccctcaacccatggagcacaaatactcttggaagtcgtggggcaaggctaaaatcattggggccgatactcagaacaccacattcatcattgacggaccagatactcctgaatgtcccgacgatcagagagcgtggaatatctgggaggtcgaggactatggctttggtgtgttcaccacaaacatatggttgaagctcagggatagctacacgcagatgtgcgaccaccgtctgatgtccgccgctattaaagattcaaaggcagttcatgccgacatggggtattggatcgaaagtgagaaaaatgaaacctggaagctagctcgggcctcttttattgaggtgaagacttgtatctggccacgaagccacacactgtggtccaacggagtactcgaatcagagatgataatccccaaaatttacggcggtcctatcagccaacataattatagaccaggctacttcacccagactgcagggccgtggcacctgggaaagcttgagttggatttcaacctgtgcgaaggcacaaccgtcgtggtggacgagcactgcgggaataggggaccctctttacgcacgactaccgtcacaggcaaaattatccatgaatggtgttgccggtcctgtaccctccctccactgagatttaggggtgaggatgggtgctggtacggaatggagatacgccccgttaaggaaaaagaggaaaaccttgtgcgaagtatggtaagcgcgggctctggtgaggtggactccttctcactgggcttgctctgtgtcagtattatgatcgaagaggtgatgcggagccgttggtcgagaaagatgctgatgactgggacactagccgtttttttcctgctcatcatgggacagctgacctggaatgaccttattaggttgtgcatcatggtgggcgctaacgtctccgatcgcatggggatgggaacaacttatctggccttaatggcaacctttaagatgcggcctatgttcgctgtgggcctcctgtttagaaggcttacgtctcgagaggttctgctactcacaattggtctgagcttggtggcctcagtcgaactgccaaacagtttagaggaactcggggacggactggcaatgggcataatgatgcttaaactgttgaccgatttccaatcccaccagctctggactaccctgctatctctgacatttatcaagactacccttagcctcgactacgcctggaaaacgatggctatggtactgtccattgtgtcattgttccccctgtgtttaagcacaaccagtcagaagactacatggctcccggttctgcttggctcttttgggtgcaaacctctgaccatgttcttgatcactgagaataagatttggggacgcaagtcctggccactcaacgaaggtatcatggcggtgggcatagtcagcatcctgctatcgtcactgcttaaaaatgatgtgcccctcgccgggcctctgattgcaggaggcatgttgatcgcttgttatgtaatttctggtagttccgccgacttaagcctggagcgggccgctgaggtgtcttgggaagaggaagcagagcatagcggggcctcccacaacatcctcgtcgaagttcaggatgacggaacaatgaagataaaagatgaggagagagacgataccctgacgattcttctgaaggcgactttgctagctgtgtcaggcgtgtaccccatgagtatcccagccaccctgtttgtctggtatttctggcaaaaaaagaaacagaggagcggcgtgctctgggacacaccttctcccccagaagttgagcgtgcagtactggatgacgggatctaccgcattcttcagcggggattactgggtagatcccaggtgggcgtcggggtgttccaagacggagtttttcataccatgtggcacgtgacaaggggcgccgtcctcatgtatcagggtaagcgattggaaccgtcatgggctagtgtgaagaaagatctgataagctacgggggaggctggcggttccagggctcctggaatactggggaggaggtacaggtcatcgcagtggaacctggaaagaaccccaaaaatgttcaaaccacgccaggtacatttaagactcccgagggcgaagtgggggccattgcgctcgacttcaaacctggaacctctggctcgccaatcgtcaaccgcgagggtaagattgtggggctgtacggaaatggcgttgtgacaaccagcggcacttatgtctcagctatcgcccaggcaaaggcctcccaggaagggccccttcctgagatagaggatgaagtgtttaaaaagagaaacctgaccatcatggacttgcacccgggaagtggtaaaacaaggcggtacctaccagctattgtacgagaggccatcaagagaaaactgcgcacgctcattttagcacccactagggtggttgcttctgaaatggccgaggcgctgaagggcatgcctatccgttatcaaaccacagccgtcaagagcgaacataccgggaaagagatagtggatcttatgtgccacgcaactttcacaatgcggctgctctccccagtgagagtccccaattacaacatgattatcatggacgaggctcattttaccgatcctgcctcaatcgctgcaaggggatatatttctacgcgcgtaggcatgggtgaagccgccgctatcttcatgactgcgacaccgcccgggagcgtggaggcatttccacagagtaatgccgttatacaggacgaagagcgagatattcctgaaagatcctggaacagcggatacgactggatcaccgatttccccggcaagaccgtgtggtttgtcccatctattaaatcaggcaatgacatcgctaactgtttgcggaagaacgggaaaagggtgatacagctgtcccgcaagactttcgacacagagtatcaaaagaccaaaaataacgattgggactacgttgtgacaactgatattagtgagatgggagccaatttccgtgcagacagagtcatcgatcctcggaggtgcctcaagcccgtgatcctgaaagacggtccagaacgcgtaattcttgccggcccgatgcctgtgacggctgcgagcgccgcacagcgaagagggcggatcggaaggaaccagaataaggagggcgatcagtacatttatatgggtcaacccctaaacaatgacgaagatcacgctcattggaccgaggccaaaatgctgttggacaacataaatacaccagaggggatcattcccgcattatttgaacctgagcgcgaaaagtcggccgctatcgatggcgagtacagactgaggggagaagcccggaagactttcgttgagctcatgcgtcgcggcgacctgccagtctggctttcttataaagtggcgtccgaggggtttcagtacagcgatcgaagatggtgcttcgacggagaaaggaacaatcaggtgctggaggaaaacatggacgtcgagatctggaccaaggaaggtgagcggaaaaagctccgccccagatggttggatgcaaggacatattcagaccctctggccctacgggagtttaaagaattcgctgccggccgaagaagtgtttctggggatctgattctcgagataggaaagcttccgcagcacctgaccttacgcgctcaaaatgcattggacaacctggtgatgctccacaattccgaacagggcggtaaagcctacaggcatgctatggaggaactgccagatactatcgagacgcttatgctgctcgccttgattgcagtactgaccgggggcgtgacattatttttcctaagcggaaagggcctggggaagacttcaatcggactcctttgtgtcatggcgagtagcgtgctgttgtggatggcctccgttgagccccactggattgctgcctctatcatactggaatttttcctcatggtgctgcttatccctgagcccgaccggcagcgtaccccacaggataaccaactcgcatatgtcgtaattggtctgttgtttatgatcctgacagtggctgccaacgaaatgggcttactagagaccactaaaaaggacctggggattggacatgttgtggcagagaatcaccaccatgccacaatgctcgatatcgaccttcaccctgctagcgcgtggacgctgtacgccgtcgcaaccactataattacacccatgatgagacataccatcgaaaacaccacagctaatatttccttgactgccatcgccaaccaggcagctatactgatgggcctcgataaaggttggccaatctcaaagatggacattggggtgcctctgcttgccttaggctgctactctcaggtcaatccgctgacgctcaccgcggctgtgttgatgctggttgcccactatgcaatcattggacccggcctacaagccaaagctacaagggaggcacagaagcgcactgccgcggggatcatgaagaacccaaccgtggatggaatagtagctattgacctggaccctgtggtctacgatgccaaattcgaaaagcagctcggccagatcatgcttctgatcttgtgtacaagtcaaattctgctcatgcggaccacttgggcactgtgcgagtcgatcacgttagccacaggtccccttaccactctgtgggaagggagcccaggaaaattttggaataccacaatagctgtttccatggccaacattttccgaggctcttatctcgcaggtgctggcctagccttctcactgatgaagactttggggggaggcagaagggggaccggagcgcagggcgagacactgggtgagaaatggaagcgccagctcaatcagcttagcaagtccgaatttaacacgtacaaacggagtgggatcatggaggtggacagatctgaagccaaggagggactgaaacgtggcgaaaccactaagcatgcagtcagcaggggtacagctaaattgcggtggttcgtggagcgcaatctggtaaagcctgagggcaaggtgattgatctcgggtgtggacgaggcgggtggtcatattactgcgccggattaaaaaaggttaccgaagtgaaaggctatactaagggtgggcccggacacgaggaaccgatcccaatggcaacatacggctggaacatagtcaaactgcactccggcagagacgtgtttttcacccctcccgagaagtgtgatacgcttctgtgcgacatcggggaaagtagcccaaatcccaccattgaggagggaaggacactacgggtcctcaaaatggtggaaccttggctgcgcggtaaccaattttgtatcaagattttgaatccgtacatgccctctgttgtagagactctggaacagatgcagagaaagcatggcgggatgctcgtgaggaacccactttcccgaaattcaacccacgagatgtattgggtcagctgcggaacaggcaacatcgtgtcggctgttaacatgacttctcggatgctgttaaatcgtttcaccatggcccatagaaaacctacatacgagcgcgatgtggacctgggtgccgggaccaggcacgtcgcggtggaacccgagattgctaacttggatatcataggacagcggattgaaaatatcaagaacgagcacaaaagtacttggcattatgacgaagataatccttacaagacgtgggcatatcacggctcctacgaggtaaaaccaagcggctcagcctcctctatggtgaacggggttgtcagactcctgacaaagccctgggacgtgatccctatggtgacccaaattgctatgactgacaccacaccatttggacagcagcgcgtcttcaaggagaaagttgatacgaggaccccccgaccgaagcggggtactgcccaaataatggaagtgacagcaaaatggctatggggctttcttagcagaaataagaaacctaggatctgtacccgcgaggaattcactcgtaaggtacggagtaacgccgctattggggcggtgtttgtcgacgagaatcagtggaactccgccaaggaagcagtggaggatgagagattctgggacctggttcatagggaacgcgagctccacaaacagggaaagtgcgctacatgcgtgtataatatgatgggcaaacgagaaaagaaactgggtgagtttgggaaggccaagggaagccgggcaatctggtacatgtggttgggcgccagattcctggaattcgaggctctcggctttatgaacgaggatcattggttctctagggaaaattcacttagtggggtcgagggagaaggtctgcacaaattaggctacattctgcgcgacatctccaagataccagggggaaacatgtatgccgatgacaccgcgggctgggatacaagaatcactgaggacgatttgcagaatgaggcaaaaattaccgacatcatggaacccgagcacgccctcctggctacgagcatttttaagctaacctaccaaaacaaagtggtacgggttcagaggcctgccaagtctggtacagtgatggatgtcatctcgcgtcgagaccagcgcgggtcaggacaggtgggcacttatggccttaacaccttcacaaatatggaagtgcaactgataagacagatggagagcgaagggattttttccccaagtgagctcgagaactctaatctggcagaacgggtcttggactggttagagaaacatggagttgaaaggctgaagcgcatggctatcagcggtgatgactgtgaggtgaagcccactgatgacagattcgccaccgctctcacggcccttaacgatatgggcaaagtacggaaggacatcccgcagtgggaaccttccaaagggtggaatgattggcagcaagtgcccttttgctcacaccatttccaccagctgattatgaaggacggaagggagatagtcgtgccatgtcgaaaccaggatgagctagttggccgtgcaagagtgagtcagggtgcggggtggtctctgcgcgaaacagcctgcctcggaaaaagctacgctcaaatgtggcagttgatgtattttcaccggagggacctgagacttgccgcaaatgctatctgttccgccgtccctgtgaactgggtacccacctcacgcactacatggagcattcatgcacaccatcagtggatgaccactgaggatatgctgtctgtttggaatcgggtgtggatcgaagagaacccatggatggaagacaagacccacgtctccagttgggaggacgtgccctacctcggcaagagggaggatcaatggtgcggcagcttaattgggctgacagcccgagcgacgtgggctaccaatatccaggttgccataaaccaggtgagacggttgatcggaaatgaaaactatctggactacatgacttcgatgaaaaggttcaagaatgagtccgatcctgaaggtgcactctggtga

SEQ ID NO: 14198 - RNA, 9879 nt, synthetic construct
  misc_feature 1..9879: note = derived and/or modified CDS sequence (opt3) from DENV-1__KM403606__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacccttgagatccagctgacagactacggggccttgaccctagactgttcaccaaggactggactggatttcaacgaaatggtcctcctgacaatgaaggagaaaagttggcttgtgcataagcagtggtttctggacttgccgctcccctggacgagcggcgcatctacctcccaagagacttggaatcggcaggatctgttagtaacattcaaaaccgctcacgccaagaagcaggaagttgtggtcctgggttcacaagagggggctatgcacacagccctaactggcgcaaccgaaatccagacgagcggaaccacaactatttttgccggccatctcaaatgccgtctgaagatggacaaacttaccttgaagggggtgagttatgtcatgtgtacaggatctttcaaactggagaaggaagtggctgagactcagcacggtaccgttctcgtgcaggtaaagtacgagggcacggatgcgccttgcaaaataccaatctccacacaagacgaaaagggggtcacccagaacggacgcctgattactgcaaatcccatcgtgacagataaagagaagcctgttaacatagaaaccgagccacccttcggcgagagctatattgtgatcggtgccggggaaaaagctcttaagctgtcgtggtttaagaaaggctcttccatcggaaagatgttcgaggccactgcaagaggcgccaggcggatggctattttgggggacaccgcctgggattttggatcaatcggtggcgtcttcacaagtgtggggaaactcgtacatcaggtgtttggaacggcatacggcgttctgttcagcggtgtctcctggaccatgaagattgggataggcatcttactgacttggctaggactcaattctcgaagcacatcactgagtatgacctgtattgcggtgggcatggtgacactttacttgggggtcatggttcaggctgactccggatgcgtgatcaactggaaaggccgcgaactgaagtgtggtagcgggatctttgtgactaacgaggtacacacctggacggaacaatataagttccaggccgattctccgaaaagactctcagcagccattggaaaggcttgggaggagggcgtctgcggtataaggagtgccacacggctggaaaatatcatgtggaaacagattagcaacgagttaaatcatatcctgcttgaaaacgacatgaagtttaccgtggttgtgggcgacgcaaatgggattttgactcagggaaaaaagatgatccgccctcaacccatggagcacaaatactcctggaagtcttggggcaaggctaaaataatcggggccgatacccagaacacaactttcattatcgacggaccagatacccctgaatgtcccgacgatcagagagcgtggaatatttgggaggtcgaggactatggctttggtgtgttcacaacgaacatctggctcaagctgagggattcgtacacccagatgtgcgaccaccgtctaatgagcgccgctataaaagattccaaggcagttcatgccgacatggggtattggattgaatcagagaaaaatgaaacttggaagctggctcgggccagttttatcgaggtgaagacatgtatttggccacgatctcacaccctctggagcaacggagtactggaatccgagatgatcatacccaaaatctacggcggtcctatttcacaacataattatagaccaggctacttcactcagacagcagggccgtggcaccttggaaagttggagctggatttcaacttatgcgaaggcaccacggtcgtggtggacgagcactgcgggaataggggacccagcctccgcactaccacagtcaccggcaaaatcattcatgaatggtgttgccggtcttgtactctgcctccacttagatttaggggtgaggatgggtgctggtacggaatggagatccgccccgttaaggaaaaagaggaaaacctggtgcgatccatggtaagtgcgggcagcggtgaggtggactctttctccttgggcctcctgtgtgtctcaataatgattgaagaggtgatgcggagtcgttggagcagaaagatgctaatgacagggaccctggccgtttttttcctcctgatcatgggacagcttacatggaatgacttgatcaggctgtgcattatggtgggcgctaacgtctcggatcgcatggggatgggaactacctatttagccctcatggcaacgtttaagatgcggcctatgttcgctgtgggcctgctttttagaaggctgacatcccgagaggttctactcctgaccatcggtttgtctctggtggccagcgtcgaattaccaaactcactcgaggaactgggggacggacttgcaatgggcattatgatgctgaaattgctcactgatttccaaagtcaccagctgtggaccacactactgtcccttacttttataaagaccacgctctctctggactacgcctggaaaacaatggctatggtattgagcatcgtgtccctgttccccttatgtctctcaaccactagccagaagacaacctggctgccggttcttctgggcagttttgggtgcaaacctttgactatgttcctcattacagagaataagatctggggacgcaagtcttggccactgaacgaaggtattatggcggtgggcatcgtctccatactactgagctcgcttctcaaaaatgatgtgcccctggccgggcctttgatcgcaggaggcatgttaattgcttgttatgtaatctcaggttctagtgccgacctgtccctcgagcgggccgctgaggtgagctgggaagaggaagcagagcattctggggccagccacaacattctggtcgaagttcaggatgacggaaccatgaagatcaaagatgaggagagagacgatacgcttactatactgttgaaggcgaccctactggctgtgtccggcgtgtaccccatgtcaattccagccacactctttgtctggtatttctggcaaaaaaagaaacagaggagtggcgtgctgtgggacacccctagccccccagaagttgagcgtgcagtacttgatgacgggatctaccgcatcttacagcggggactgctcggtagatctcaggtgggcgtcggggtgttccaagacggagtttttcatacaatgtggcacgtgactaggggcgccgtcttgatgtatcagggtaagcgactggaaccgtcctgggcttcagtgaagaaagatctcattagttacgggggaggctggcggttccagggcagctggaataccggggaggaggtacaggtcatagcagtggaacctggaaagaaccccaaaaatgttcaaacgacaccaggtacttttaagacccccgagggcgaagtgggggccatcgcgctggacttcaaacctggaacatccggctctccaattgtcaaccgcgagggtaagatcgtggggctttacggaaatggcgttgtgaccacttcgggcacctatgtcagcgctattgcccaggcaaaggcctcacaggaagggcccctgcctgagatcgaggatgaagtgtttaaaaagagaaacttgacaataatggacctacacccgggatccggtaaaacgaggcggtacctgccagctatcgtacgagaggccattaagagaaaactccgcactttaatcctggcacccaccagggtggttgctagtgaaatggccgaggcgcttaagggcatgcctattcgttatcaaacaaccgccgtcaagtctgaacatactgggaaagagatcgtggatctgatgtgccacgcaacattcaccatgcggctcttgagcccagtgagagtccccaattacaacatgataattatggacgaggctcattttacggatcctgcctccatcgctgcaaggggatatatctcaactcgcgtaggcatgggtgaagccgccgctattttcatgacagcgaccccgcccgggtctgtggaggcatttccacagagcaatgccgttatccaggacgaagagcgagatatacctgaaagaagttggaactccggatacgactggattaccgatttccccggcaagactgtgtggtttgtcccaagcatcaaatctggcaatgacattgctaactgtctgcggaagaacgggaaaagggtgatccagctctcacgcaagacattcgacaccgagtatcaaaagacaaaaaataacgattgggactacgttgtgactacggatatatccgagatgggagccaatttccgtgcagacagagtcattgatcctcggaggtgcctgaagcccgtgatccttaaagacggtccagaacgcgtaatcctagccggcccgatgcctgtgaccgctgcgagtgccgcacagcgaagagggcggattggaaggaaccagaataaggagggcgatcagtacatctatatgggtcaacccctgaacaatgacgaagatcacgctcattggacagaggccaaaatgttgttagacaacattaatactccagaggggataatccccgcactgtttgaacctgagcgcgaaaagagcgccgctattgatggcgagtacagactcaggggagaagcccggaagaccttcgttgagctgatgcgtcgcggcgaccttccagtctggctgtcgtataaagtggcgtctgaggggtttcagtactccgatcgaagatggtgcttcgacggagaaaggaacaatcaggtgctcgaggaaaacatggacgtcgagatctggacaaaggaaggtgagcggaaaaagttgcgccccagatggctggatgcaaggacctatagcgaccctctagccctgcgggagtttaaagaattcgctgccggccgaagatcagttagtggggatctcatccttgagattggaaagctgccgcagcacttaactttgcgcgctcaaaatgcactggacaacctcgtgatgctgcacaattctgaacagggcggtaaagcctacaggcatgctatggaggaacttccagatacgatagagaccctgatgctcttggccctgatcgcagtattaacagggggcgtgactctatttttcctgtccggaaagggcctcgggaagaccagcattggacttctgtgtgtcatggcgtcaagtgtgttgctgtggatggccagcgttgagccccactggatcgctgcctccattatcctcgaatttttcctgatggtgcttctcatacctgagcccgaccggcagcgtacaccacaggataaccaactggcatatgtcgtaatcggtttgctgtttatgattttaaccgtggctgccaacgaaatgggcctactggagactacaaaaaaggacctcgggatcggacatgttgtggcagagaatcaccaccatgccacgatgcttgatattgacctgcaccctgcttctgcgtggaccttgtacgccgtcgcaactacaatcataacccccatgatgagacataccattgaaaacacaactgctaatatcagcctgacggccattgccaaccaggcagctatcctcatgggcctggataaaggttggccaatatccaagatggacatcggggtgcctcttttagccctgggctgctactcacaggtcaatccgctcaccttgacagcggctgtgctgatgctagttgcccactatgcaattatcggacccggcctgcaagccaaagctactagggaggcacagaagcgcaccgccgcggggattatgaagaacccaacagtggatggaatcgtagctatagacctcgaccctgtggtctacgatgccaaattcgaaaagcagcttggccagattatgctgttgatcctgtgtacctctcaaatcctcctgatgcggactacgtgggcattatgcgagagtattacacttgccaccggtcccctgactaccctctgggaagggtcgccaggaaaattttggaatacaactatcgctgttagcatggccaacatattccgaggctcctatctagcaggtgctggcctggccttctctttgatgaagaccctggggggaggcagaagggggacaggagcgcagggcgagacgctcggtgagaaatggaagcgccagcttaatcagctgtcaaagagcgaatttaacacctacaaacggtccgggattatggaggtggacagaagtgaagccaaggagggattgaaacgtggcgaaactacaaagcatgcagtctctaggggtaccgctaaactgcggtggttcgtggagcgcaatctcgtaaagcctgagggcaaggtgatcgatttagggtgtggacgaggcgggtggagctattactgcgccggactgaaaaaggttactgaagtgaaaggctatacaaagggtgggcccggacacgaggaaccgattccaatggcaacctacggctggaacatcgtcaaacttcactcaggcagagacgtgtttttcacgcctcccgagaagtgtgataccctgctatgcgacataggggaatccagtccaaatcccacaatcgaggagggaaggactctccgggtcctgaaaatggtggaaccttggttgcgcggtaaccaattttgtattaagatcctgaatccgtacatgcccagcgttgtagagaccctcgaacagatgcagagaaagcatggcgggatgcttgtgaggaacccactgtctcgaaattccacacacgagatgtattgggtctcatgcggaactggcaacattgtgagcgctgttaacatgacctcgcggatgttactgaatcgtttcacaatggcccatagaaaacctacctacgagcgcgatgtggacttgggtgccgggactaggcacgtcgcggtggaacccgagatcgctaacctcgatattatcggacagcggatagaaaatattaagaacgagcacaaatctacgtggcattatgacgaagataatccttacaagacatgggcatatcacggcagttacgaggtaaaaccatccggcagcgcctcatccatggtgaacggggttgtcagactgctaaccaagccctgggacgtgatccctatggtgactcaaatcgctatgaccgacacaacgccatttggacagcagcgcgtcttcaaggagaaagttgataccaggactccccgaccgaagcggggtacagcccaaattatggaagtgaccgcaaaatggctttggggctttctgtctagaaataagaaacctaggatatgtactcgcgaggaattcacacgtaaggtacggagcaacgccgctatcggggcggtgtttgtcgacgagaatcagtggaacagtgccaaggaagcagtggaggatgagagattctgggacctcgttcatagggaacgcgagctgcacaaacagggaaagtgcgctacctgcgtgtataatatgatgggcaaacgagaaaagaaattgggtgagtttgggaaggccaagggatcccgggcaatttggtacatgtggctgggcgccagattcctcgaattcgaggctcttggctttatgaacgaggatcattggttcagcagggaaaattctctgtcaggggtcgagggagaaggtttacacaaactgggctacatcttgcgcgacattagtaagatcccagggggaaacatgtatgccgatgacacagcgggctgggatactagaataaccgaggacgatctccagaatgaggcaaaaatcacggacattatggaacccgagcacgccctgctagctacctccatctttaagcttacataccaaaacaaagtggtacgggttcagaggcctgccaagagcggtactgtgatggatgtcatttctcgtcgagaccagcgcgggtcgggacaggtgggcacctatggcctgaacacattcactaatatggaagtgcaactcatcagacagatggagtcagaagggatatttagcccatccgagctggagaacagtaatttggcagaacgggtcttagactggctggagaaacatggagttgaaaggctcaagcgcatggctatttctggtgatgactgtgtggtaaagcccaccgatgacagattcgccacggctcttacagccctgaacgatatgggcaaagtgcggaaggacatcccgcagtgggagcctagcaaagggtggaatgattggcagcaagtccccttttgctcccaccatttccaccagctaatcatgaaggacggaagggaaattgtggttccatgtcgaaaccaggatgagctggtgggccgtgcaagagtctcacagggtgcggggtggagtctccgcgagaccgcctgcttgggaaaatcttacgctcaaatgtggcagctgatgtattttcaccggagggaccttagactggccgcaaatgctatatgtagcgccgtgcctgtaaactgggttcccacttcccgcacaacctggtcaatccatgcacaccatcagtggatgactaccgaagatatgctcagcgtgtggaatcgggtctggattgaggaaaacccatggatggaggacaagacacacgtgtcttcctgggaagacgttccctacttaggcaagagggaggatcaatggtgcggcagtctgatcgggttgacggcccgagcgacctgggctactaatattcaggtggccatcaaccaggtcagacggctgataggaaatgagaactatctcgactacatgacaagcatgaaaaggttcaagaatgaatcggatcctgagggtgcactttggtga

SEQ ID NO: 14199 - RNA, 9879 nt, synthetic construct
  misc_feature 1..9879: note = derived and/or modified CDS sequence (opt3) from DENV-1__KM403591__SS-prME
  source 1..9879: mol_type = other RNA
agcgtgaccatgctgctcatgcttctgcccactgcattggctttccacttaactacgagaggaggggaacctcatatgatcgtctccaagcaagaaaggggaaaatctctgctatttaagacctcagccggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggttgacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggggaaactgacccttaagggagtgtcttatgtcatgtgtacaggttccttcaaattggagaaggaagtggctgagactcagcacggcaccgttctggtgcaggtaaagtacgaggggacggacgcgccttgcaaaataccaatcagcacacaagatgaaaagggagtcacccagaacggccgcctcattactgcaaatcccatcgtgacagacaaagagaagcctgttaacatagaaaccgagccacccttcggtgagtcgtatattgtgatcggggccggcgaaaaagctctgaaactttcttggtttaagaaaggatcctcaatcggcaagatgttcgaggccactgcaagaggggccaggcggatggctattctgggagataccgcctgggactttggtagtatcggcggggtcttcacaagcgtgggaaaattggtacatcaggtgtttggcacggcatacggtgttctcttctccggggtctcttggaccatgaagattggcataggaatcctgttaacttggctgggcctaaatagccgatcaacaagtctctccatgacctgtattgcggtggggatggtgacactgtaccttggagtcatggttcaggctgatagcggctgcgtgatcaactggaaaggtcgcgaattgaagtgtgggtctggaatctttgtgactaacgaggtacacacctggacggaacaatataagttccaggccgactcaccgaaaagactgagtgcagccattggcaaggcttgggaggagggtgtctgcggcataaggagcgccacacggctcgaaaatatcatgtggaaacagatttccaacgagctgaatcatatcttactggaaaacgatatgaagtttaccgtggttgtgggggacgcaaatggcattcttactcagggcaaaaagatgatccgccctcaacccatggagcacaaatactcttggaagtcgtgggggaaggctaaaataatcggagccgacacccagaacacaactttcattatcgatggcccagacacccctgaatgtcccgatgaccagagagcgtggaatatttgggaggtcgaggattatggttttggggtgttcacaacgaacatctggttgaagctcagggacagctacacccagatgtgcgatcaccgtctgatgtccgccgctataaaagactcaaaggcagttcatgccgatatgggatattggattgaaagtgagaaaaatgaaacttggaagctagctcgggcctcttttatcgaggtgaagacatgtatttggccacgaagccacaccctgtggtccaacggcgtactcgaatcagagatgatcatacccaaaatctacggtggccctattagccaacataattatagaccagggtacttcactcagacagcaggaccgtggcacctgggcaaacttgagttggacttcaacctgtgcgaagggaccacggtcgtggtggatgagcactgcggaaataggggcccctctttacgcactaccacagtcaccggtaaaatcattcatgaatggtgttgccggtcctgtactctccctccactgagatttagaggggaagacggatgctggtacggcatggagatccgccccgttaaggaaaaagaggaaaaccttgtgcgaagtatggtaagcgcgggttctggcgaggtggattccttctcactggggttgctctgtgtcagtataatgattgaagaggtgatgcggagccgttggtcgagaaagatgctgatgacaggaaccctagccgtatttttcctgctcatcatgggccagctgacatggaatgaccttatcaggttgtgcattatggtgggggctaacgtctccgaccgcatgggaatgggcactacctatctggccttaatggcaacgtttaagatgcggcctatgttcgctgtgggtctcctgtttagaaggcttacatctcgagaggttctgctactcaccatcgggctgagcttggtggcctcagtcgaactgccaaacagtttagaggaactcggagatggcctggcaatgggcattatgatgcttaaactgttgactgacttccaatcccaccagctctggaccacactgctatctctgacttttataaagaccacgcttagcctcgattacgcctggaaaacaatggctatggtactgtccatcgtgtcattgttccccctgtgtttaagcaccacaagtcagaagacaacctggctcccggttctgcttgggtcttttggatgcaaacctctgactatgttcttgattacagagaataagatctggggtcgcaagtcctggccactcaacgaaggcattatggcggtggggatcgtcagcatactgctatcgtcactgcttaaaaatgacgtgcccctcgccggacctctgatcgcaggcggtatgttgattgcttgttatgtaatctctgggagttccgccgatttaagcctggagcgggccgctgaggtgtcttgggaagaggaagcagagcatagcggagcctcccacaacattctcgtcgaagttcaggacgatggcaccatgaagatcaaagacgaggagagagatgacacgctgactatacttctgaaggcgaccttgctagctgtgtcaggcgtgtaccccatgagtattccagccacactgtttgtctggtatttctggcagaagaagaaacagaggagcggggtgctctgggataccccttctcccccagaagttgagcgtgcagtactggacgatggaatctaccgcatccttcagcggggtttactgggcagatcccaggtgggggtcggagtgttccaagacggcgtttttcatacaatgtggcacgtgactaggggtgccgtcctcatgtatcaggggaaacgattggaaccgtcatgggctagtgtgaagaaagacctgattagctacggaggcggctggcggttccaggggtcctggaataccggagaggaggtacaggtcatagcagtggaacctggtaagaaccccaaaaatgttcaaacgacaccaggcacttttaagacccccgagggggaagtgggagccatcgcgctcgatttcaaacctggcacatctggttcgccaattgtcaaccgcgaggggaagatcgtgggactgtacggcaatggcgttgtgaccactagcgggacctatgtctcagctattgcccaggcaaaggcctcccaggaaggaccccttcctgagatcgaggacgaagtgtttaaaaagagaaacctgacaataatggatttgcacccgggtagtggcaaaacgaagaggtacctaccagctatcgtacgggaggccattaaacgaaagctgagaactctcatcttagcacccacccgcgtggttgcttctgaaatggccgaggcgctgaaggggatgcctattaggtatcaaacaaccgccgtcaaaagcgaacatactggaaaggagatcgtggaccttatgtgccacgcaacattcaccatgcgtctgctctccccagtgcgggtccccaattacaacatgataattatggatgaggctcattttacggaccctgcctcaatcgctgcaagaggctatatctctactagggtaggtatgggggaagccgccgctattttcatgacagcgaccccgcccggaagcgtggaggcatttccacagagtaatgccgttatccaggatgaagaacgcgacatacctgaacgatcctggaacagcggctacgattggattaccgacttccccggcaaaactgtgtggtttgtcccatctatcaagtcagggaatgatattgctaactgtttgaggaagaacggaaagcgggtgatccagctgtccaggaagacattcgacaccgagtatcagaaaactaagaataacgactgggattacgttgtgactacggacataagtgagatgggtgccaatttccgcgcagatcgtgtcattgaccctagacggtgcctcaaacccgtgatcctgaaggatggcccagaaagggtaatccttgccgggccgatgcctgtgaccgctgcgagcgccgcacaacgccgaggaagaattggccggaaccagaataaagagggtgaccagtacatctatatggggcaacccctaaacaatgatgaagaccacgctcattggacagaggccaagatgctgttggataacattaatactccagagggcataatccccgcattatttgaacctgagagggaaaagtcggccgctattgacggagagtaccgcctgagaggcgaagccaggaaaaccttcgttgagctcatgcggcgtggggatctgccagtctggctttcttataaggtggcgtccgagggatttcagtacagcgaccgccgatggtgcttcgatggtgaaagaaacaatcaggtgctggaggaaaacatggacgtcgagatctggacaaaagaaggcgagaggaagaaactccggccccgctggttggacgcaagaacctattcagatcctctggccctaagggagtttaaggagttcgctgccgggcggcgaagtgtttctggagacctgatcctcgagattggcaaacttccgcagcacctgactttaagagctcaaaatgcattggataacctggtgatgctccacaattccgaacagggtgggaaggcctaccgccatgctatggaggaactgccagacacgatagagacccttatgctgctcgccttgatcgcagtactgacaggcggagtgactttatttttcctaagcggcaaggggctgggaaaaacctcaattggtctcctttgtgtcatggcgagtagcgtgctgttgtggatggcctccgttgagccccactggatcgctgcctctattatcctggaatttttcctcatggtgctgcttatacctgagcccgataggcagcggacaccacaggacaaccaactcgcatatgtcgtaatcggcctgttgtttatgattctgaccgtggctgccaacgaaatggggttactagagactacaaagaaagatctgggaatcggccatgttgtggcagagaatcaccaccatgccacgatgctcgacattgatcttcaccctgctagcgcgtggaccctgtacgccgtcgcaactacaatcataacccccatgatgcgtcataccattgaaaacacaactgctaatatctccttgacggccattgccaaccaggcagctatcctgatgggtctcgacaaggggtggccaatatcaaaaatggatatcggcgtgcctctgcttgccttaggatgctactctcaggtcaatccgctgaccctcacagcggctgtgttgatgctggttgcccactatgcaattatcggccccgggctacaagccaaggctactagagaggcacagaagaggaccgccgcgggaattatgaaaaacccaacagtggacggcatcgtagctatagatctggaccctgtggtctacgacgccaagttcgaaaaacagctcggtcagattatgcttctgatcttgtgtaccagtcaaatcctgctcatgcgcactacgtgggcactgtgcgagtcgattacattagccaccgggccccttactaccctgtgggaaggaagcccaggcaagttttggaatacaactatcgctgtttccatggccaacatattccggggttcttatctcgcaggcgctgggctagccttctcactgatgaagtccttgggaggcgggcgaagaggaaccggcgcgcagggtgagacactgggggagaagtggaagaggcagctcaatcagcttagcaaaagtgaatttaacacgtacaagcgctctggaattatggaggtggatcggagcgaagccaaagagggcctgaagagaggtgaaaccactaaacatgcagtctcacgtggcacagctaagttgaggtggttcgtggagcggaatctggtaaagcctgaggggaaagtgatcgacctcggatgtggccgcgggggatggtcctattactgcgccggcttaaagaaagttaccgaagtgaagggttatactaaagggggacccggccacgaggaaccgattccaatggcaacatacggctggaacatcgtcaagctgcacagtgggcgagatgtgtttttcacccctcccgagaaatgtgacacgcttctgtgcgatataggagaaagctctccaaatcccaccatcgaggagggtagaacactaagggtcctcaagatggtggaaccttggctgcggggcaaccaattttgtattaagatcttgaatccgtacatgccctccgttgtagagactctggaacagatgcagcgcaaacatgggggaatgctcgtgagaaacccactttcaaggaatagcacccacgagatgtattgggtctcgtgcggcacaggtaacattgtgtctgctgttaacatgacaagtcgaatgctgttaaatcggttcaccatggcccatcgtaagcctacatacgagagagacgtggatctgggggccggaacccgccacgtcgcggtggaacccgagatcgctaacttggacattatcggccagaggatagaaaatattaaaaacgagcacaagtccacttggcattatgatgaagacaatccttacaaaacgtgggcatatcacggcagctacgaggtaaagccatcagggtccgcctctagcatggtgaacggagttgtccggctcctgacaaagccctgggatgtgatccctatggtgacccaaatcgctatgactgacaccacaccatttggtcagcagagagtcttcaaagagaaggttgacacgcgcacccccaggccgaaacgaggcactgcccaaattatggaagtgacagcaaagtggctatgggggtttcttagtcggaataaaaagcctagaatatgtaccagggaggagttcactcgcaaggtacgttccaacgccgctatcggagcggtgtttgtcgatgagaatcagtggaacagcgccaaagaagcagtggaggacgagcggttctgggatctggttcatagagaaagggagctccacaagcagggcaaatgcgctacatgcgtgtataatatgatgggtaagcgcgagaaaaagctgggggagtttggaaaggccaaaggctctcgagcaatttggtacatgtggttgggcgcccggttcctggagttcgaggctctcgggtttatgaacgaggaccattggttctcaagagaaaatagtctttccggagtcgagggtgaaggcctgcacaagttagggtacatcctgagggatattagcaaaatcccaggaggcaacatgtatgccgacgataccgcgggttgggacacacgcataactgaggatgacttgcagaatgaggcaaagatcaccgatattatggaacccgagcacgccctcctggctacgtctatctttaaactaacctaccaaaacaaggtggtaagagttcagcggcctgccaaatcggggacagtgatggacgtcatttcaaggcgtgatcagcgaggaagcggccaggtgggcacttatgggcttaacaccttcacaaatatggaagtgcaactgatccgccagatggagtccgaaggaatatttagtccatctgagctcgagaacagcaatctggcagaaagagtcttggactggttagagaagcatggtgttgaacggctgaagaggatggctatttccggcgacgattgtgtggtaaaacccactgacgatcgcttcgccaccgctctcacggcccttaacgacatggggaaggtgagaaaagatatcccgcagtgggagccttcaaagggatggaatgactggcagcaagtccccttttgcagtcaccatttccaccagctgatcatgaaagatggccgggaaattgtggttccatgtaggaaccaggacgagctagtgggtcgagcacgtgtctctcagggggcgggatggagcctgagagagacagcctgcctcggcaagtcctacgctcaaatgtggcagttgatgtattttcaccgccgggatctgaggcttgccgcaaatgctatatgttcagccgtgcctgtaaactgggttcccaccagcagaactacatggtctatccatgcacaccatcagtggatgaccactgaagacatgctgtccgtgtggaatcgcgtctggattgaggaaaacccatggatggaggataagacccacgtgagtagctgggaagacgttccctacctcggcaaacgggaggaccaatggtgcgggtcgttaatcggactgacagccagggcgacgtgggctaccaatattcaggtggccatcaaccaggtccgaagattgataggtaatgagaactatctggattacatgacttccatgaagcggttcaaaaatgaatctgaccctgagggcgcactctggtga

SEQ ID NO: 14200 - RNA, 9879 nt, synthetic construct
  misc_feature 1..9879: note = derived and/or modified CDS sequence (opt3) from DENV-1__KM403607__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaagggggtgtcttatgtcatgtgtacaggatccttcaaattggagaaggaagtggctgagactcagcacggtaccgttctggtgcaggtaaagtacgagggcacggatgcgccttgcaaaataccaatcagcattcaagacgaaaagggggtcacacagaacggacgcctcatcaccgcaaatcccatagtgactgataaagagaagcctgttaacattgaaacagagccacccttcggcgagtcgtatatcgtgatcggtgccggggaaaaagctctgaagctttcttggtttaagaaaggctcctcaattggaaagatgttcgaggccaccgcaagaggcgccaggcggatggctatcctgggggacactgcctgggattttggaagtattggtggcgtcttcaccagcgtggggaaattggtacatcaggtgtttggaacagcatacggcgttctcttctccggtgtctcttggacgatgaagatagggatcggcattctgttaacctggctgggactaaatagccgatcaactagtctctccatgacatgtatcgcggtgggcatggtgaccctgtaccttggggtcatggttcaggctgacagcggatgcgtgatcaactggaaaggccgcgaattgaagtgtggttctgggatttttgtgacaaacgaggtacacacttggaccgaacaatataagttccaggccgattcaccgaaaagactgagtgcagccataggaaaggcttgggaggagggcgtctgcggtatcaggagcgccacgcggctcgaaaatattatgtggaaacagatctccaacgagctgaatcatattttactggaaaacgacatgaagtttacagtggttgtgggcgacgcaaatgggatccttacccagggaaaaaagatgatacgccctcaacccatggagcacaaatactcttggaagtcgtggggcaaggctaaaatcattggggccgatactcagaacaccacattcatcattgacggaccagatactcctgaatgtcccgacgatcagagagcgtggaatatctgggaggtcgaggactatggctttggtgtgttcaccacaaacatatggttgaagctcagggatagctacacgcagatgtgcgaccaccgtctgatgtccgccgctattaaagattcaaaggcagttcatgccgacatggggtattggatcgaaagtgagaaaaatgaaacctggaagctagctcgggcctcttttattgaggtgaagacttgtatctggccacgaagccacacactgtggtccaacggagtactcgaatcagagatgataatccccaaaatttacggcggtcctatcagccaacataattatagaccaggctacttcacccagactgcagggccgtggcacctgggaaagcttgagttggatttcaacctgtgcgaaggcacaaccgtcgtggtggacgagcactgcgggaataggggaccctctttacgcacgactaccgtcacaggcaaaattatccatgaatggtgttgccggtcctgtaccctccctccactgagatttaggggtgaggatgggtgctggtacggaatggagatacgccccgttaaggaaaaagaggaaaaccttgtgcgaagtatggtaagcgcgggctctggtgaggtggactccttctcactgggcttgctctgtgtcagtattatgatcgaagaggtgatgcggagccgttggtcgagaaagatgctgatgactgggacactagccgtttttttcctgctcatcatgggacagctgacctggaatgaccttattaggttgtgcatcatggtgggcgctaacgtctccgatcgcatggggatgggaacaacttatctggccttaatggcaacctttaagatgcggcctatgttcgctgtgggcctcctgtttagaaggcttacgtctcgagaggttctgctactcacaattggtctgagcttggtggcctcagtcgaactgccaaacagtttagaggaactcggggacggactggcaatgggcataatgatgcttaaactgttgaccgatttccaatcccaccagctctggactaccctgctatctctgacatttatcaagactacccttagcctcgactacgcctggaaaacgatggctatggtactgtccattgtgtcattgttccccctgtgtttaagcacaaccagtcagaagactacatggctcccggttctgcttggctcttttgggtgcaaacctctgaccatgttcttgatcactgagaataagatttggggacgcaagtcctggccactcaacgaaggtatcatggcggtgggcatagtcagcatcctgctatcgtcactgcttaaaaatgatgtgcccctcgccgggcctctgattgcaggaggcatgttgatcgcttgttatgtaatttctggtagttccgccgacttaagcctggagcgggccgctgaggtgtcttgggaagaggaagcagagcatagcggggcctcccacaacatcctcgtcgaagttcaggatgacggaacaatgaagataaaagatgaggagagagacgataccctgacgattcttctgaaggcgactttgctagctgtgtcaggcgtgtaccccatgagtatcccagccaccctgtttgtctggtatttctggcaaaaaaagaaacagaggagcggcgtgctctgggacacaccttctcccccagaagttgagcgtgcagtactggatgacgggatctaccgcattcttcagcggggattactgggtagatcccaggtgggcgtcggggtgttccaagacggagtttttcataccatgtggcacgtgacaaggggcgccgtcctcatgtatcagggtaagcgattggaaccgtcatgggctagtgtgaagaaagatctgataagctacgggggaggctggcggttccagggctcctggaatactggggaggaggtacaggtcatcgcagtggaacctggaaagaaccccaaaaatgttcaaaccacgccaggtacatttaagactcccgagggcgaagtgggggccattgcgctcgacttcaaacctggaacctctggctcgccaatcgtcaaccgcgagggtaagattgtggggctgtacggaaatggcgttgtgacaaccagcggcacttatgtctcagctatcgcccaggcaaaggcctcccaggaagggccccttcctgagatagaggatgaagtgtttaaaaagagaaacctgaccatcatggacttgcacccgggaagtggtaaaacaaggcggtacctaccagctattgtacgagaggccatcaagagaaaactgcgcacgctcattttagcacccactagggtggttgcttctgaaatggccgaggcgctgaagggcatgcctatccgttatcaaaccacagccgtcaagagcgaacataccgggaaagagatagtggatcttatgtgccacgcaactttcacaatgcggctgctctccccagtgagagtccccaattacaacatgattatcatggacgaggctcattttaccgatcctgcctcaatcgctgcaaggggatatatttctacgcgcgtaggcatgggtgaagccgccgctatcttcatgactgcgacaccgcccgggagcgtggaggcatttccacagagtaatgccgttatacaggacgaagagcgagatattcctgaaagatcctggaacagcggatacgactggatcaccgatttccccggcaagaccgtgtggtttgtcccatctattaaatcaggcaatgacatcgctaactgtttgcggaagaacgggaaaagggtgatacagctgtcccgcaagactttcgacacagagtatcaaaagaccaaaaataacgattgggactacgttgtgacaactgatattagtgagatgggagccaatttccgtgcagacagagtcatcgatcctcggaggtgcctcaagcccgtgatcctgaaagacggtccagaacgcgtaattcttgccggcccgatgcctgtgacggctgcgagcgccgcacagcgaagagggcggatcggaaggaaccagaataaggagggcgatcagtacatttatatgggtcaacccctaaacaatgacgaagatcacgctcattggaccgaggccaaaatgctgttggacaacataaatacaccagaggggatcattcccgcattatttgaacctgagcgcgaaaagtcggccgctatcgatggcgagtacagactgaggggagaagcccggaagactttcgttgagctcatgcgtcgcggcgacctgccagtctggctttcttataaagtggcgtccgaggggtttcagtacagcgatcgaagatggtgcttcgacggagaaaggaacaatcaggtgctggaggaaaacatggacgtcgagatctggaccaaggaaggtgagcggaaaaagctccgccccagatggttggatgcaaggacatattcagaccctctggccctacgggagtttaaagaattcgctgccggccgaagaagtgtttctggggatctgattctcgagataggaaagcttccgcagcacctgaccttacgcgctcaaaatgcattggacaacctggtgatgctccacaattccgaacagggcggtaaagcctacaggcatgctatggaggaactgccagatactatcgagacgcttatgctgctcgccttgattgcagtactgaccgggggcgtgacattatttttcctaagcggaaagggcctggggaagacttcaatcggactcctttgtgtcatggcgagtagcgtgctgttgtggatggcctccgttgagccccactggattgctgcctctatcatactggaatttttcctcatggtgctgcttatccctgagcccgaccggcagcgtaccccacaggataaccaactcgcatatgtcgtaattggtctgttgtttatgatcctgacagtggctgccaacgaaatgggcttactagagaccactaaaaaggacctggggattggacatgttgtggcagagaatcaccaccatgccacaatgctcgatatcgaccttcaccctgctagcgcgtggacgctgtacgccgtcgcaaccactataattacacccatgatgagacataccatcgaaaacaccacagctaatatttccttgactgccatcgccaaccaggcagctatactgatgggcctcgataaaggttggccaatctcaaagatggacattggggtgcctctgcttgccttaggctgctactctcaggtcaatccgctgacgctcaccgcggctgtgttgatgctggttgcccactatgcaatcattggacccggcctacaagccaaagctacaagggaggcacagaagcgcactgccgcggggatcatgaagaacccaaccgtggatggaatagtagctattgacctggaccctgtggtctacgatgccaaattcgaaaagcagctcggccagatcatgcttctgatcttgtgtacaagtcaaattctgctcatgcggaccacttgggcactgtgcgagtcgatcacgttagccacaggtccccttaccactctgtgggaagggagcccaggaaaattttggaataccacaatagctgtttccatggccaacattttccgaggctcttatctcgcaggtgctggcctagccttctcactgatgaagactttggggggaggcagaagggggaccggagcgcagggcgagacactgggtgagaaatggaagcgccagctcaatcagcttagcaagtccgaatttaacacgtacaaacggagtgggatcatggaggtggacagatctgaagccaaggagggactgaaacgtggcgaaaccactaagcatgcagtcagcaggggtacagctaaattgcggtggttcgtggagcgcaatctggtaaagcctgagggcaaggtgattgatctcgggtgtggacgaggcgggtggtcatattactgcgccggattaaaaaaggttaccgaagtgaaaggctatactaagggtgggcccggacacgaggaaccgatcccaatggcaacatacggctggaacatagtcaaactgcactccggcagagacgtgtttttcacccctcccgagaagtgtgatacgcttctgtgcgacatcggggaaagtagcccaaatcccaccattgaggagggaaggacactacgggtcctcaaaatggtggaaccttggctgcgcggtaaccaattttgtatcaagattttgaatccgtacatgccctctgttgtagagactctggaacagatgcagagaaagcatggcgggatgctcgtgaggaacccactttcccgaaattcaacccacgagatgtattgggtcagctgcggaacaggcaacatcgtgtcggctgttaacatgacttctcggatgctgttaaatcgtttcaccatggcccatagaaaacctacatacgagcgcgatgtggacctgggtgccgggaccaggcacgtcgcggtggaacccgagattgctaacttggatatcataggacagcggattgaaaatatcaagaacgagcacaaaagtacttggcattatgacgaagataatccttacaagacgtgggcatatcacggctcctacgaggtaaaaccaagcggctcagcctcctctatggtgaacggggttgtcagactcctgacaaagccctgggacgtgatccctatggtgacccaaattgctatgactgacaccacaccatttggacagcagcgcgtcttcaaggagaaagttgatacgaggaccccccgaccgaagcggggtactgcccaaataatggaagtgacagcaaaatggctatggggctttcttagcagaaataagaaacctaggatctgtacccgcgaggaattcactcgtaaggtacggagtaacgccgctattggggcggtgtttgtcgacgagaatcagtggaactccgccaaggaagcagtggaggatgagagattctgggacctggttcatagggaacgcgagctccacaaacagggaaagtgcgctacatgcgtgtataatatgatgggcaaacgagaaaagaaactgggtgagtttgggaaggccaagggaagccgggcaatctggtacatgtggttgggcgccagattcctggaattcgaggctctcggctttatgaacgaggatcattggttctctagggaaaattcacttagtggggtcgagggagaaggtctgcacaaattaggctacattctgcgcgacatctccaagataccagggggaaacatgtatgccgatgacaccgcgggctgggatacaagaatcactgaggacgatttgcagaatgaggcaaaaattaccgacatcatggaacccgagcacgccctcctggctacgagcatttttaagctaacctaccaaaacaaagtggtacgggttcagaggcctgccaagtctggtacagtgatggatgtcatctcgcgtcgagaccagcgcgggtcaggacaggtgggcacttatggccttaacaccttcacaaatatggaagtgcaactgataagacagatggagagcgaagggattttttccccaagtgagctcgagaactctaatctggcagaacgggtcttggactggttagagaaacatggagttgaaaggctgaagcgcatggctatcagcggtgatgactgtgtggtaaagcccactgatgacagattcgccaccgctctcacggcccttaacgatatgggcaaagtgcggaaggacatcccgcagtgggagccttccaaagggtggaatgattggcagcaagtccccttttgctcacaccatttccaccagctgattatgaaggacggaagggaaatagtggttccatgtcgaaaccaggatgagctagtgggccgtgcaagagtcagtcagggtgcggggtggtctctgcgcgagacagcctgcctcggaaaaagctacgctcaaatgtggcagttgatgtattttcaccggagggacctgagacttgccgcaaatgctatctgttccgccgtgcctgtaaactgggttcccacctcacgcactacatggagcattcatgcacaccatcagtggatgaccactgaagatatgctgtctgtgtggaatcgggtctggatcgaggaaaacccatggatggaggacaagacccacgtgtccagttgggaagacgttccctacctcggcaagagggaggatcaatggtgcggcagcttaattgggctgacagcccgagcgacgtgggctaccaatatccaggtggccataaaccaggtcagacggttgatcggaaatgagaactatctggactacatgacttcgatgaaaaggttcaagaatgaatccgatcctgagggtgcactctggtga

SEQ ID NO: 14201 - RNA, 9879 nt, synthetic construct
  misc_feature 1..9879: note = derived and/or modified CDS sequence (opt3) from DENV-1__KM403581__SS-prME
  source 1..9879: mol_type = other RNA
agcgtgaccatgctgctcatgcttctgcccactgcattggctttccacttaactacgagaggaggggaacctcatatgatcgtctccaagcaagaaaggggaaaatctctgctgtttaagacctcagccggtgttaacatgtgcacactcattgcaatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagaccgtagaagcgtggcactggcaccccatgtcggcttgggtctcgagactaggaccgaaacatggatgtcctctgagggggcctggcggcagatccagcgcgtggaaacttgggctctgagacaccctggattcaccgttattgcactgtttctcgcccatgctatcggcacatcgattacccagaagggcatcatattcatcttactgatgcttgtgacgccatcaatggccatgaggtgcgtcgggattggaaaccgggattttgtggagggtttgagcggcgcgacttgggtagacgttgtgctggagcacgggagttgtgtcacaaccatggccaagaataagcccactctagatatcgaactcctgaagacagaggtgaccaaccctgccgtgcttcgcaaactgtgcattgaagctaagatctccaatacgaccacagactctcgatgtccaactcaaggagaggccaccttggtcgaagaacaggatgcaaacttcgtttgcagaaggacatttgtggaccggggctggggtaatgggtgtggactcttcggcaaaggcagcctgttaacttgcgctaagtttaaatgcgtaaccaagctggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccacgtactggactagatttcaacgaaatggtcctgctcacaatgaaggagaaaagctggctggtgcataagcagtggtttcttgacctgccgttgccctggacgtctggcgcatccacctcacaagagacttggaatcgccaggatctcctggtaacattcaaaaccgctcacgccaagaaacaggaagttgtggtcttaggtagccaagagggggctatgcacacagccctgactggcgcaaccgaaatccagacgagtggaaccacaactatttttgccggccatctaaagtgcagactcaagatggacaaactgacccttaagggggtgtcttatgtcatgtgtacaggatccttcaaattggagaaggaagtggctgagactcagcacggtaccgttctggtgcaggtaaaatacgagggcacggatgcgccttgcaagataccaatcagcacacaagacgaaaagggggtcacccagaacggaaggctcattactgcaaatcccatcgtgacagataaagagaagcctgttaacatagaaaccgagccacccttcggcgagtcgtatattgtgatcggtgccggggaaaaagctctgaaactttcttggtttaaaaagggctcctcaatcggaaagatgttcgaggccactgcacggggcgcccgacgcatggctattctgggggacaccgcctgggattttggaagtatcggtggcgtcttcacaagcgtggggaaattggtacatcaggtgtttggaacggcatacggcgttctcttctccggtgtctcttggaccatgaagattgggataggcatcctgttaacttggctgggactaaatagcagatcaacaagtctctccatgacctgtattgcggtgggcatggtgacactgtaccttggggtcatggttcaggctgacagcggatgcgtgatcaactggaaaggcagggaattgaagtgtggttctgggatctttgtgactaacgaggtacacacctggacggaacaatataaattccaggccgattcaccgaagcggctgagtgcagccattggaaaggcttgggaggagggcgtctgcggtatacgcagcgccacaagactcgaaaatatcatgtggaaacagatttccaacgagctgaatcatatcttactggaaaacgacatgaagtttaccgtggttgtgggcgacgcaaatgggattcttactcagggcaagaagatgatcaggcctcaacccatggagcacaaatactcttggaagtcgtggggcaaagctaagataatcggggccgatacccagaacacaactttcattatcgacggaccagatacccctgaatgtcccgacgatcagcgtgcgtggaatatttgggaggtcgaggactatggctttggtgtgttcacaacgaacatctggttgaagctccgggatagctacacccagctgtgcgaccaccgactaatgtccgccgctataaaagattcaaaggcagttcatgccgacatggggtattggattgaaagtgagaaaaatgaaacttggaagctggctagagcctcttttatcgaggtgaaaacatgtatttggccaaggagccacaccctctggtccaacggagtactggaatcagagatgatcatacccaagatctacggcggtcctattagccaacataattatcgcccaggctacttcactcagacagcagggccgtggcaccttggaaagttggagctggatttcaacttatgcgaaggcaccacggtcgtggtggacgagcactgcgggaatcggggaccctctctcagaactaccacagtcaccggcaaaatcattcatgaatggtgttgcaggtcctgtactctgcctccacttcgctttcgaggtgaggatgggtgctggtacggaatggagatccggcccgttaaggaaaaagaggaaaacctggtgcgtagtatggtaagcgcgggctctggtgaggtggactccttctcattgggcctcctgtgtgtcagtataatgattgaagaggtgatgagaagcagatggtcgcgcaagatgctaatgacagggaccctggccatctttttcctcctgatcatgggacagcttacatggaatgacttgattcggctgtgcatcatggttggcgctaacgtgtccgatagaatggggatgggaactacctatttagccctcatggcaacgtttaaaatgaggcctatgttcgctgtcggcctgctttttcgacgcctgacatctcgggaggtgctactcctgaccattggtttgagcctggttgcctcagtggaattaccaaacagtctcgaggaactgggggacggacttgcaatgggcataatgatgctgaagttgctcactgatttccaatcccaccagctgtggaccacactactgtctcttacttttatcaagaccacgctcagcctggactacgcctggaaaacaatggctatggtcttgtccattgtatcactgttccccttatgtctcagcaccacaagtcagaagacaacctggctgccggtgcttctgggctcttttgggtgcaaacctttgactatgttcctcatcacagagaataagatttggggaagaaaatcctggccactgaacgaaggtatcatggcggttggcatagtgagcatcctactgtcgtcacttctcaagaatgatgtccccctggccgggcctttgattgcaggaggcatgttaatcgcttgttatgtgatttctggtagttccgccgacctgagcctcgagagggccgctgaggtatcttgggaagaggaagcagagcatagcggggcctcccacaacatcctggtggaagtccaggatgacggaaccatgaagataaaagatgaggagcgtgacgatacgcttactattctgttgaaggcgaccctactggctgtttcaggcgtgtaccccatgagtatcccagccacactctttgtgtggtatttctggcagaagaagaaacagcgcagcggcgtcctgtgggacaccccttctcccccagaagtggagcgggcagttcttgatgacgggatctacagaattttacagaggggactgctcggtcgatcccaggtaggcgtgggggtcttccaagacggagtgtttcatacaatgtggcacgttactcggggcgccgtgttgatgtatcagggtaagcgcctggaaccgtcatgggctagtgtcaaaaaggatctcataagctacgggggaggctggagattccagggctcctggaataccggggaggaggtgcaggtaatcgcagtcgaacctggaaagaaccccaaaaatgtgcaaacgacaccaggtacttttaagacccccgagggcgaagttggggccattgcgctggacttcaaacctggaacatctggctcgccaatcgtgaacagggagggtaagattgtcgggctttacggaaatggcgtggttaccactagcggcacctatgtgtcagctatcgcccaggcaaaagcctcccaggaagggcccctgcctgagatagaggatgaagtctttaagaagcggaacttgacaatcatggacctacacccgggaagtggtaaaacgcgaagatacctgccagctattgtgcgcgaggccatcaagaggaaactccgtactttaattctggcacccacccgggtagtggcttctgaaatggccgaggcgcttaagggcatgcctatcagatatcaaacaaccgccgttaaaagcgaacatactgggaaggagatagtcgatctgatgtgccacgcaacattcaccatgaggctcttgtccccagtgcgcgtgcccaattacaacatgattatcatggacgaggctcattttacggatcctgcctcaatcgctgcacgaggatatatttctactagagtcggcatgggtgaagccgccgctatcttcatgacagcgaccccgcccgggagcgtagaggcatttccacagagtaatgccgtgatacaggacgaagaacgggatattcctgaaaggtcctggaacagcggatacgactggatcaccgatttccccggcaagactgtttggtttgtgccatctattaaatcaggcaatgacatcgctaactgtctgcgcaagaacgggaaacgtgtcatacagctctccagaaagacattcgacaccgagtatcagaaaactaagaataacgattgggactacgtggttactacggatattagtgagatgggagccaatttccgggcagacagggtgatcgatcctcgccgatgcctgaagcccgtcatccttaaagacggtccagaaagagtgattctagccggcccgatgcctgtaaccgctgcgagcgccgcacaacggagggggcgcatcggaagaaaccagaataaggagggcgatcagtacatttatatgggtcaacccctgaacaatgacgaagatcacgctcattggacagaggccaaaatgttgttagacaacataaatactccagaggggatcattcccgcactgtttgaacctgagagggaaaagtcggccgctatcgatggcgagtaccggctccgtggagaagcccgcaaaaccttcgtggagctgatgcgaagaggcgaccttccagtttggctgtcttataaggtcgcgtccgaggggtttcagtacagcgataggcggtggtgcttcgacggagaacgcaacaatcaggtgctcgaggaaaacatggacgtggagatctggacaaaggaaggtgagaggaaaaagttgaggccccggtggctggatgcacgaacctattcagaccctctagccctgagagagtttaaagagttcgctgccggccgcaggagtgtctctggggatctcattcttgagataggaaagctgccgcagcacttaactttgcgggctcaaaatgcactggacaacctcgttatgctgcacaattccgaacagggcggtaaagcctaccgtcatgctatggaggaacttccagatacgatcgagaccctgatgctcttggccctgattgcagtgttaacagggggcgtaactctatttttcctgagcggaaagggcctcgggaaaacctcaatcggacttctgtgtgtgatggcgagtagcgtcttgctgtggatggcctccgtggagccccactggattgctgcctctatcatactcgaatttttcctgatggttcttctcatccctgagcccgacagacagaggacaccacaggataaccaactggcatatgtggtcattggtttgctgtttatgatcttaaccgtagctgccaacgaaatgggcctactggagactacaaagaaggacctcgggattggacatgtggttgcagagaatcaccaccatgccacgatgcttgatatcgacctgcaccctgctagcgcgtggaccttgtacgccgtggcaactacaataattacccccatgatgcgccataccatcgaaaacacaactgctaatatttccctgacggccatcgccaaccaggcagctatactcatgggcctggataaaggttggccaatctcaaagatggacattggggtccctcttttagccctgggctgctactctcaggtgaatccgctcaccttgacagcggctgtcctgatgctagtggcccactatgcaatcattggacccggcctgcaagccaaagctactcgggaggcacagaagcgaaccgccgcggggatcatgaaaaacccaacagttgatggaatagtggctattgacctcgaccctgtagtgtacgatgccaagttcgaaaagcagcttggccagatcatgctgttgatcctgtgtaccagtcaaattctcctgatgagaactacgtgggcattatgcgagtcgatcacacttgccaccggtcccctgactaccctctgggaagggagcccaggaaaattttggaatacaactatagctgtctccatggccaacattttcaggggctcttatctagccggtgctggcctggccttctcattgatgaaaagcctagggggaggccgccgggggaccggagcgcagggcgagacactcggtgagaaatggaagagacagcttaatcagctgtccaaaagtgaatttaacacgtacaagcgttctgggatcatggaggttgacaggagcgaagccaaggagggattgaaacggggcgaaaccactaagcatgcagtgtcacgcggtacagctaaactgcgatggttcgtcgagagaaatctcgtgaagcctgagggcaaagtaattgatttagggtgtggaaggggcgggtggtcctattactgcgccggactgaagaaggtgaccgaagttaaaggctatactaagggtgggcccggacacgaggaaccgatcccaatggcaacatacggctggaacatagtgaaacttcacagtggccgggacgtctttttcacccctcccgagaagtgtgatacgctgctatgcgacatcggggaaagctctccaaatcccaccattgaggagggacgcacactcagagtgctgaaaatggtcgaaccttggttgaggggtaaccaattttgtatcaagattctgaatccgtacatgccctccgtggttgagactctcgaacagatgcagcgaaaacatggcgggatgcttgtacggaacccactgtcacgtaatagcacccacgagatgtattgggtgtcgtgcggaacaggcaacatcgtctctgctgtgaacatgacaagtagaatgttactgaatcgcttcaccatggcccataggaagcctacatacgagcgggatgttgacttgggtgccgggaccagacacgtggcggtcgaacccgagattgctaacctcgatatcataggacagcgcattgaaaatatcaagaacgagcacaaatccacttggcattatgacgaagataatccttacaagacgtgggcatatcacggcagctacgaggtgaaaccatcaggctccgcctctagcatggtaaacggggtggttaggctgctaacaaagccctgggacgtcatccctatggtgacccaaattgctatgactgacaccacaccatttggacagcagcgagtgttcaaagagaaggtcgatacgcggacccccagaccgaagaggggtactgcccaaataatggaagttacagcaaaatggctttggggctttctgagtcgcaataagaaacctcgtatctgtacccgggaggagttcactagaaaggtgaggtccaacgccgctattggggcggtatttgtggacgagaatcagtggaacagcgccaaagaagcagtcgaggatgagcgcttctgggacctcgtgcatcgagaacgggagctgcacaagcagggaaagtgcgctacatgcgtttataatatgatgggcaaaagagaaaagaaattgggtgagtttgggaaggccaaaggatctagggcaatctggtacatgtggctgggcgcccgcttcctcgagttcgaggctcttggctttatgaacgaggatcattggttctcaagagaaaatagtctgtccggggtggagggagaaggtttacacaagctgggctacattttgcgggacatcagcaagataccagggggaaacatgtatgccgatgacaccgcgggctgggatacaaggatcactgaggacgatctccagaatgaggcaaaaattaccgacatcatggaacccgagcacgccctgctagctacgtctatttttaaacttacctaccaaaacaaagtcgtgcgtgtacagcgacctgccaagtcgggtacagttatggatgtgatctcacgcagagaccagcgggggagcggacaggtcggcacttatggcctgaacaccttcacaaatatggaagtgcaactcataaggcagatggagtccgaagggatttttagtccatctgagctggagaacagcaatttggcagaacgcgtgttagactggctggagaaacatggagtcgaaagactcaagcggatggctatctccggtgatgactgtgttgtgaaacccactgatgacaggttcgccaccgctcttacggccctgaacgatatgggcaaggtacgaaaggacatcccgcagtgggagccttcaaaagggtggaatgattggcagcaagtgcccttttgcagtcaccatttccaccagctaattatgaaggacggacgtgaaatagtcgtgccatgtagaaaccaggatgagctggttggccgcgcacgggtgtctcagggtgcggggtggagcctcagggagacagcctgcttgggaaaatcctacgctcaaatgtggcagctgatgtattttcacagacgcgaccttcggctggccgcaaatgctatctgttcagccgtccctgtgaactgggtacccaccagcaggactacatggtctattcatgcacaccatcagtggatgaccactgaagatatgctctccgtttggaatcgagtgtggatcgaggaaaacccatggatggaggacaagacccacgtcagtagctgggaagacgtgccctacttaggcaaaagagaggatcaatggtgcggctcgctgattgggttgacagcccgggcgacgtgggctaccaatatccaggttgccataaaccaggtgaggcgcctgatcggaaatgagaactatctcgactacatgacttccatgaagcgtttcaagaatgaatctgatcctgagggtgcactttggtga

SEQ ID NO: 14202 - RNA, 9879 nt, synthetic construct
  misc_feature 1..9879: note = derived and/or modified CDS sequence (opt3) from DENV-1__KM403597__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagaccgtagaagcgtggccctggcaccccatgtcggcttgggtctcgagactaggaccgaaacatggatgtcctctgagggggcctggcggcagatccagcgcgtggaaacttgggctctgagacaccctggattcaccgttattgcactgtttctcgcccatgctatcggcacatcgattacccagaagggcatcatattcatcttactgatgcttgtgacgccatcaatggccatgaggtgcgtcgggattggaaaccgggattttgtggagggtttgagcggcgcgacttgggtagacgttgtgctggagcacgggagttgtgtcacaaccatggcaaaaaataagcccactctagatatcgaactcctgaagacagaggtgaccaaccctgccgtgcttcgcaaactgtgcattgaagctaagatctccaatacgaccacagactctcgatgtccaactcaaggagaggccaccttggtcgaagagcaggatgcaaacttcgtttgcagaaggacatttgtggaccggggctggggtaatgggtgtggactcttcggcaaaggcagcctgttaacttgcgctaagtttaaatgcgtaaccaagctggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccacgtactggactagatttcaacgaaatggtcctgctcacaatgaaggagaaaagctggctggtgcataagcagtggtttcttgacctgccgttgccctggacgtctggcgcatccacctcacaagagacttggaatcgccaggatctcctggtaacattcaaaaccgctcacgccaagaaacaggaagttgtggtcttaggtagccaagagggggctatgcacacagccctgactggcgcaaccgaaatccagacgagtggaaccacaactatttttgccggccatctaaagtgcagactcaagatggacaaactgacccttaagggggtgtcttatgtcatgtgtacaggatccttcaaattggagaaggaagtggctgagactcagcacggtaccgttctggtgcaggtaaaatacgagggcacggatgcgccttgcaagataccaatcagcacacaagacgaaaagggggtcacccagaacggaaggctcattactgcaaatcccatcgtgacagataaagagaagcctgttaacatagaaaccgagccacccttcggcgagtcgtatattgtgatcggtgccggggaaaaagctctgaagctttcttggtttaaaaagggctcctcaatcggaaagatgttcgaggccactgcacggggcgcccgacgcatggctattctgggggacaccgcctgggattttggaagtatcggtggcgtcttcacaagcgtggggaaattggtacatcaggtgtttggaacggcatacggcgttctcttctccggtgtctcttggaccatgaagattgggataggcatcctgttaacttggctgggactaaatagcagatcaacaagtctctccatgacctgtattgcggtgggcatggtgacactgtaccttggggtcatggttcaggctgacagcggatgcgtgatcaactggaaaggcagggaattgaagtgtggttctgggatctttgtgactaacgaggtacacacctggacggaacaatataaattccaggccgattcaccgaagcggctgagtgcagccattggaaaggcttgggaggagggcgtctgcggtatacgcagcgccacaagactcgaaaatatcatgtggaaacagatttccaacgagctgaatcatatcttactggaaaacgacatgaagtttaccgtggttgtgggcgacgcaaatgggattcttactcagggaaaaaagatgatcaggcctcaacccatggagcacaaatactcttggaagtcgtggggcaaagctaagataatcggggccgatacccagaacacaactttcattatcgacggaccagatacccctgaatgtcccgacgatcagcgtgcgtggaatatttgggaggtcgaggactatggctttggtgtgttcacaacgaacatctggttgaagctccgggatagctacacccagatgtgcgaccaccgactgatgtccgccgctataaaagattcaaaggcagttcatgccgacatggggtattggattgaaagtgagaaaaatgaaacttggaagctagctagagcctcttttatcgaggtgaaaacatgtatttggccaaggagccacaccctgtggtccaacggagtactcgaatcagagatgatcatacccaagatctacggcggtcctattagccaacataattatcgcccaggctacttcactcagacagcagggccgtggcacctgggaaagcttgagttggatttcaacctgtgcgaaggcaccacggtcgtggtggacgagcactgcgggaatcggggaccctctttaagaactaccacagtcaccggcaaaatcattcatgaatggtgttgcaggtcctgtactctccctccactgcgctttcgaggtgaggatgggtgctggtacggaatggagatccggcccgttaaggaaaaagaggaaaaccttgtgcgtagtatggtaagcgcgggctctggtgaggtggactccttctcactgggcttgctctgtgtcagtataatgattgaagaggtgatgagaagcaggtggtcgcgcaagatgctgatgacagggaccctagccatctttttcctgctcatcatgggacagctgacatggaatgaccttattcggttgtgcatcatggttggcgctaacgtgtccgatagaatggggatgggaactacctatctggccttaatggcaacgtttaaaatgaggcctatgttcgctgtcggcctcctgtttcgacgccttacatctcgggaggtgctgctactcaccattggtctgagcttggttgcctcagtggaactgccaaacagtttagaggaactcggggacggactggcaatgggcataatgatgcttaagctgttgactgatttccaatcccaccagctctggaccacactgctatctctgacttttatcaagaccacgcttagcctcgactacgcctggaaaacaatggctatggtcctgtccattgtatcattgttccccctgtgtttaagcaccactagtcagaagacaacctggctcccggtgctgcttggctcttttgggtgcaaacctctgactatgttcttgatcacagagaataagatttggggaagaaaatcctggccactcaacgaaggtatcatggcggttggcatagtgagcatcctgctatcgtcactgcttaagaatgatgtccccctcgccgggcctctgattgcaggaggcatgttgatcgcttgttatgtgatttctggtagttccgccgacttaagcctggagagggccgctgaggtatcttgggaagaggaagcagagcatagcggggcctcccacaacatcctcgtggaagtccaggatgacggaaccatgaagataaaagatgaggagcgtgacgatacgctgactattcttctgaaggcgaccttgctagctgtttcaggcgtgtaccccatgagtatcccagccacactgtttgtgtggtatttctggcaaaaaaagaaacagcgcagcggcgtcctctgggacaccccttctcccccagaagtggagcgggcagttctggatgacgggatctacagaattcttcagaggggattactgggtcgatcccaggtaggcgtgggggtcttccaagacggagtgtttcatacaatgtggcacgttactcggggcgccgtgctcatgtatcagggtaagcgcttggaaccgtcatgggctagtgtcaaaaaggatctgataagctacgggggaggctggagattccagggctcctggaataccggggaggaggtgcaggtaatcgcagtcgaacctggaaagaaccccaaaaatgtgcaaacgacaccaggtacttttaagacccccgagggcgaagttggggccattgcgctcgacttcaaacctggaacatctggctcgccaatcgtgaacagggagggtaagattgtcgggctgtacggaaatggcgtggttaccactagcggcacctatgtgtcagctatcgcccaggcaaaagcctcccaggaagggccccttcctgagatagaggatgaagtctttaagaagcggaacctgacaatcatggacttgcacccgggaagtggtaaaacgcgaagatacctaccagctattgtgcgcgaggccatcaagaggaaactgcgtactctcattttagcacccacccgggtagtggcttctgaaatggccgaggcgctgaagggcatgcctatcagatatcaaacaaccgccgttaaaagcgaacatactgggaaggagatagtcgatcttatttgccacgcaacattcaccatgaggctgctctccccagtgcgcgtgcccaattacaacatgatcatcatggacgaggctcattttacggatcctgcctcaattgctgcacgaggatatatctctactagagtcggcatgggtgaagccgccgctatattcatgacagcgaccccgcccgggagcgtagaggcatttccacagagtaatgccgtgattcaggacgaagagcgggatatccctgaaaggtcctggaacagcggatacgactggattaccgatttccccggcaagactgtttggtttgtgccatctatcaaatcaggcaatgacatagctaactgtttgcgcaagaacgggaaacgtgtcattcagctgtccagaaagacattcgacaccgagtatcaaaaaacaaagaataacgattgggactacgtggttactacggatatcagtgagatgggagccaatttccgggcagacagggtgatcgatcctcgccgatgcctcaagcccgtcattctgaaagacggtccagaaagagtgatccttgccggcccgatgcctgtaaccgctgcgagcgccgcacagcggagggggcgcattggaagaaaccagaataaggagggcgatcagtacatatatatgggtcaacccctaaacaatgacgaagatcacgctcattggacagaggccaaaatgctgttggacaacatcaatactccagaggggattatccccgcattatttgaacctgagagggaaaagtcggccgctatcgatggcgagtaccggctgcgtggagaagcccgcaaaaccttcgtggagctcatgcgaagaggcgacctgccagtttggctttcttataaggtcgcgtccgaggggtttcagtacagcgataggcggtggtgcttcgacggagaacgcaacaatcaggtgctggaggaaaacatggacgtggagatttggacaaaggaaggtgagagaaaaaagctcaggccccggtggttggatgcacgaacctattcagaccctctggccctaagagagtttaaagaattcgctgccggccgcaggagtgtctctggggatctgatactcgagatcggaaagcttccgcagcacctgactttacgggctcaaaatgcattggacaacctggttatgctccacaattccgaacagggcggtaaagcctaccgtcatgctatggaggaactgccagatacgattgagacccttatgctgctcgccttgatcgcagtgctgacagggggcgtaactttatttttcctaagcggaaagggcctggggaaaacctcaattggactcctttgtgtgatggcgagtagcgtcctgttgtggatggcctccgtggagccccactggatcgctgcctctataatcctggaatttttcctcatggttctgcttattcctgagcccgacagacagaggacaccacaggataaccaactcgcatatgtggtcatcggtctgttgtttatgattctgaccgtagctgccaacgaaatgggcttactagagactacaaagaaggacctggggatcggacatgtggttgcagagaatcaccaccatgccacgatgctcgatatagaccttcaccctgctagcgcgtggaccctgtacgccgtggcaactacaattatcacccccatgatgcgccataccattgaaaacacaactgctaatatctccttgacggccatagccaaccaggcagctatcctgatgggcctcgataaaggttggccaatttcaaagatggacatcggggtccctctgcttgccttaggctgctactctcaggtgaatccgctgaccctcacagcggctgtcttgatgctggtggcccactatgcaattatcggacccggcctacaagccaaagctactcgggaggcacagaagcgaaccgccgcggggataatgaaaaacccaacagttgatggaattgtggctatcgacctggaccctgtagtgtacgatgccaagttcgaaaagcagctcggccagatcatgcttctgattttgtgtaccagtcaaatcctgctcatgagaactacgtgggcactgtgcgagtcgataacattagccaccggtccccttactaccctgtgggaagggagcccaggaaaattttggaatacaactattgctgtctccatggccaacatcttcaggggctcttatctcgcaggtgctggcctagccttctcactgatgaagagcttggggggaggccgccgggggaccggagcgcagggcgagacactgggtgagaaatggaagagacagctcaatcagctttccaaaagtgaatttaacacgtacaagcgttctgggattatggaggttgacaggagcgaagccaaggagggactgaaacggggcgaaaccactaagcatgcagtgtcacgcggtacagctaaattgcgatggttcgtcgagagaaatctggtgaagcctgagggcaaagtaatcgatctcgggtgtggaaggggcgggtggtcctattactgcgccggattaaagaaggtgaccgaagttaaaggctatactaagggtgggcccggacacgaggaaccgataccaatggcaacatacggctggaacatcgtgaaactgcacagtggccgggacgtctttttcacccctcccgagaagtgtgatacgcttctgtgcgacattggggaaagctctccaaatcccaccatcgaggagggacgcacactaagagtgctcaaaatggtcgaaccttggctgaggggtaaccaattttgtattaagatcttgaatccgtacatgccctccgtggttgagactctggaacagatgcagcgaaaacatggcgggatgctcgtacggaacccactttcacgtaatagcacccacgagatgtattgggtgtcgtgcggaacaggcaacattgtctctgctgtgaacatgactagtagaatgctgttaaatcgcttcaccatggcccataggaagcctacatacgagcgggatgttgacctgggtgccgggaccagacacgtggcggtcgaacccgagatcgctaacttggatataattggacagcgcatcgaaaatatcaagaacgagcacaaatccacttggcattatgacgaagataatccttacaagacgtgggcatatcacggcagctacgaggtgaaaccatcaggctccgcctctagcatggtaaacggggtggttaggctcctgacaaagccctgggacgtcattcctatggtgacccaaatagctatgactgacaccacaccatttggacagcagcgagtgttcaaagagaaggtcgatacgcggacccccagaccgaagaggggtactgcccaaatcatggaagttacagcaaaatggctatggggctttcttagtcgcaataagaaacctcgtatttgtacccgggaggaattcactagaaaggtgaggtccaacgccgctatcggggcggtatttgtggacgagaatcagtggaacagcgccaaagaagcagtcgaggatgagcgcttctgggacctggtgcatcgagaacgggagctccacaagcagggaaagtgcgctacatgcgtttataatatgatgggcaaaagagaaaagaaactgggtgagtttgggaaggccaaaggatctagggcaatttggtacatgtggttgggcgcccgcttcctggaattcgaggctctcggctttatgaacgaggatcattggttctcaagagaaaatagtctttccggggtggagggagaaggtctgcacaagttaggctacatcctgcgggacataagcaagatcccagggggaaacatgtatgccgatgacaccgcgggctgggatacaaggattactgaggacgatttgcagaatgaggcaaaaatcaccgacattatggaacccgagcacgccctcctggctacgtctatctttaagctaacctaccaaaacaaagtcgtgcgtgtacagcgacctgccaagtcgggtacagttatggatgtgatatcacgcagagaccagcgggggagcggacaggtcggcacttatggccttaacaccttcacaaatatggaagtgcaactgattaggcagatggagtccgaagggatctttagtccatctgagctcgagaacagcaatctggcagaacgcgtgttggactggttagagaaacatggagtcgaaagactgaagcggatggctatctccggtgatgactgtgttgtgaaacccactgatgacaggttcgccaccgctctcacggcccttaacgatatgggcaaggtacgaaaggacattccgcagtgggagccttcaaaagggtggaatgattggcagcaagtgcccttttgcagtcaccatttccaccagctgataatgaaggacggacgtgaaatcgtcgtgccatgtagaaaccaggatgagctagttggccgcgcacgggtgtctcagggtgcggggtggagcctgagggagacagcctgcctcggaaaatcctacgctcaaatgtggcagttgatgtattttcacagacgcgacctgcggcttgccgcaaatgctatttgttcagccgtccctgtgaactgggtacccaccagcaggactacatggtctatccatgcacaccatcagtggatgaccactgaagatatgctgtccgtttggaatcgagtgtggattgaggaaaacccatggatggaggacaagacccacgtcagtagctgggaagacgtgccctacctcggcaaaagagaggatcaatggtgcggctcgttaatcgggctgacagcccgggcgacgtgggctaccaatatacaggttgccatcaaccaggtgaggcgcttgattggaaatgagaactatctggactacatgacttccatgaagcgtttcaagaatgaatctgatcctgagggtgcactctggtga

SEQ ID NO: 14203 - RNA, 9879 nt, synthetic construct
  misc_feature 1..9879: note = derived and/or modified CDS sequence (opt3) from DENV-1__KM403610__SS-prME
  source 1..9879: mol_type = other RNA
tccgtgaccatgctgctcatgcttctgcccacagcattggctttccacttaactacgagaggaggggaacctcatatgatcgtctccaagcaggaaagaggaaaatctctgttgtttaagacctcagccggtgttaatatgtgcacactcattgccatggacctgggagaactttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagaacaagatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacaatccacaccggagatcagcatcaagttggtaatgagactacggaacacggcacaattgccaccatcactccccaggcgcctacctcagagatccagcttacagactacggggccctgaccttggactgtagtccaaggactggactagatttcaacgaaatggtgctgctcacaatgaaggagaaaagctggctggtccataagcagtggtttcttgacctgccgttgccctggacgtctggcgcatccacctcacaagagacttggaatcggcaggatctcctggtgacattcaaaaccgctcacgccaagaagcaggaagtagttgtgttaggtagccaagagggggctatgcacacagccctgactggcgcaaccgaaattcagacgagtggaaccacaactatatttgccggccatctaaaatgccgtctcaagatggacaaactgacccttaagggggtctcttatgtgatgtgtacaggatccttcaaattggagaaggaagtcgctgagactcagcacggtaccgtgctggttcaggtgaagtacgagggcacggatgcgccttgcaaaatcccaattagcacacaagacgaaaagggggtaacccagaacggacgcctcatcactgcaaatcccatagtcacagataaagagaagcctgtgaacattgaaaccgagccacccttcggcgagtcgtatatcgttatcggtgccggggaaaaagctctgaaactttcttggtttaagaaaggctcctcaattggaaagatgttcgaggccactgcaagaggcgccaggcggatggctatcctgggggacaccgcctgggattttggaagtattggtggcgtgttcacaagcgtcgggaaattggtgcatcaggtatttggaacggcatacggcgtactcttctccggtgtttcttggaccatgaagatagggatcggcattctgttaacttggctgggactaaatagccgatcaacaagtctctccatgacctgtatcgcggtcggcatggtgacactgtaccttggggtgatggtccaggctgacagcggatgcgttatcaactggaaaggccgcgaattgaagtgtggttctgggatttttgtgactaacgaggtgcacacctggacggaacaatataagttccaggccgattcaccgaaaagactgagtgcagccataggaaaggcttgggaggagggcgtatgcggtatcaggagcgccacacggctcgaaaatattatgtggaaacagatctcctctgagctgaaccatattttactggaaaatgacatgaagtttaccgtcgtggttggcgacgcaaacgggatccttactcagggcaagaagatgatacgccctcaacccatggagcacaaatactcgtggaaaagctggggcaaggctaagatcattggggccgatacccagaatacaactttcatcattgacggaccagatacccctgaatgtcccgacgatcagagagcgtggaacatctgggaggtggaggactatggctttggtgtcttcacaacgaatatatggttgaagctcagggattcctacacccagatgtgcgaccaccgtctgatgtcagccgctattaaagatagtaaggcagtgcatgccgacatggggtattggatcgaatctgagaaaaacgaaacttggaagctagctcgggccagctttattgaggttaagacatgtatctggccacgatcccacaccctgtggtcaaatggagtgctcgaaagcgagatgataatccccaaaatttacggcggtcctatctctcaacataactatagaccaggctacttcactcagacagcagggccgtggcacctgggaaaacttgagttggatttcaatctgtgcgaaggcaccacggtagtcgtggacgagcactgcgggaacaggggaccctccttacgcactaccacagtgaccggcaaaattatccatgaatggtgttgccggagttgtactctccctccactgagatttaggggtgaggatgggtgctggtacggaatggagatacgccccgtcaaggaaaaagaggaaaatcttgttcgaagcatggtgtctgcgggctccggtgaggtagactcattcagtctgggcttgctctgtgtgagcattatgatcgaagaggtcatgcggtcgcgttggtccaagaagatgctgatgacagggaccctagccgtgtttttcctgctcatcatgggacagctgacatggaacgaccttattagattgtgcatcatggttggcgctaatgtgtctgataggatggggatgggaactacctatctggccttaatggcaacgtttaaaatgcgccctatgttcgctgtcggcctcctgtttcggagacttacaagcagggaggtgctgctactcaccattggtctgtcattggttgccagtgtggaactgccaaactccttagaggaactcggggacggactggcaatgggcataatgatgcttaagctgttgactgatttccaatctcaccagctctggaccacactgctaagcctgacttttatcaaaaccacgctttccctcgactacgcctggaagacaatggctatggtcctgtcaattgtgagcttgttccccctgtgtttaagtaccacttctcagaaaacaacctggctcccggtgctgcttggctcctttgggtgcaagcctctgactatgttcttgatcacagagaacaagatttggggacgaaaaagctggccactcaatgaaggtatcatggcggttggcatagtgtcgatcctgctatcatctctgcttaagaacgatgtccccctcgccgggcctctgattgcaggaggcatgttgatcgcttgttatgtgattagtggttccagcgccgacttatctctggagcgcgccgctgaggtaagctgggaagaggaagcagagcattccggggcctcacacaatatcctcgtggaagtccaggatgacggaaccatgaaaataaaggatgaggagcgggacgatacgctgactattcttctgaaagcgaccttgctagctgttagtggcgtgtaccccatgagcatcccagccacactgtttgtgtggtatttctggcaaaagaaaaagcagagatctggcgtcctctgggacaccccttcacccccagaagtggagagggcagttctggatgacgggatctaccgtattcttcagcgcggattactgggtcggagccaggtaggcgtgggggtcttccaagacggagtgtttcatacaatgtggcacgttactagaggcgccgtgctcatgtatcagggtaagaggttggaaccgagttgggctagcgtcaaaaaggatctgatatcctacgggggaggctggcgattccagggctcttggaacaccggggaggaggtgcaggtaatcgcagtcgaacctggcaagaatcccaagaacgtgcaaacgacaccaggtacttttaaaacccccgagggcgaagttggggccattgcgctcgacttcaagcctggaacatcgggcagcccaatcgtgaatcgggagggtaagattgtcgggctgtacggaaacggcgtggttaccacttcaggcacctatgtgtccgctatcgcccaggcaaaagccagtcaggaagggccccttcctgagatagaggatgaagtctttaagaaacgcaatctgacaatcatggacttgcacccgggatctggtaagacgagaaggtacctaccagctattgtgcgggaggccatcaaacgaaagctgagaactctcattttagcacccacccgcgtagtggctagcgaaatggccgaggcgctgaagggcatgcctatcaggtatcaaacaaccgccgttaaatccgaacatactgggaaggagatagtcgatcttatgtgccacgcaacattcaccatgcgtctgctctcaccagtgcgggtgcccaactacaatatgattatcatggacgaggctcattttacggatcctgcctctatcgctgcaagaggatatattagcactagggtcggcatgggtgaagccgccgctatcttcatgacagcgaccccgcccgggagtgtagaggcatttccacagtccaacgccgtgatacaggacgaagaacgcgatattcctgaacgaagctggaactctggatacgactggatcaccgatttccccggcaaaactgtttggtttgtgccatcaattaagtccggcaacgacatcgctaattgtttgaggaaaaatgggaagcgggtcatacagctgagtaggaagacattcgacaccgagtatcagaaaacaaagaacaatgattgggactacgtggttactacggatattagcgagatgggagccaacttccgcgcagaccgtgtgatcgatcctagacggtgcctcaaacccgtcatcctgaaggacggtccagaaagggtgattcttgccggcccgatgcctgtaaccgctgcgtcggccgcacagcgccgagggagaatcggacggaatcagaacaaagagggcgatcagtacatttatatgggtcaacccctaaataacgacgaagatcacgctcattggacagaggccaagatgctgttggacaatataaacactccagaggggatcattcccgcattatttgaacctgagagggaaaagtctgccgctatcgatggcgagtaccgcctgagaggagaagccaggaaaaccttcgtggagctcatgcggcgtggcgacctgccagtttggctttcctataaggtcgcgagcgaggggtttcagtactcagatcgccgatggtgcttcgacggagaaagaaataaccaggtgctggaggaaaatatggacgtggagatctggacaaaagaaggtgagaggaagaaactccggccccgctggttggatgcaagaacctatagtgaccctctggccctaagggagtttaaggagttcgctgccggccggcgatctgtctccggggatctgattctcgagataggaaaacttccgcagcacctgactttaagagctcaaaacgcattggacaatctggttatgctccacaacagcgaacagggcggtaaggcctaccgccatgctatggaggaactgccagatacgatcgagacccttatgctgctcgccttgattgcagtgctgacagggggcgtaactttatttttcctatcaggaaagggcctggggaaaaccagtatcggactcctttgtgtgatggcgagctccgtcctgttgtggatggcctctgtggagccccactggattgctgccagcatcatactggaatttttcctcatggttctgcttatccctgagcccgacaggcagcggacaccacaggataatcaactcgcatatgtggtcattggtctgttgtttatgatcctgaccgtagctgccaacgaaatgggcttactagagactacaaagaaagacctggggattggacatgtggttgcagagaaccaccaccatgccacgatgctcgatatcgaccttcaccctgcttccgcgtggaccctgtacgccgtggcaactacaataattacccccatgatgcgtcataccatcgaaaatacaactgctaacatttcattgacggccatcgccaatcaggcagctatactgatgggcctcgataagggttggccaatctctaaaatggacattggggtccctctgcttgccttaggctgctacagtcaggtgaacccgctgaccctcacagcggctgtcttgatgctggtggcccactatgcaatcattggacccggcctacaagccaaggctactagagaggcacagaagaggaccgccgcggggatcatgaaaaatccaacagttgatggaatagtggctattgacctggaccctgtagtgtacgatgccaagttcgaaaaacagctcggccagatcatgcttctgatcttgtgtacctcgcaaattctgctcatgcgcactacgtgggcactgtgcgagagcatcacattagccaccggtccccttactaccctgtgggaagggtccccaggaaagttttggaacacaactatagctgtctctatggccaatattttccggggctcatatctcgcaggagctggcctagccttcagcctgatgaaatccctagggggtggccgaagagggaccggagcgcagggcgagacactgggtgagaagtggaagaggcagctcaaccagcttagtaaatctgaatttaatacgtacaagcgcagcgggatcatggaggttgaccggtcagaagccaaagagggactgaagagaggcgaaaccactaaacatgcagtgtcccgtggtacagctaagttgaggtggttcgtcgagcggaacctggtgaagcctgagggcaaagtaattgatctcgggtgtggacgcggcgggtggagttattactgcgccggattaaagaaagtgaccgaagttaagggctatactaaaggtgggcccggacacgaggaaccgatcccaatggcaacatacggctggaatatagtgaagctgcacagcggccgagacgtctttttcacccctcccgagaaatgtgatacgcttctgtgcgacatcggggaatcttccccaaaccccaccattgaggagggaagaacactaagggtgctcaagatggtcgaaccttggctgcggggtaatcaattttgtatcaagattttgaacccgtacatgccctcagtggttgagactctggaacagatgcagcgcaaacatggcgggatgctcgtaagaaatccacttagcaggaactcgacccacgagatgtattgggtgtcttgcggaacaggcaatatcgtcagtgctgtgaacatgacttcccgaatgctgttaaaccggttcaccatggcccatcgtaagcctacatacgagagagatgttgacctgggtgccgggacccgccacgtggcggtcgaacccgagattgctaatttggatatcataggacagaggattgaaaacatcaaaaatgagcacaagagcacttggcattatgacgaagataacccttacaaaacgtgggcatatcacggctcatacgaggtgaagccatccggctctgccagcagtatggtaaatggggtggttcggctcctgacaaagccctgggacgtcatccctatggtgacccaaattgctatgactgacaccacaccatttggacagcagagagtgttcaaagagaaggtcgatacgcgcacccccaggccgaaacgaggtactgcccaaataatggaagttacagcaaagtggctatggggctttctttcccggaacaaaaagcctagaatctgtaccagggaggagttcactcgcaaggtgcgtagcaatgccgctattggggcggtatttgtggacgagaaccagtggaactctgccaaagaagcagtcgaggatgagcggttctgggacctggtgcatagagaaagggagctccacaagcagggaaaatgcgctacatgcgtttataacatgatgggcaagcgcgagaaaaagctgggtgagtttgggaaggccaaaggatcacgagcaatctggtacatgtggttgggcgcccggttcctggagttcgaggctctcggctttatgaatgaggatcattggttcagtagagaaaactcccttagcggggtggagggagaaggtctgcacaagttaggctacattctgagggacatctctaaaataccagggggaaatatgtatgccgatgacaccgcgggctgggatacacgcatcactgaggacgatttgcagaacgaggcaaagattaccgacatcatggaacccgagcacgccctcctggctacgtcgatttttaaactaacctaccaaaataaggtcgtgagagtacagcggcctgccaaatcaggtacagttatggatgtgatcagcaggcgtgaccagcgagggtccggacaggtcggcacttatggccttaacaccttcacaaacatggaagtgcaactgatacgccagatggagagtgaagggatttttctcccatctgagctggagaatagcaacttggcagaaagagtgttagactggctggagaagcatggagtcgaacggctcaagaggatggctatctccggtgatgactgtgttgtgaaacccactgatgaccgcttcgccaccgctcttacggccctgaatgatatgggcaaggtaagaaaagacatcccgcagtgggagccttcaaaggggtggaacgattggcagcaagtgcccttttgcagtcaccatttccaccagctaattatgaaagacggacgggaaatagtcgtgccatgtaggaatcaggatgagctggttggccgagcacgtgtgtctcagggtgcggggtggagcctcagagagacagcctgcttgggaaagtcctacgctcaaatgtggcagctgatgtattttcaccgccgggaccttaggctggccgcaaacgctatctgttcagccgtccctgtgaattgggtacccaccagcagaactacatggtctattcatgcacaccatcagtggatgaccactgaagatatgctctccgtttggaaccgcgtgtggatcgaggaaaatccatggatggaggacaagacccacgtcagtagctgggaagacgtgccctacttaggcaaacgggaggatcaatggtgcggctcgctgattgggttgacagccagggcgacgtgggctaccaacatccaggttgccataaatcaggtgcgaagactgatcggaaacgagaattatctcgactacatgacttccatgaagcggttcaaaaacgaatctgatcctgagggtgcactttggtga

SEQ ID NO: 14204 - RNA, 9879 nt, synthetic construct
  misc_feature 1..9879: note = derived and/or modified CDS sequence (opt3) from DENV-1__KM403596__SS-prME
  source 1..9879: mol_type = other RNA
agcgtgaccatgctgctcatgcttctgcccacagcattggctttccacttaactacgagaggcggggaacctcatatgatcgtctccaagcaagaaagaggaaaatctctgttgtttaagacctcagccggtgttaacatgtgcacactcattgcaatggacctgggcgagctttgtgaagatactatgacctacaaatgcccacggattacagaggcggaaccggacgatgtggactgttggtgcaatgctaccgatacttgggtaacatatgggacctgtagtcaaacgggagagcaccgccgagaccgtagaagcgtggccctggcaccccatgtcggcttgggtctcgagactaggaccgaaacatggatgtcctctgagggggcctggcggcagatccagcgcgtggaaacttgggctctgagacaccctggattcaccgttattgcactgtttctcgcccatgctatcggcacatcgattacccagaagggcatcatattcatcttactgatgcttgtgacgccatcaatggccatgaggtgcgtcgggattggaaaccgggattttgtggagggtttgagcggcgcgacttgggtagacgttgtgctggagcacgggagttgtgtcacaaccatggccaagaataagcccactctagatatcgaactcctgaagacagaggtgaccaaccctgccgtgcttcgcaaactgtgcattgaagctaagatctccaatacgaccacagactctcgatgtccaactcaaggagaggccaccttggtcgaagaacaagatgcaaacttcgtttgcagaaggacatttgtggaccggggctggggtaatgggtgtggactcttcggcaaaggcagcctgttaacttgcgctaagtttaaatgcgtaaccaagctggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgagtttggactgtagcccacgtaccggactagatttcaacgaaatggtcctgctcactatgaaggagaaatcttggctggtgcataagcagtggtttcttgacctgccgttgccctggacatccggcgcatcaacgagccaagagacctggaatcgccaggatctcctggtaactttcaaaacagctcacgccaagaaacaggaagttgtggtcttaggtagtcaagagggggctatgcacaccgccctgacaggcgcaactgaaatccagacctctggaacgaccacaatttttgccggccatctaaagtgcagactcaagatggacaaactgactcttaagggggtgtcctatgtcatgtgtaccggtagcttcaaattggagaaggaagtggctgagacacagcacggtactgttctggtgcaggtaaaatacgagggcaccgatgcgccttgcaagataccaatctcgacgcaagacgaaaagggggtcacacagaacggaaggctcattaccgcaaatcccatcgtgactgataaagagaagcctgttaacatagaaattgagccacccttcggcgagtcttatatcgtgatcggtgccggggaaaaagctctgaaactttcctggtttaaaaagggctcaagtattggaaagatgttcgaggccacagcacggggcgcccgacgcatggctatcctgggggacaccgcctgggattttggaagcattggtggcgtcttcacttccgtggggaaattggtacatcaggtgtttggaaccgcatacggcgttctcttctctggtgtcagctggacaatgaagatagggatcggcattctgttaacgtggctgggactaaattcaagaagtacctccctcagcatgacttgtatcgcggtgggcatggtgacactgtaccttggggtcatggttcaggctgactctggatgcgtgatcaactggaaaggcagggaattgaagtgtggttcagggatttttgtgaccaacgaggtacacacatggactgaacaatataaattccaggccgatagtccgaagcggctgagcgcagccataggaaaggcttgggaggagggcgtctgcggtatccgctccgccaccagactcgaaaatattatgtggaaacagatctctaacgagctgaatcatattttactggaaaacgacatgaagtttacggtggttgtgggcgacgcaaatgggatccttacacagggcaagaagatgataaggcctcaacccatggagcacaaatactcgtggaaaagctggggcaaggctaagatcattggggccgatacccagaacactaccttcatcattgacggaccagatacacctgaatgtcccgacgatcagcgtgcgtggaatatctgggaggtcgaggactatggctttggtgtgttcactaccaacatatggttgaagctccgggattcctacacacagatgtgcgaccaccgactgatgtcagccgctattaaagatagtaaggcagttcatgccgacatggggtattggatcgaatctgagaaaaatgaaacgtggaagctagctagagccagctttattgaggtgaaaacctgtatctggccaaggtcccacactctgtggtcaaacggagtactcgaaagcgagatgataatccccaagatttacggcggtcctatctctcaacataattatcgcccaggctacttcacacagaccgcagggccgtggcacctgggaaaacttgagttggatttcaacctgtgcgaaggcactacagtcgtggtggacgagcactgcgggaatcggggaccctccttaagaaccacgactgtcaccggcaaaattatccatgaatggtgttgcaggagttgtacactccctccactgcgctttcgaggtgaggatgggtgctggtacggaatggagatacggcccgttaaggaaaaagaggaaaaccttgtgcgtagcatggtatctgcgggctccggtgaggtggactcattcagtctgggcttgctctgtgtcagcattatgatcgaagaggtgatgagatcgaggtggtcccgcaagatgctgatgaccgggactctagccatctttttcctgctcattatgggacagctgacatggaatgaccttatccggttgtgcattatggttggcgctaacgtgtctgatagaatggggatgggaaccacatatctggccttaatggcaacttttaaaatgaggcctatgttcgctgtcggcctcctgtttcgacgccttaccagccgggaggtgctgctactcacgataggtctgtcattggttgccagtgtggaactgccaaactccttagaggaactcggggacggactggcaatgggcatcatgatgcttaagctgttgacagatttccaatctcaccagctctggaccactctgctaagcctgacctttattaagacaactctttccctcgactacgcctggaaaaccatggctatggtcctgtcaatcgtatccttgttccccctgtgtttaagtacgacatctcagaagaccacttggctcccggtgctgcttggctcctttgggtgcaaacctctgacaatgttcttgattaccgagaataagatctggggaagaaaaagctggccactcaacgaaggtataatggcggttggcatcgtgtcgattctgctatcatctctgcttaagaatgatgtccccctcgccgggcctctgatcgcaggaggcatgttgattgcttgttatgtgatcagtggttccagcgccgacttatctctggagagggccgctgaggtaagctgggaagaggaagcagagcattccggggcctcacacaacatactcgtggaagtccaggatgacggaactatgaagattaaagatgaggagcgtgacgatacactgaccatccttctgaaggcgacgttgctagctgttagtggcgtgtaccccatgagcatcccagccactctgtttgtgtggtatttctggcagaagaagaaacagcgctctggcgtcctctgggacaccccttcacccccagaagtggagcgggcagttctggatgacgggatttacagaatacttcagaggggattactgggtcgaagccaggtaggcgtgggggtcttccaagacggagtgtttcatacaatgtggcacgttacccggggcgccgtgctcatgtatcagggtaagcgcttggaaccgagttgggctagcgtcaaaaaggatctgatctcctacgggggaggctggagattccagggctcttggaatacaggggaggaggtgcaggtaattgcagtcgaacctggaaagaaccccaaaaatgtgcaaactaccccaggtacgtttaagacacccgagggcgaagttggggccatcgcgctcgacttcaaacctggaacttcgggcagcccaattgtgaacagggagggtaagatcgtcgggctgtacggaaatggcgtggttaccacatcaggcacctatgtgtccgctatagcccaggcaaaagccagtcaggaagggccccttcctgagatcgaggatgaagtctttaagaagcggaacctgactattatggacttgcacccgggatctggtaaaacccgaagatacctaccagctatcgtgcgcgaggccattaagaggaaactgcgtacactcatcttagcacccacgcgggtagtggctagcgaaatggccgaggcgctgaagggcatgcctataagatatcaaactaccgccgttaaatccgaacatacagggaaggagattgtcgatcttatgtgccacgcaaccttcactatgaggctgctctcaccagtgcgcgtgcccaattacaacatgatcatcatggacgaggctcattttacagatcctgcctctattgctgcacgaggatatatcagcaccagagtcggcatgggtgaagccgccgctatattcatgacggcgactccgcccgggagtgtagaggcatttccacagtccaatgccgtgattcaggacgaagaacgggatatccctgaaaggagctggaactctggatacgactggattacagatttccccggcaagaccgtttggtttgtgccatcaatcaaatccggcaatgacatagctaactgtttgcgcaagaacgggaaacgtgtcattcagctgagtagaaagaccttcgacactgagtatcagaaaacaaagaataacgattgggactacgtggttaccacagatatcagcgagatgggagccaatttccgggcagacagggtgatcgatcctcgccgatgcctcaagcccgtcattctgaaagacggtccagaaagagtgatccttgccggcccgatgcctgtaactgctgcgtcggccgcacagcggagggggcgcattggaagaaaccagaataaggagggcgatcagtacatatatatgggtcaacccctaaacaatgacgaagatcacgctcattggacggaggccaaaatgctgttggacaacatcaataccccagaggggattatccccgcattatttgaacctgagagggaaaagtctgccgctatcgatggcgagtaccggctgcgtggagaagcccgcaaaacattcgtggagctcatgcgaagaggcgacctgccagtttggctttcctataaggtcgcgagcgaggggtttcagtactcagataggcggtggtgcttcgacggagaacgcaacaatcaggtgctggaggaaaacatggacgtggagatttggactaaggaaggtgagaggaaaaagctcaggccccggtggttggatgcacgaacctatagtgaccctctggccctaagagagtttaaagagttcgctgccggccgcaggtctgtctccggggatctgatactcgagatcggaaaacttccgcagcacctgacattacgggctcaaaatgcattggacaacctggttatgctccacaatagcgaacagggcggtaaagcctaccgtcatgctatggaggaactgccagataccattgagactcttatgctgctcgccttgatcgcagtgctgaccgggggagtaacgttatttttcctatcaggaaagggcctggggaaaacaagtattggactcctttgtgtgatggcgagctccgtcctgttgtggatggcctctgtggagccccactggatcgctgccagcataatcctggaatttttcctcatggttctgcttattcctgagcccgacagacagaggactccacaggataaccaactcgcatatgtggtcatcggtctgttgtttatgattctgaccgtagctgccaacgaaatgggcttactagagacaaccaagaaggacctggggatcggacatgtggttgcagagaatcaccaccatgccactatgctcgatatagaccttcaccctgcttccgcgtggacactgtacgccgtggcaacgaccattatcactcccatgatgcgccatacaattgaaaacaccaccgctaatatctcattgacagccatagccaaccaggcagctatcctgatgggcctcgataaaggttggccaatttctaagatggacatcggggtccctctgcttgccttaggctgctacagtcaggtgaatccgctgactctcacggcggctgtcttgatgctggtggcccactatgcaattatcggacccggcctacaagccaaagctacccgggaggcacagaagcgaacagccgcggggataatgaaaaacccaactgttgatggaattgtggctatcgacctggaccctgtagtgtacgatgccaagttcgaaaagcagctcggccagatcatgcttctgattttgtgtacctcgcaaatcctgctcatgagaacaacctgggcactgtgcgagagcataactttagccacgggtccccttacaaccctgtgggaagggtccccaggaaaattttggaatactaccattgctgtctctatggccaacatcttcaggggctcatatctcgcaggagctggcctagccttcagcctgatgaagtccctagggggaggccgccgggggacaggagcgcagggcgagactctgggtgagaaatggaagagacagctcaatcagcttagtaaatctgaatttaacacctacaagcgtagcgggattatggaggttgacaggtcagaagccaaggagggactgaaacggggcgaaacaacgaagcatgcagtgtcccgcggtaccgctaaattgcgatggttcgtcgagagaaatctggtgaagcctgagggcaaagtaatcgatctcgggtgtggaaggggcgggtggagttattactgcgccggattaaagaaggtgactgaagttaaaggctatacaaagggtgggcccggacacgaggaaccgataccaatggcaacctacggctggaacatcgtgaaactgcacagcggccgggacgtctttttcactcctcccgagaagtgtgatacacttctgtgcgacattggggaatcttccccaaatcccaccatcgaggagggacgcacgctaagagtgctcaaaatggtcgaaccttggctgaggggtaaccaattttgtattaagatcttgaatccgtacatgccctcagtggttgagaccctggaacagatgcagcgaaaacatggcgggatgctcgtacggaacccacttagccgtaattcgacacacgagatgtattgggtgtcttgcggaactggcaacattgtcagtgctgtgaacatgacctccagaatgctgttaaatcgcttcacaatggcccataggaagcctacttacgagcgggatgttgacctgggtgccgggaccagacacgtggcggtcgaacccgagacagctaacttggatatcataggacagcgcattgaaaatatcaagaacgagcacaaaagcacctggcattatgacgaagataatccttacaagacttgggcatatcacggctcatacgaggtgaaaccatccggctctgccagcagtatggtaaacggggtggttaggctcctgacgaagccctgggacgtcatccctatggtgacacaaattgctatgaccgacactaccccatttggacagcagcgagtgttcaaagagaaggtcgatacacggacgcccagaccgaagaggggtaccgcccaaataatggaagttactgcaaaatggctatggggctttctttcccgcaataagaaacctcgtatctgtacacgggaggagttcaccagaaaggtgaggagcaacgccgctattggggcggtatttgtggacgagaatcagtggaactctgccaaagaagcagtcgaggatgagcgcttctgggacctggtgcatcgagaacgggagctccacaagcagggaaagtgcgctacttgcgtttataatatgatgggcaaaagagaaaagaaactgggtgagtttgggaaggccaaaggatcaagggcaatctggtacatgtggttgggcgcccgcttcctggagttcgaggctctcggctttatgaacgaggatcattggttcagtagagaaaattcccttagcggggtggagggagaaggtctgcacaagttaggctacattctgcgggacatctctaagataccagggggaaacatgtatgccgatgacacagcgggctgggataccaggatcacagaggacgatttgcagaatgaggcaaaaattactgacatcatggaacccgagcacgccctcctggctacctcgatttttaagctaacgtaccaaaacaaagtcgtgcgtgtacagcgacctgccaagtcaggtaccgttatggatgtgatcagccgcagagaccagcgggggtccggacaggtcggcacatatggccttaacactttcaccaatatggaagtgcaactgataaggcagatggagagtgaagggatattttctccaagcgagctcgagaactccaatctggcagaacgcgtgttggactggttagagaaacatggagtcgaaagactgaagcggatggctatctcaggtgatgactgtgttgtgaaacccacagatgacaggttcgccactgctctcaccgcccttaacgatatgggcaaggtacgaaaggacatcccgcagtgggagcctagtaaagggtggaatgattggcagcaagtgcccttttgctctcaccatttccaccagctgattatgaaggacggacgtgaaatagtcgtgccatgtagaaaccaggatgagctagttggccgcgcacgggtgagccagggtgcggggtggtccctgagggagacggcctgcctcggaaaatcatacgctcaaatgtggcagttgatgtattttcacagacgcgacctgcggcttgccgcaaatgctatctgtagcgccgtccctgtgaactgggtacccacatctaggaccacttggtccattcatgcacaccatcagtggatgacaaccgaagatatgctgagtgtttggaatcgagtgtggatcgaggaaaacccatggatggaggacaagactcacgtcagctcgtgggaagacgtgccctacctcggcaaaagagaggatcaatggtgcggctccttaattgggctgaccgcccgggcgacatgggctacgaatatccaggttgccataaaccaggtgaggcgcttgatcggaaatgagaactatctggactacatgacctctatgaagcgtttcaagaatgaatcagatcctgagggtgcactctggtga

SEQ ID NO: 14205 - RNA, 9879 nt, synthetic construct
  misc_feature 1..9879: note = derived and/or modified CDS sequence (opt3) from DENV-1__KM403616__SS-prME
  source 1..9879: mol_type = other RNA
agcgtgaccatgctgctcatgcttctgcccaccgccttggctttccacttaactacgagaggaggggaacctcatatgatcgtctccaagcaagaaaggggaaaatctctgttatttaagacctcagctggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactttggatatcgaactcctgaagacagaggtgaccaaccctgccgtgcttaggaaactgtgcattgaagctaagatctccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcgtggttacagtgcacaccggagatcagcatcaagtcggtaatgagactacggaacacggcacaattgccaccatcactccccaggcgcctacctcagagattcagcttacagactacggggccctgaccttggactgtagtccaaggactggactagatttcaacgaaatggtgctgctcacaatgaaggagaaaagctggctggtacataagcagtggtttcttgacctgccgttgccctggacgtctggcgcatccacctcacaagagacttggaatcggcaggatctcctggttacattcaaaaccgctcacgccaagaagcaggaagtggtcgtgttaggtagccaagagggggctatgcacacagccctgactggcgcaaccgaaatccagacgagtggaaccacaactatctttgccggccatctaaaatgccgtctcaagatggacaaactgacccttaagggggtctcttatgtgatgtgtacaggatccttcaaattggagaaggaagttgctgagactcagcacggtaccgtgctggtacaggtcaagtacgagggcacggatgcgccttgcaaaattccaataagcacacaagacgaaaagggggtgacccagaacggacgcctcatcactgcaaatcccattgttacagataaagagaagcctgtgaacatcgaaaccgagccacccttcggcgagtcgtatatagtcattggtgccggggaaaaagctctgaaactttcttggtttaagaaaggctcctcaatcggaaagatgttcgaggccactgcaagaggcgccaggcggatggctatcctgggggacaccgcctgggattttggaagtattggtggcgtgttcacaagcgtagggaaattggtgcatcaggtttttggaacggcatacggcgtcctcttctccggtgtgtcttggaccatgaagatcgggattggcatactgttaacttggctgggactaaatagccgatcaacaagtctctccatgacctgtatcgcggtgggcatggtcacactgtaccttggggttatggtgcaggctgacagcggatgcgtgattaactggaaaggccgcgaattgaagtgtggttctgggatctttgtaactaacgaggtccacacctggacggaacaatataagttccaggccgattcaccgaaaagactgagtgcagccatcggaaaggcttgggaggagggcgtgtgcggtattaggagcgccacacggctcgaaaatataatgtggaaacagatctccaacgagctgaatcatattttactggaaaacgacatgaagtttaccgttgtggtcggcgacgcaaatgggatccttactcagggcaagaaaatgattcgccctcaacccatggagcacaaatactcttggaagtcgtggggcaaggctaaaatcataggggccgatacccagaacacaactttcatcattgacggaccagatacccctgaatgtcccgacgatcagagagcgtggaatatctgggaggtggaggactatggctttggtgttttcacaacgaacatttggttgaagctcagggatagctacacccagatgtgcgaccaccgtctgatgtccgccgctatcaaagattcaaaggcagtgcatgccgacatggggtattggatagaaagtgagaaaaatgaaacttggaagctagctcgggcctcttttattgaggtaaagacatgtatctggccacgaagccacaccctgtggtccaacggagtcctcgaatcagagatgattatccccaaaatatacggcggtcctatcagccaacataattatagaccaggctacttcactcagacagcagggccgtggcacctgggaaaacttgagttggatttcaacctgtgcgaaggcaccacggtggtggtcgacgagcactgcgggaataggggaccctctttacgcactaccacagttaccggcaaaattatccatgaatggtgttgccggtcctgtactctccctccactgagatttaggggtgaggatgggtgctggtacggaatggagattcgccccgtgaaggaaaaagaggaaaaccttgtacgaagtatggtgagcgcgggctctggtgaggtcgactccttctcactgggcttgctctgtgtgagtatcatgatagaagaggttatgcggagccgttggtcgagaaagatgctgatgacagggaccctagccgcatttttcctgctcattatgggacagctgacatggaatgaccttatcaggttgtgcatcatggtgggcgccaacgtctccgatcgcatggggatgggaactacctatctggcattaatggctacgtttaagatgcggcctatgttcgccgtgggcctcctgtttagaaggcttacatctcgagaggttctgctactcaccattggtctgagcttggtggcatcagtcgaactgccaaacagtttagaggaactcggggacggactggccatgggcatcatgatgcttaaactgttgactgatttccaatcccaccagctctggaccacactgctatctctgacttttattaagaccacgcttagcctcgactacgcttggaaaacaatggcgatggtactgtccatagtgtcattgttccccctgtgtttaagcaccacaagtcagaagacaacctggctcccggttctgcttggctcttttgggtgcaaacctctgactatgttcttgatcacagagaataagatttggggacgcaagtcctggccactcaacgaaggtatcatggccgtgggcattgtcagcatcctgctatcgtcactgcttaaaaatgatgtgcccctcgcagggcctctgatagctggaggcatgttgatcgcctgttatgtaatttctggtagttccgccgacttaagcctggagcgggctgcagaggtgtcttgggaagaggaagccgagcatagcggggcgtcccacaacatcctcgtcgaagttcaggatgacggaaccatgaagattaaagatgaggagagagacgatacgctgactatccttctgaaggctaccttgctagccgtgtcaggcgtgtaccccatgagtataccagcaacactgtttgtctggtatttctggcagaagaagaaacagaggagcggcgtgctctgggacaccccttctcccccagaagttgagcgtgccgtactggatgacgggatttaccgcatccttcagcggggattactgggtagatcccaggtgggcgtcggggtgttccaagacggagtttttcatacaatgtggcacgtgactaggggcgctgtcctcatgtatcagggtaagcgattggaaccgtcatgggcaagtgtgaagaaagatctgatcagctacgggggaggctggcggttccagggctcctggaataccggggaggaggtacaggtcattgccgtggaacctggaaagaaccccaaaaatgttcaaacgacaccaggtacttttaagacccccgagggcgaagtgggggcgatagctctcgacttcaaacctggaacatctggctcgccaatcgtcaaccgcgagggtaagattgtggggctgtacggaaatggcgttgtgaccactagcggcacctatgtctcagccatcgcacaggccaaggcttcccaggaagggccccttcctgagattgaggatgaagtgtttaaaaagagaaacctgacaatcatggacttgcacccgggaagtggtaaaacgaggcggtacctaccagccatagtacgagaggcaatcaagagaaaactgcgcactctcattttagctcccaccagggtggttgcctctgaaatggcggaggccctgaagggcatgcctatccgttatcaaacaaccgcagtcaagagcgaacatactgggaaagagattgtggatcttatgtgccacgctacattcaccatgcggctgctctccccagtgagagtccccaattacaacatgatcataatggacgaggcccattttacggatcctgcttcaattgcagccaggggatatatctctactcgcgtaggcatgggtgaagccgctgcgatcttcatgacagcaaccccgcccgggagcgtggaggcctttccacagagtaatgctgttattcaggacgaagaacgagatatccctgaaagatcctggaacagcggatacgactggataaccgatttccccggcaagactgtgtggtttgtcccatctattaaatcaggcaatgacatcgccaactgtttgcggaagaacgggaaaagggtgattcagctgtcccgcaagacattcgacaccgagtatcaaaagactaagaataacgattgggactacgttgtgactacggatatcagtgagatgggagcaaatttccgtgccgacagagtcatagatcctcggaggtgcctcaagcccgtgattctgaaagacggtccagaacgcgtaatccttgctggcccgatgcctgtgaccgcggccagcgcagctcagcgaagagggcggatcggaaggaaccagaataaggagggcgatcagtacatttatatgggtcaacccctaaacaatgacgaagatcacgcccattggacagaggcaaaaatgctgttggacaacatcaatactccagaggggattatacccgccttatttgaacctgagcgcgaaaagtcggctgccatcgatggcgagtacagactgaggggagaagcgcggaagaccttcgttgagctcatgcgtcgcggcgacctgccagtctggctttcttataaagtggcatccgaggggtttcagtacagcgatcgaagatggtgcttcgacggagaaaggaacaatcaggtgctggaggaaaacatggacgtcgagatttggacaaaggaaggtgagcggaaaaagctccgccccagatggttggatgccaggacctattcagaccctctggctctacgggagtttaaagagttcgccgctggccgaagaagtgtttctggggatctgatcctcgagatcggaaaacttccgcagcacctgactttacgcgcacaaaatgccttggacaacctggtgatgctccacaattccgaacagggcggtaaggcttacaggcatgccatggaggaactgccagatacgattgagacccttatgctgctcgcattgatagcggtactgacagggggcgtgactttatttttcctaagcggaaagggcctggggaagacctcaatcggactcctttgtgtcatggccagtagcgtgctgttgtggatggcttccgttgagccccactggattgccgcatctatcattctggaatttttcctcatggtgctgcttatccctgagcccgaccggcagcgtacaccacaggataaccaactcgcttatgtcgtaataggtctgttgtttatgatcctgaccgtggccgcaaacgaaatgggcttactagagactactaagaaggacctggggattggacatgttgtggccgagaatcaccaccatgctacgatgctcgatatcgaccttcaccctgcgagcgcctggaccctgtacgcagtcgctactacaattatcacccccatgatgagacataccatagaaaacacaactgccaatatttccttgacggccatcgcaaaccaggctgccattctgatgggcctcgataaaggttggccaatctcaaagatggacataggggtgcctctgcttgcgttaggctgctactctcaggtcaatccgctgaccctcacagctgccgtgttgatgctggttgcacactatgccatcattggacccggcctacaagctaaagcaactagggaggcccagaagcgcaccgcggctgggatcatgaagaacccaacagtggatggaattgtagccatcgacctggaccctgtggtctacgatgcaaaattcgaaaagcagctcggccagataatgcttctgattttgtgtaccagtcaaatcctgctcatgcggactacgtgggccctgtgcgagtcgatcacattagctaccggtccccttactaccctgtgggaagggagcccaggaaaattttggaatacaactattgccgtttccatggcaaacatcttccgaggctcttatctcgctggtgccggcctagcgttctcactgatgaaaagcctagggggaggcagaagggggaccggagcccagggcgagacactgggtgagaaatggaagcgccagctcaatcagctttccaagagtgaatttaacacgtacaaacggtctgggataatggaggtggacagaagcgaagcaaaggagggactgaaacgtggcgaaaccactaagcatgctgtctcaaggggtacagccaaattgcggtggttcgtggagcgcaatctggtaaagcctgagggcaaggtgattgatctcgggtgtggacgaggcgggtggtcctattactgcgcaggactgaaaaaggttaccgaagtgaaaggctatactaagggtgggcccggacacgaggaaccgatcccaatggctacatacggctggaacattgtcaaactacacagtggcagagacgtgtttttcacccctcccgagaagtgtgatacgcttctgtgcgacatcggggaaagctctccaaatcccaccatagaggagggaaggacactacgggtcctcaaaatggtggaaccttggctgcgcggtaaccaattttgtatcaagattttgaatccgtacatgccctccgttgtagagactctggaacagatgcagagaaagcatggcgggatgctcgtgaggaacccactttcacgaaatagcacccacgagatgtattgggtctcgtgcggaacaggcaacatcgtgtctgccgttaacatgacaagtcggatgctgttaaatcgtttcaccatggcccatagaaaacctacatacgagcgcgatgtggacctgggtgcggggaccaggcacgtcgctgtggaacccgagattgcaaacttggatatcattggacagcggatcgaaaatataaagaacgagcacaaatccacttggcattatgacgaagataatccttacaagacgtgggcctatcacggcagctacgaggtaaaaccatcaggctccgcttctagcatggtgaacggggttgtcagactcctgacaaagccctgggacgtgattcctatggtgacccaaatcgccatgactgacaccacaccatttggacagcagcgcgtcttcaaggagaaagttgatacgaggacaccccgaccgaagcggggtactgcacaaatcatggaagtgacagccaaatggctatggggctttcttagtagaaataagaaacctaggatttgtacccgcgaggagttcactcgtaaggtacggtccaacgctgcgataggggccgtgtttgtcgacgagaatcagtggaacagcgcaaaggaagctgtggaggatgagagattctgggacctggttcatagggaacgcgagctccacaaacagggaaagtgcgccacatgcgtgtataatatgatgggcaaacgagaaaagaaactgggtgagtttgggaaggcaaagggatctcgggccatctggtacatgtggttgggcgctagattcctggagttcgaggccctcggctttatgaacgaggatcattggttctcaagggaaaatagtctttccggggtcgagggagaaggtctgcacaaattaggctacattctgcgcgacatcagcaagattccagggggaaacatgtatgcggatgacaccgcaggctgggatacaagaatcactgaggacgatttgcagaatgaggccaaaataaccgacatcatggaacccgagcacgctctcctggccacgtctatttttaagctaacctaccaaaacaaagtggtacgggttcagaggcctgcaaagtcgggtacagtgatggatgtcatctcacgtcgagaccagcgcgggagcggacaggtgggcacttatggccttaacaccttcacaaatatggaagtgcaactgattagacagatggagtccgaagggatctttagtccatctgagctcgagaacagcaatctggctgaacgggtcttggactggttagagaaacatggagttgaaaggctgaagcgcatggccatatccggtgatgactgtgtggtaaagcccactgatgacagattcgctaccgccctcacggcacttaacgatatgggcaaagtgcggaaggacattccgcagtgggagccttcaaaagggtggaatgattggcagcaagtccccttttgcagtcaccatttccaccagctgatcatgaaggacggaagggaaatcgtggttccatgtcgaaaccaggatgagctagtgggccgtgcgagagtctctcagggtgccgggtggagcctgcgcgagacagcttgcctcggaaaatcctacgcccaaatgtggcagttgatgtattttcaccggagggacctgagacttgcagctaatgccatttgttcagcagtgcctgtaaactgggttcccaccagccgcactacatggtctatacatgcccaccatcagtggatgaccactgaagatatgctgtccgtgtggaatcgggtctggatcgaggaaaacccatggatggaggacaagacccacgtgagtagctgggaagacgttccctacctcggcaagagggaggatcaatggtgcggctcgttaattgggctgacagcgcgagctacgtgggccaccaatatccaggtggcaattaaccaggtcagacggttgatcggaaatgagaactatctggactacatgacttccatgaaaaggttcaagaatgaatctgatcctgagggtgccctctggtga

SEQ ID NO: 14206 - RNA, 9879 nt, synthetic construct
  misc_feature 1..9879: note = derived and/or modified CDS sequence (opt3) from DENV-1__KM403617__SS-prME
  source 1..9879: mol_type = other RNA
agcgtgaccatgctgctcatgcttctgcccaccgcattggctttccacttaactacgagaggaggggaacctcatatgatcgtctccaagcaagaaaggggaaaatctctgttatttaagacctcagccggtgttaacatgtgcacactcattgcaatggacctgggcgagctttgtgaagatactatgacctacaaatgcccacggataacagaggcggaaccggacgatgtggactgttggtgcaatgctaccgatacttgggtgacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactttggatatcgaactcctgaagacagaggtgaccaaccctgccgtgcttaggaaactgtgcattgaagctaagatctccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcgtggttacagtgcacaccggagatcagcatcaagtcggtaatgagactacggaacacggcacaattgccaccatcactccccaggcgcctacctcagagattcagcttacagactacggggccctgaccttggactgtagtccaaggactggactagatttcaacgaaatggtgctgctcacaatgaaggagaaaagctggctggtacataagcagtggtttcttgacctgccgttgccctggacgtctggcgcatccacctcacaagagacttggaatcggcaggatctcctggttacattcaaaaccgctcacgccaagaagcaggaagtggtcgtgttaggtagccaagagggggctatgcacacagccctgactggcgcaaccgaaatccagacgagtggaaccacaactatctttgccggccatctaaaatgccgtctcaagatggacaaactgacccttaagggggtctcttatgtgatgtgtacaggatccttcaaattggagaaggaagttgctgagactcagcacggtaccgtgctggtacaggtcaagtacgagggcacggatgcgccttgcaaaattccaataagcacacaagacgaaaagggggtgacccagaacggacgcctcatcactgcaaatcccattgttacagataaagagaagcctgtgaacatcgaaaccgagccacccttcggcgagtcgtatatagtcattggtgccggggaaaaagctctgaaactttcttggtttaagaaaggctcctcaatcggaaagatgttcgaggccactgcaagaggcgccaggcggatggctatcctgggggacaccgcctgggattttggaagtattggtggcgtgttcacaagcgtagggaaattggtgcatcaggtttttggaacggcatacggcgtcctcttctccggtgtgtcttggaccatgaagatcgggattggcatactgttaacttggctgggactaaatagccgatcaacaagtctctccatgacctgtatcgcggtgggcatggtcacactgtaccttggggttatggtgcaggctgacagcggatgcgtgattaactggaaaggccgcgaattgaagtgtggttctgggatctttgtaactaacgaggtccacacctggacggaacaatataagttccaggccgattcaccgaaaagactgagtgcagccatcggaaaggcttgggaggagggcgtgtgcggtattaggagcgccacacggctcgaaaatataatgtggaaacagatctccaacgagctgaatcatattttactggaaaacgacatgaagtttaccgttgtggtcggcgacgcaaatgggatccttactcagggcaagaagatgattcgccctcaacccatggagcacaaatactcttggaagtcgtggggcaaggctaaaatcataggggccgatacccagaacacaactttcatcattgacggaccagatacccctgaatgtcccgacgatcagagagcgtggaatatctgggaggtggaggactatggctttggtgttttcacaacgaacatttggttgaagctcagggatagctacacccagatgtgcgaccaccgtctgatgtccgccgctatcaaagattcaaaggcagtgcatgccgacatggggtattggatagaaagtgagaaaaatgaaacttggaagctagctcgggcctcttttattgaggtaaagacatgtatctggccacgaagccacaccctgtggtccaacggagtcctcgaatcagagatgattatccccaaaatatacggcggtcctatcagccaacataattatagaccaggctacttcactcagacagcagggccgtggcacctgggaaaacttgagttggatttcaacctgtgcgaaggcaccacggtggtggtcgacgagcactgcgggaataggggaccctctttacgcactaccacagttaccggcaaaattatccatgaatggtgttgccggtcctgtactctccctccactgagatttaggggtgaggatgggtgctggtacggaatggagattcgccccgtgaaggaaaaagaggaaaaccttgtacgaagtatggtgagcgcgggctctggtgaggtcgactccttctcactgggcttgctctgtgtgagtatcatgatagaagaggttatgcggagccgttggtcgagaaagatgctgatgacagggaccctagccgtgtttttcctgctcattatgggacagctgacatggaatgaccttatcaggttgtgcatcatggtcggcgctaacgtgtccgatcgcatggggatgggaactacctatctggccttaatggcaacgtttaagatgcggcctatgttcgctgttggcctcctgtttagaaggcttacatctcgagaggtgctgctactcaccattggtctgagcttggtcgcctcagtagaactgccaaacagtttagaggaactcggggacggactggcaatgggcatcatgatgcttaaactgttgactgatttccaatcccaccagctctggaccacactgctatctctgacttttattaagaccacgcttagcctcgactacgcctggaaaacaatggctatggtgctgtccatagtttcattgttccccctgtgtttaagcaccacaagtcagaagacaacctggctcccggtgctgcttggctcttttgggtgcaaacctctgactatgttcttgatcacagagaataagatttggggacgcaagtcctggccactcaacgaaggtatcatggcggtcggcattgtgagcatcctgctatcgtcactgcttaaaaatgatgtacccctcgccgggcctctgatagcaggaggcatgttgatcgcttgttatgtgatttctggtagttccgccgacttaagcctggagcgggccgctgaggtctcttgggaagaggaagcagagcatagcggggcctcccacaacatcctcgttgaagtgcaggatgacggaaccatgaagattaaagatgaggagagagacgatacgctgactatccttctgaaggcgaccttgctagctgtgtcaggcgtctaccccatgagtataccagccacactgtttgtgtggtatttctggcagaagaagaaacagaggagcggcgttctctgggacaccccttctcccccagaagtagagcgtgcagtgctggatgacgggatttaccgcatccttcagcggggattactgggtagatcccaggtcggcgtgggggttttccaagacggagtgtttcatacaatgtggcacgtcactaggggcgccgtgctcatgtatcagggtaagcgattggaaccgtcatgggctagtgtaaagaaagatctgatcagctacgggggaggctggcggttccagggctcctggaataccggggaggaggtccaggtgattgcagttgaacctggaaagaaccccaaaaatgtgcaaacgacaccaggtacttttaagacccccgagggcgaagtcggggccatagcgctcgacttcaaacctggaacatctggctcgccaatcgtgaaccgcgagggtaagattgttgggctgtacggaaatggcgtggtcaccactagcggcacctatgtgtcagctatcgcccaggcaaaggcctcccaggaagggccccttcctgagattgaggatgaagtatttaaaaagagaaacctgacaatcatggacttgcacccgggaagtggtaaaacgaggcggtacctaccagctatagtgcgagaggccatcaagagaaaactgcgcactctcattttagcacccaccagggttgtcgcttctgaaatggccgaggcgctgaagggcatgcctatccgttatcaaacaaccgccgtaaagagcgaacatactgggaaagagattgtggatcttatgtgccacgcaacattcaccatgcggctgctctccccagtcagagtacccaattacaacatgatcataatggacgaggctcattttacggatcctgcctcaattgctgcaaggggatatatctctactcgcgtgggcatgggtgaagccgccgctatcttcatgacagcgaccccgcccgggagcgttgaggcatttccacagagtaatgccgtgattcaggacgaagaacgagatatccctgaaagatcctggaacagcggatacgactggataaccgatttccccggcaagactgtctggtttgtgccatctattaaatcaggcaatgacatcgctaactgtttgcggaagaacgggaaaagggttattcagctgtcccgcaagacattcgacaccgagtatcaaaagactaagaataacgattgggactacgtggtcactacggatatcagtgagatgggagccaatttccgtgcagacagagtgatagatcctcggaggtgcctcaagcccgtaattctgaaagacggtccagaacgcgtgatccttgccggcccgatgcctgttaccgctgcgagcgccgcacagcgaagagggcggatcggaaggaaccagaataaggagggcgatcagtacatttatatgggtcaacccctaaacaatgacgaagatcacgctcattggacagaggccaaaatgctgttggacaacatcaatactccagaggggattatacccgcattatttgaacctgagcgcgaaaagtcggccgctatcgatggcgagtacagactgaggggagaagcccggaagaccttcgtcgagctcatgcgtcgcggcgacctgccagtgtggctttcttataaagtggcgtccgaggggtttcagtacagcgatcgaagatggtgcttcgacggagaaaggaacaatcaggtcctggaggaaaacatggacgttgagatttggacaaaggaaggtgagcggaaaaagctccgccccagatggttggatgcaaggacctattcagaccctctggccctacgggagtttaaagagttcgctgccggccgaagaagtgtgtctggggatctgatcctcgagatcggaaaacttccgcagcacctgactttacgcgctcaaaatgcattggacaacctggtaatgctccacaattccgaacagggcggtaaagcctacaggcatgctatggaggaactgccagatacgattgagacccttatgctgctcgccttgatagcagtgctgacagggggcgtcactttatttttcctaagcggaaagggcctggggaagacctcaatcggactcctttgtgtgatggcgagtagcgttctgttgtggatggcctccgtggagccccactggattgctgcctctatcattctggaatttttcctcatggtcctgcttatccctgagcccgaccggcagcgtacaccacaggataaccaactcgcatatgtagtgataggtctgttgtttatgatcctgaccgttgctgccaacgaaatgggcttactagagactactaagaaggacctggggattggacatgtggtcgcagagaatcaccaccatgccacgatgctcgatatcgaccttcaccctgctagcgcgtggaccctgtacgccgtggcaactacaattatcacccccatgatgagacataccatagaaaacacaactgctaatatttccttgacggccatcgccaaccaggcagctattctgatgggcctcgataaaggttggccaatctcaaagatggacataggggtccctctgcttgccttaggctgctactctcaggtgaatccgctgaccctcacagcggctgttttgatgctggtggcccactatgcaatcattggacccggcctacaagccaaagctactagggaggcacagaagcgcaccgccgcggggatcatgaagaacccaacagtagatggaattgtggctatcgacctggaccctgtcgtttacgatgccaaattcgaaaagcagctcggccagataatgcttctgattttgtgtaccagtcaaatcctgctcatgcggactacgtgggcactgtgcgagtcgatcacattagccaccggtccccttactaccctgtgggaagggagcccaggaaaattttggaatacaactattgctgtgtccatggccaacatcttccgaggctcttatctcgccggtgctggcctagccttctcactgatgaaaagcctagggggaggcagaagggggaccggagcgcagggcgagacactgggtgagaaatggaagcgccagctcaatcagctttccaagagtgaatttaacacgtacaaacggtctgggataatggaggtcgacagaagcgaagccaaggagggactgaaacgtggcgaaaccactaagcatgcagtgtcaaggggtacagctaaattgcggtggttcgtagagcgcaatctggtgaagcctgagggcaaggttattgatctcgggtgtggacgaggcgggtggtcctattactgcgccggactgaaaaaggtgaccgaagtcaaaggctatactaagggtgggcccggacacgaggaaccgatcccaatggcaacatacggctggaacattgtgaaactacacagtggcagagacgtctttttcacccctcccgagaagtgtgatacgcttctgtgcgacatcggggaaagctctccaaatcccaccatagaggagggaaggacactacgggtgctcaaaatggttgaaccttggctgcgcggtaaccaattttgtatcaagattttgaatccgtacatgccctccgtagtggagactctggaacagatgcagagaaagcatggcgggatgctcgtcaggaacccactttcacgaaatagcacccacgagatgtattgggtgtcgtgcggaacaggcaacatcgtttctgctgtgaacatgacaagtcggatgctgttaaatcgtttcaccatggcccatagaaaacctacatacgagcgcgatgtcgacctgggtgccgggaccaggcacgtggcggtagaacccgagattgctaacttggatatcattggacagcggatcgaaaatataaagaacgagcacaaatccacttggcattatgacgaagataatccttacaagacgtgggcatatcacggcagctacgaggtgaaaccatcaggctccgcctctagcatggttaacggggtcgtgagactcctgacaaagccctgggacgtgattcctatggtcacccaaatcgctatgactgacaccacaccatttggacagcagcgcgttttcaaggagaaagtggatacgaggacaccccgaccgaagcggggtactgcccaaatcatggaagtaacagcaaaatggctatggggctttcttagtagaaataagaaacctaggatttgtacccgcgaggagttcactcgtaaggtgcggtccaacgccgctataggggcggtctttgtggacgagaatcagtggaacagcgccaaggaagcagttgaggatgagagattctgggacctggtgcatagggaacgcgagctccacaaacagggaaagtgcgctacatgcgtctataatatgatgggcaaacgagaaaagaaactgggtgagtttgggaaggccaagggatctcgggcaatctggtacatgtggttgggcgccagattcctggagttcgaggctctcggctttatgaacgaggatcattggttctcaagggaaaatagtctttccggggtggagggagaaggtctgcacaaattaggctacattctgcgcgacatcagcaagattccagggggaaacatgtatgccgatgacaccgcgggctgggatacaagaatcactgaggacgatttgcagaatgaggcaaaaataaccgacatcatggaacccgagcacgccctcctggctacgtctatttttaagctaacctaccaaaacaaagtagttcgggtgcagaggcctgccaagtcgggtacagtcatggatgtgatctcacgtcgagaccagcgcgggagcggacaggtgggcacttatggccttaacaccttcacaaatatggaagtccaactgattagacagatggagtccgaagggatctttagtccatctgagctcgagaacagcaatctggcagaacgggttttggactggttagagaaacatggagtggaaaggctgaagcgcatggctatatccggtgatgactgtgtagtgaagcccactgatgacagattcgccaccgctctcacggcccttaacgatatgggcaaagtccggaaggacattccgcagtgggagccttcaaaagggtggaatgattggcagcaagtgcccttttgcagtcaccatttccaccagctgatcatgaaggacggaagggaaatcgttgtgccatgtcgaaaccaggatgagctagtcggccgtgcaagagtgtctcagggtgcggggtggagcctgcgcgagacagcctgcctcggaaaatcctacgctcaaatgtggcagttgatgtattttcaccggagggacctgagacttgccgcaaatgctatttgttcagccgtacctgttaactgggtgcccaccagccgcactacatggtctatacatgcacaccatcagtggatgaccactgaagatatgctgtccgtctggaatcgggtgtggatcgaggaaaacccatggatggaggacaagacccacgttagtagctgggaagacgtgccctacctcggcaagagggaggatcaatggtgcggctcgttaattgggctgacagcccgagcgacgtgggctaccaatatccaggtcgccattaaccaggtgagacggttgatcggaaatgagaactatctggactacatgacttccatgaaaaggttcaagaatgaatctgatcctgagggtgcactctggtga

SEQ ID NO: 14207 - RNA, 9879 nt, synthetic construct
  misc_feature 1..9879: note = derived and/or modified CDS sequence (opt3) from DENV-1__KM403635__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccgcttcacaagagacctggaatcggcaggatctcctggtaactttcaaaacagcccacgctaagaagcaggaagttgtggtcttaggtagccaagagggggccatgcacaccgcactgacaggcgccactgaaatccagaccagtggaacgaccacaatttttgctggccatctaaaatgccgtctcaagatggacaaactgactcttaagggggtgtcttatgtcatgtgtaccggatccttcaaattggagaaggaagtggcggagacacagcacggtactgttctggtgcaggtaaagtacgagggcaccgatgcaccttgcaaaataccaatcagcacgcaagacgaaaagggggtcacacagaacggacgcctcattaccgccaatcccatcgtgactgataaagagaagcctgttaacatagaaacagagccacccttcggcgagtcgtatattgtgatcggtgctggggaaaaagccctgaagctttcttggtttaagaaaggctcctcaatcggaaagatgttcgaggcaaccgccagaggcgctaggcggatggccattctgggggacactgcatgggattttggaagtatcggtggcgtcttcaccagcgtggggaaattggtacatcaggtgtttggaacagcgtacggcgttctcttctccggtgtctcttggacgatgaagattgggataggcatcctgttaacctggctgggactaaatagccgatcaactagtctctccatgacatgtattgctgtgggcatggtgaccctgtaccttggggtcatggttcaggccgacagcggatgcgtgatcaactggaaaggccgcgaattgaagtgtggttctgggatctttgtgacaaacgaggtacacacttggaccgaacaatataagttccaggcagattcaccgaaaagactgagtgccgctattggaaaggcctgggaggagggcgtctgcggtataaggagcgcaacgcggctcgaaaatatcatgtggaaacagatttccaacgagctgaatcatatcttactggaaaacgacatgaagtttacagtggttgtgggcgacgctaatgggattcttacccagggaaaaaagatgatccgccctcaacccatggagcacaaatactcttggaagtcgtggggcaaggccaaaataatcggggcggatactcagaacaccacattcattatcgacggaccagatactcctgaatgtcccgacgatcagagagcctggaatatttgggaggtcgaggactatggctttggtgtgttcaccacaaacatctggttgaagctcagggatagctacacgcagatgtgcgaccaccgtctgatgtccgctgcaataaaagattcaaaggccgttcatgctgacatggggtattggattgaaagtgagaaaaatgaaacctggaagctagcccgggcatcttttatcgaggtgaagacttgtatttggccacgaagccacacactgtggtccaacggagtactcgaatcagagatgatcatacccaaaatctacggcggtcctattagccaacataattatagaccaggctacttcacccagactgcggggccgtggcacctgggaaagcttgagttggatttcaacctgtgcgaaggcacaaccgtcgtggtggacgagcactgcgggaataggggaccctctttacgcacgactaccgtcacaggcaaaatcattcatgaatggtgttgccggtcctgtaccctccctccactgagatttaggggtgaggatgggtgctggtacggaatggagatccgccccgttaaggaaaaagaggaaaaccttgtgcgaagtatggtaagcgccggctctggtgaggtggactccttctcactgggcttgctctgtgtcagtataatgattgaagaggtgatgcggagccgttggtcgagaaagatgctgatgactgggacactagctgtttttttcctgctcatcatgggacagctgacctggaatgaccttatcaggttgtgcattatggtgggcgccaacgtctccgatcgcatggggatgggaacaacttatctggcattaatggctacctttaagatgcggcctatgttcgccgtgggcctcctgtttagaaggcttacgtctcgagaggttctgctactcacaatcggtctgagcttggtggcatcagtcgaactgccaaacagtttagaggaactcggggacggactggccatgggcattatgatgcttaaactgttgaccgatttccaatcccaccagctctggactaccctgctatctctgacatttataaagactacccttagcctcgactacgcttggaaaacgatggcgatggtactgtccatcgtgtcattgttccccctgtgtttaagcacaaccagtcagaagactacatggctcccggttctgcttggctcttttgggtgcaaacctctgaccatgttcttgattactgagaataagatctggggacgcaagtcctggccactcaacgaaggtattatggccgtgggcatcgtcagcatactgctatcgtcactgcttaaaaatgatgtgcccctcgcagggcctctgatcgctggaggcatgttgattgcctgttatgtaatctctggtagttccgccgacttaagcctggagcgggctgcagaggtgtcttgggaagaggaagccgagcatagcggggcgtcccacaacattctcgtcgaagttcaggatgacggaacaatgaagatcaaagatgaggagagagacgataccctgacgatacttctgaaggctactttgctagccgtgtcaggcgtgtaccccatgagtattccagcaaccctgtttgtctggtatttctggcaaaaaaagaaacagaggagcggcgtgctctgggacacaccttctcccccagaagttgagcgtgccgtactggatgacgggatctaccgcatccttcagcggggattactgggtagatcccaggtgggcgtcggggtgttccaagacggagtttttcataccatgtggcacgtgacaaggggcgctgtcctcatgtatcagggtaagcgattggaaccgtcatgggcaagtgtgaagaaagatctgattagctacgggggaggctggcggttccagggctcctggaatactggggaggaggtacaggtcatagccgtggaacctggaaagaaccccaaaaatgttcaaaccacgccaggtacatttaagactcccgagggcgaagtgggggcgatcgctctcgacttcaaacctggaacctctggctcgccaattgtcaaccgcgagggtaagatcgtggggctgtacggaaatggcgttgtgacaaccagcggcacttatgtctcagccattgcacaggccaaggcttcccaggaagggccccttcctgagatcgaggatgaagtgtttaaaaagagaaacctgaccataatggacttgcacccgggaagtggtaaaacaaggcggtacctaccagccatcgtacgagaggcaattaagagaaaactgcgcacgctcatcttagctcccactagggtggttgcctctgaaatggcggaggccctgaagggcatgcctattcgttatcaaaccacagcagtcaagagcgaacataccgggaaagagatcgtggatcttatgtgccacgctactttcacaatgcggctgctctccccagtgagagtccccaattacaacatgataattatggacgaggcccattttaccgatcctgcttcaatcgcagccaggggatatatctctacgcgcgtaggcatgggtgaagccgctgcgattttcatgactgcaacaccgcccgggagcgtggaggcctttccacagagtaatgctgttatccaggacgaagagcgagatatacctgaaagatcctggaacagcggatacgactggattaccgatttccccggcaagaccgtgtggtttgtcccatctatcaaatcaggcaatgacattgccaactgtttgcggaagaacgggaaaagggtgatccagctgtcccgcaagactttcgacacagagtatcaaaagaccaaaaataacgattgggactacgttgtgacaactgatataagtgagatgggagcaaatttccgtgccgacagagtcattgatcctcggaggtgcctcaagcccgtgatcctgaaagacggtccagaacgcgtaatccttgctggcccgatgcctgtgacggcggccagcgcagctcagcgaagagggcggattggaaggaaccagaataaggagggcgatcagtacatctatatgggtcaacccctaaacaatgacgaagatcacgcccattggaccgaggcaaaaatgctgttggacaacattaatacaccagaggggataatccccgccttatttgaacctgagcgcgaaaagtcggctgccattgatggcgagtacagactgaggggagaagcgcggaagactttcgttgagctcatgcgtcgcggcgacctgccagtctggctttcttataaagtggcatccgaggggtttcagtacagcgatcgaagatggtgcttcgacggagaaaggaacaatcaggtgctggaggaaaacatggacgtcgagatctggaccaaggaaggtgagcggaaaaagctccgccccagatggttggatgccaggacatattcagaccctctggctctacgggagtttaaagaattcgccgctggccgaagaagtgtttctggggatctgatcctcgagattggaaagcttccgcagcacctgaccttacgcgcacaaaatgccttggacaacctggtgatgctccacaattccgaacagggcggtaaagcttacaggcatgccatggaggaactgccagatactatagagacgcttatgctgctcgcattgatcgcggtactgaccgggggcgtgacattatttttcctaagcggaaagggcctggggaagacttcaattggactcctttgtgtcatggccagtagcgtgctgttgtggatggcttccgttgagccccactggatcgccgcatctattatcctggaatttttcctcatggtgctgcttatacctgagcccgaccggcagcgtaccccacaggataaccaactcgcttatgtcgtaatcggtctgttgtttatgattctgacagtggccgcaaacgaaatgggcttactagagaccactaaaaaggacctggggatcggacatgttgtggccgagaatcaccaccatgctacaatgctcgatattgaccttcaccctgcgagcgcctggacgctgtacgcagtcgctaccactatcataacacccatgatgagacataccattgaaaacaccacagccaatatctccttgactgccattgcaaaccaggctgccatcctgatgggcctcgataaaggttggccaatatcaaagatggacatcggggtgcctctgcttgcgttaggctgctactctcaggtcaatccgctgacgctcaccgctgccgtgttgatgctggttgcacactatgccattatcggacccggcctacaagctaaagcaacaagggaggcccagaagcgcactgcggctgggattatgaagaacccaaccgtggatggaatcgtagccatagacctggaccctgtggtctacgatgcaaaattcgaaaagcagctcggccagattatgcttctgatcttgtgtacaagtcaaatcctgctcatgcggaccacttgggccctgtgcgagtcgattacgttagctacaggtccccttaccactctgtgggaagggagcccaggaaaattttggaataccacaatcgccgtttccatggcaaacatattccgaggctcttatctcgctggtgccggcctagcgttctcactgatgaagagcttggggggaggcagaagggggactggagcccagggcgagaccctgggtgagaaatggaagcgccagctcaatcagctttccaagagtgaatttaacacatacaaacggtctgggattatggaggtggacagaagcgaagcaaaggagggactgaaacgtggcgaaacgaccaagcatgctgtctcaaggggtactgccaaattgcggtggttcgtggagcgcaatctggtaaagcctgagggcaaggtgatcgatctcgggtgtggacgaggcgggtggtcctattactgcgcaggattaaaaaaggttacagaagtgaaaggctataccaagggtgggcccggacacgaggaaccgattccaatggctacttacggctggaacatcgtcaaactgcacagtggcagagacgtgtttttcacacctcccgagaagtgtgatacccttctgtgcgacataggggaaagctctccaaatcccacgatcgaggagggaaggaccctacgggtcctcaaaatggtggaaccttggctgcgcggtaaccaattttgtattaagatcttgaatccgtacatgccctccgttgtagagacactggaacagatgcagagaaagcatggcgggatgctcgtgaggaacccactttcacgaaatagcactcacgagatgtattgggtctcgtgcggaaccggcaacattgtgtctgccgttaacatgacaagtcggatgctgttaaatcgtttcactatggcccatagaaaacctacctacgagcgcgatgtggacctgggtgcggggacaaggcacgtcgctgtggaacccgagatcgcaaacttggatattatcggacagcggatagaaaatattaagaacgagcacaaatccacctggcattatgacgaagataatccttacaagacttgggcctatcacggcagctacgaggtaaaaccatcaggctccgcttctagcatggtgaacggggttgtcagactcctgacgaagccctgggacgtgatccctatggtgacacaaatcgccatgaccgacactaccccatttggacagcagcgcgtcttcaaggagaaagttgatacaaggacgccccgaccgaagcggggtaccgcacaaattatggaagtgactgccaaatggctatggggctttcttagtagaaataagaaacctaggatatgtacacgcgaggaattcacccgtaaggtacggtccaacgctgcgatcggggccgtgtttgtcgacgagaatcagtggaacagcgcaaaggaagctgtggaggatgagagattctgggacctggttcatagggaacgcgagctccacaaacagggaaagtgcgccacttgcgtgtataatatgatgggcaaacgagaaaagaaactgggtgagtttgggaaggcaaagggatctcgggccatttggtacatgtggttgggcgctagattcctggaattcgaggccctcggctttatgaacgaggatcattggttctcaagggaaaatagtctttccggggtcgagggagaaggtctgcacaaattaggctacatcctgcgcgacattagcaagatcccagggggaaacatgtatgcggatgacacagcaggctgggataccagaataacagaggacgatttgcagaatgaggccaaaatcactgacattatggaacccgagcacgctctcctggccacctctatctttaagctaacgtaccaaaacaaagtggtacgggttcagaggcctgcaaagtcgggtaccgtgatggatgtcatttcacgtcgagaccagcgcgggagcggacaggtgggcacatatggccttaacactttcaccaatatggaagtgcaactgatcagacagatggagtccgaagggatatttagtccatctgagctcgagaacagcaatctggctgaacgggtcttggactggttagagaaacatggagttgaaaggctgaagcgcatggccatttccggtgatgactgtgtggtaaagcccacagatgacagattcgctactgccctcaccgcacttaacgatatgggcaaagtgcggaaggacatcccgcagtgggagccttcaaaagggtggaatgattggcagcaagtccccttttgcagtcaccatttccaccagctgatcatgaaggacggaagggaaattgtggttccatgtcgaaaccaggatgagctagtgggccgtgcgagagtctctcagggtgccgggtggagcctgcgcgagacggcttgcctcggaaaatcctacgcccaaatgtggcagttgatgtattttcaccggagggacctgagacttgcagctaatgccatatgttcagcagtgcctgtaaactgggttcccacaagccgcaccacttggtctatccatgcccaccatcagtggatgacaaccgaagatatgctgtccgtgtggaatcgggtctggattgaggaaaacccatggatggaggacaagactcacgtgagtagctgggaagacgttccctacctcggcaagagggaggatcaatggtgcggctcgttaatcgggctgaccgcgcgagctacatgggccacgaatattcaggtggcaatcaaccaggtcagacggttggtgggaaatgagaactatctggactacatgacctccatgaaaaggttcaagaatgaatctgatcctgagggtgccctctggtga

SEQ ID NO: 14208 - RNA, 9879 nt, synthetic construct
  misc_feature 1..9879: note = derived and/or modified CDS sequence (opt3) from DENV-1__KM403621__SS-prME
  source 1..9879: mol_type = other RNA
agcgtgaccatgctgctcatgcttctgcccacagcattggctttccacttaactacgagaggaggggaacctcatatgatcgtctccaagcaagaaaggggaaaatctctgttatttaagacctcagccggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggttgacgttgtgctggagcacgggagttgtgtcacaaccatggcaaagaataaacccactttggatatcgaactcctgaagacagaggtgaccaaccctgccgtgcttaggaaactgtgcattgaagctaagatctccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaagggggtgtcttatgtcatgtgtacaggatccttcaaattggagaaggaagtggctgagactcagcacggtaccgttctggtgcaggtaaagtacgagggcacggatgcgccttgcaaaataccaatcagcacacaagacgaaaagggggtcacccagaacggacgcctcattactgcaaatcccatcgtgacagataaagagaagcctgttaacatagaaaccgagccacccttcggcgagtcgtatattgtgatcggtgccggggaaaaagctctgaaactttcttggtttaagaaaggctcctcaatcggaaagatgttcgaggccactgcaagaggcgccaggcggatggctattctgggggacaccgcctgggattttggaagtatcggtggcgtcttcacaagcgtggggaaattggtacatcaggtgtttggaacggcatacggcgttctcttctccggtgtctcttggaccatgaagattgggataggcatcctgttaacttggctgggactaaatagccgatcaacaagtctctccatgacctgtattgcggtgggcatggtgacactgtaccttggggtcatggttcaggctgacagcggatgcgtgatcaactggaaaggccgcgaattgaagtgtggttctgggatctttgtgactaacgaggtacacacctggacggaacaatataagttccaggccgattcaccgaaaagactgagtgcagccattggaaaggcttgggaggagggcgtctgcggtataaggagcgccacacggctcgaaaatatcatgtggaaacagatttccaacgagctgaatcatatcttactggaaaacgacatgaagtttaccgtggttgtgggcgacgcaaatgggattcttactcagggcaagaagatgatccgccctcaacccatggagcacaaatactcttggaagtcgtggggcaaggctaaaataatcggggccgatacccagaacacaactttcattatcgacggaccagatacccctgaatgtcccgacgatcagagagcgtggaatatttgggaggtcgaggactatggctttggtgtgttcacaacgaacatctggttgaagctcagggatagctacacccagatgtgcgaccaccgtctgatgtccgccgctataaaagattcaaaggcagttcatgccgacatggggtattggattgaaagtgagaaaaatgaaacttggaagctagctcgggcctcttttatcgaggtgaagacatgtatttggccacgaagccacaccctgtggtccaacggagtactcgaatcagagatgatcatacccaaaatctacggcggtcctattagccaacataattatagaccaggctacttcactcagacagcagggccgtggcacctgggaaaacttgagttggatttcaacctgtgcgaaggcaccacggtcgtggtggacgagcactgcgggaataggggaccctctttacgcactaccacagtcaccggcaaaatcattcatgaatggtgttgccggtcctgtactctccctccactgagatttaggggtgaggatgggtgctggtacggaatggagatccgccccgttaaggaaaaagaggaaaaccttgtgcgaagtatggtaagcgcgggctctggtgaggtggactccttctcactgggcttgctctgtgtcagtataatgattgaagaggtgatgcggagccgttggtcgagaaagatgctgatgacagggaccctagccgtatttttcctgctcatcatgggacagctgacatggaatgaccttatcaggttgtgcattatggtgggcgctaacgtctccgatcgcatggggatgggaactacctatctggccttaatggcaacgtttaagatgcggcctatgttcgctgtgggcctcctgtttagaaggcttacatctcgagaggttctgctactcaccatcggtctgagcttggtggcctcagtcgaactgccaaacagtttagaggaactcggggacggactggcaatgggcattatgatgcttaaactgttgactgatttccaatcccaccagctctggaccacactgctatctctgacttttataaagaccacgcttagcctcgactacgcctggaaaacaatggctatggtactgtccatcgtgtcattgttccccctgtgtttaagcaccacaagtcagaagacaacctggctcccggttctgcttggctcttttgggtgcaaacctctgactatgttcttgattacagagaataagatctggggacgcaagtcctggccactcaacgaaggtattatggcggtgggcatcgtcagcatactgctatcgtcactgcttaaaaatgatgtgcccctcgccgggcctctgatcgcaggaggcatgttgattgcttgttatgtaatctctggtagttccgccgacttaagcctggagcgggccgctgaggtgtcttgggaagaggaagcagagcatagcggggcctcccacaacattctcgtcgaagttcaggatgacggaaccatgaagatcaaagatgaggagagagacgatacgctgactatacttctgaaggcgaccttgctagctgtgtcaggcgtgtaccccatgagtattccagccacactgtttgtctggtatttctggcagaagaagaaacagaggagcggcgtgctctgggacaccccttctcccccagaagttgagcgtgcagtactggatgacgggatctaccgcatccttcagcggggattactgggtagatcccaggtgggcgtcggggtgttccaagacggagtttttcatacaatgtggcacgtgactaggggcgccgtcctcatgtatcagggtaagcgattggaaccgtcatgggctagtgtgaagaaagatctgattagctacgggggaggctggcggttccagggctcctggaataccggggaggaggtacaggtcatagcagtggaacctggaaagaaccccaaaaatgttcaaacgacaccaggtacttttaagacccccgagggcgaagtgggggccatcgcgctcgacttcaaacctggaacatctggctcgccaattgtcaaccgcgagggtaagatcgtggggctgtacggaaatggcgttgtgaccactagcggcacctatgtctcagctattgcccaggcaaaggcctcccaggaagggccccttcctgagatcgaggatgaagtgtttaaaaagagaaacctgacaataatggacttgcacccgggaagtggtaaaacgaggcggtacctaccagctatcgtacgagaggccattaagagaaaactgcgcactctcatcttagcacccaccagggtggttgcttctgaaatggccgaggcgctgaagggcatgcctattcgttatcaaacaaccgccgtcaagagcgaacatactgggaaagagatcgtggatcttatgtgccacgcaacattcaccatgcggctgctctccccagtgagagtccccaattacaacatgataattatggacgaggctcattttacggatcctgcctcaatcgctgcaaggggatatatctctactcgcgtaggcatgggtgaagccgccgctattttcatgacagcgaccccgcccgggagcgtggagagttttccacagtccaatgcagttatccaggacgaagaacgagatatacctgaaagaagctggaactctggatacgactggattaccgatttccccggcaagactgtgtggtttgtcccatcaatcaaatccggcaatgacattgccaactgtttgcggaagaacgggaaaagggtgatccagctgagtcgcaagacattcgacaccgagtatcaaaagactaagaataacgattgggactacgttgtgactacggatataagcgagatgggagctaatttccgtgccgacagagtcattgatcctcggaggtgcctcaagcccgtgatcctgaaagacggtccagaacgcgtaatccttgcaggcccgatgcctgtgaccgccgcttcggcggcccagcgaagagggcggattggaaggaaccagaataaggagggcgatcagtacatctatatgggtcaacccctaaacaatgacgaagatcacgcacattggacagaggctaaaatgctgttggacaacattaatactccagaggggataatccccgccttatttgaacctgagcgcgaaaagtctgcagccattgatggcgagtacagactgaggggagaagctcggaagaccttcgttgagctcatgcgtcgcggcgacctgccagtctggctttcctataaagtggccagcgaggggtttcagtactcagatcgaagatggtgcttcgacggagaaaggaacaatcaggtgctggaggaaaacatggacgtcgagatctggacaaaggaaggtgagcggaaaaagctccgccccagatggttggatgcgaggacctatagtgaccctctggcactacgggagtttaaagagttcgccgctggccgaagatctgtttccggggatctgatcctcgagattggaaaacttccgcagcacctgactttacgcgcccaaaatgctttggacaacctggtgatgctccacaatagcgaacagggcggtaaagcatacaggcatgccatggaggaactgccagatacgatagagacccttatgctgctcgctttgatcgccgtactgacagggggcgtgactttatttttcctatcaggaaagggcctggggaagaccagtattggactcctttgtgtcatggcaagctccgtgctgttgtggatggcgtctgttgagccccactggatcgccgctagcattatcctggaatttttcctcatggtgctgcttatacctgagcccgaccggcagcgtacaccacaggataaccaactcgcctatgtcgtaatcggtctgttgtttatgattctgaccgtggcagctaacgaaatgggcttactagagactaccaaaaaggacctggggatcggacatgttgtggccgagaatcaccaccatgcaacgatgctcgatattgaccttcaccctgcctccgcttggaccctgtacgcggtcgccactacaatcataacccccatgatgagacataccattgaaaacacaactgcaaatatctcattgacggctattgccaaccaggccgcaatcctgatgggcctcgataaaggttggccaatatctaagatggacatcggggtgcctctgcttgctttaggctgctacagtcaggtcaatccgctgaccctcacagccgcggtgttgatgctggttgctcactatgccattatcggacccggcctacaagcaaaagccactagggaggctcagaagcgcaccgcagccgggattatgaagaacccaacagtggatggaatcgtagcgatagacctggaccctgtggtctacgatgctaaattcgaaaagcagctcggccagattatgcttctgatcttgtgtacctcgcaaatcctgctcatgcggactacgtgggccctgtgcgagagcattacattagcaaccggtccccttactaccctgtgggaagggtccccaggaaaattttggaatacaactatcgccgtttctatggctaacatattccgaggctcatatctcgccggtgcaggcctagctttcagcctgatgaagtccctagggggaggcagaagggggaccggagcccagggcgagacactgggtgagaaatggaagcgccagctcaatcagcttagtaagtctgaatttaacacgtacaaacggagcgggattatggaggtggacagatcagaagcgaaggagggactgaaacgtggcgaaaccactaagcatgccgtctccaggggtacagcaaaattgcggtggttcgtggagcgcaatctggtaaagcctgagggcaaggtgatcgatctcgggtgtggacgaggcgggtggagttattactgcgctggactgaaaaaggttaccgaagtgaaaggctatactaagggtgggcccggacacgaggaaccgattccaatggccacatacggctggaacatcgtcaaactacacagcggcagagacgtgtttttcacccctcccgagaagtgtgatacgcttctgtgcgacataggggaatcttccccaaatcccaccatcgaggagggaaggacactacgggtcctcaaaatggtggaaccttggctgcgcggtaaccaattttgtattaagatcttgaatccgtacatgccctcagttgtagagactctggaacagatgcagagaaagcatggcgggatgctcgtgaggaacccacttagccgaaattcgacccacgagatgtattgggtctcttgcggaacaggcaacattgtgagtgcagttaacatgacttcccggatgctgttaaatcgtttcaccatggctcatagaaaacctacatacgagcgcgatgtggacctgggtgccgggaccaggcacgtcgccgtggaacccgagatcgcgaacttggatattatcggacagcggatagaaaatattaagaacgagcacaaaagcacttggcattatgacgaagataatccttacaagacgtgggcttatcacggctcatacgaggtaaaaccatccggctctgcaagcagtatggtgaacggggttgtcagactcctgacaaagccctgggacgtgatccctatggtgacccaaatcgccatgactgacaccacaccatttggacagcagcgcgtcttcaaggagaaagttgatacgaggacaccccgaccgaagcggggtactgctcaaattatggaagtgacagccaaatggctatggggctttctttccagaaataagaaacctaggatatgtacccgcgaggagttcactcgtaaggtacggagcaacgcagccatcggggctgtgtttgtcgacgagaatcagtggaactctgcgaaggaagccgtggaggatgagagattctgggacctggttcatagggaacgcgagctccacaaacagggaaagtgcgcaacatgcgtgtataatatgatgggcaaacgagaaaagaaactgggtgagtttgggaaggctaagggatcacgggccatttggtacatgtggttgggcgcaagattcctggagttcgaggccctcggctttatgaacgaggatcattggttcagtagggaaaattcccttagcggggtcgagggagaaggtctgcacaaattaggctacatcctgcgcgacatttctaagatcccagggggaaacatgtatgctgatgacaccgccggctgggatacaagaataactgaggacgatttgcagaatgaggcgaaaatcaccgacattatggaacccgagcacgcactcctggccacgtcgatctttaagctaacctaccaaaacaaagtggtacgggttcagaggcctgctaagtcaggtacagtgatggatgtcattagccgtcgagaccagcgcgggtccggacaggtgggcacttatggccttaacaccttcacaaatatggaagtgcaactgatcagacagatggagagtgaagggatattttctccaagcgagctcgagaactccaatctggccgaacgggtcttggactggttagagaaacatggagttgaaaggctgaagcgcatggcaatttcaggtgatgactgtgtggtaaagcccactgatgacagattcgctaccgccctcacggctcttaacgatatgggcaaagtgcggaaggacatcccgcagtgggagcctagtaaagggtggaatgattggcagcaagtccccttttgctctcaccatttccaccagctgatcatgaaggacggaagggaaattgtggttccatgtcgaaaccaggatgagctagtgggccgtgccagagtcagccagggtgcagggtggtccctgcgcgagacagcgtgcctcggaaaatcatacgcccaaatgtggcagttgatgtattttcaccggagggacctgagacttgctgccaatgcaatatgtagcgctgtgcctgtaaactgggttcccacctctcgcactacatggtccatccatgcccaccatcagtggatgaccactgaagatatgctgagtgtgtggaatcgggtctggattgaggaaaacccatggatggaggacaagacccacgtgagctcgtgggaagacgttccctacctcggcaagagggaggatcaatggtgcggctccttaatcgggctgacagcacgagccacgtgggcgaccaatattcaggtggctatcaaccaggtcagacggttgataggaaatgagaactatctggactacatgacttctatgaaaaggttcaagaatgaatcagatcctgagggtgccctctggtga

SEQ ID NO: 14209 - RNA, 9879 nt, synthetic construct
  misc_feature 1..9879: note = derived and/or modified CDS sequence (opt3) from DENV-1__KM403623__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagatttcgtggagggtcttagcggcgcgacttgggtagacgttgtgttggagcacgggagttgtgtcacaaccatggcaaagaataaacccactctggatatcgaactactcaagacagaggtgaccaaccctgccgtgctgaggaaactttgcattgaagctaagatctccaatacgaccacagactctcggtgtccaactcaaggagaggccaccctggtcgaagagcaggatgcaaactttgtttgccgccgaacattcgtggacagaggctggggtaatgggtgtggattgtttggcaaaggcagcctcctgacttgcgctaagttcaagtgcgtaaccaaattagaggggaagatagtgcagtacgaaaacctgaaatattccgtcattgtgacagttcacaccggagatcagcatcaagtgggtaatgagactacggaacacggcacaatcgccaccattactccccaggcgcctacctcagagatccagctcacagactacggggcccttaccctggactgtagtccaaggactggattggattttaacgaaatggtcctactgacaatgaaggagaaaagctggctcgtgcataagcagtggttcctggaccttccgctgccctggacgtctggcgcatccacctcacaagagacttggaatcggcaggatttgctcgtaacatttaaaaccgctcacgccaagaagcaggaagttgtggtcctgggtagccaagagggggctatgcacacagccttaactggcgcaaccgaaatccagacgagtggaaccacaactattttcgccggccatctgaaatgccgtctaaagatggacaaactcaccctgaagggggtgtcttatgtcatgtgtacaggatccttcaaacttgagaaggaagtggctgagactcagcacggtaccgttttggtgcaggtaaagtacgagggcacggatgcgccttgcaaaataccaatcagcacacaagacgaaaagggggtcacccagaacggacgcctgattactgcaaatcccatcgtgacagataaagagaagcctgttaacatagaaaccgagccaccctttggcgagtcgtatattgtgatcggtgccggggaaaaagctctcaagctgtcttggttcaagaaaggctcctcaatcggaaagatgtttgaggccactgcaagaggcgccaggcggatggctattcttggggacaccgcctgggatttcggaagtatcggtggcgtctttacaagcgtggggaaactggtacatcaggtgttcggaacggcatacggcgttttgttttccggtgtctcttggaccatgaagattgggataggcatcctcctgacttggttaggactgaatagccgatcaacaagtctatccatgacctgtattgcggtgggcatggtgacactctacctgggggtcatggttcaggctgacagcggatgcgtgatcaactggaaaggccgcgaacttaagtgtggttctgggatcttcgtgactaacgaggtacacacctggacggaacaatataagtttcaggccgattcaccgaaaagattgagtgcagccattggaaaggcttgggaggagggcgtctgcggtataaggagcgccacacggctggaaaatatcatgtggaaacagatttccaacgagctcaatcatatcctgttagaaaacgacatgaagttcaccgtggttgtgggcgacgcaaatgggattctgactcagggaaaaaagatgatccgccctcaacccatggagcacaaatactcttggaagtcgtggggcaaggctaaaataatcggggccgatacccagaacacaacttttattatcgacggaccagatacccctgaatgtcccgacgatcagagagcgtggaatatttgggaggtcgaggactatggcttcggtgtgtttacaacgaacatctggcttaagttgagggatagctacacccagatgtgcgaccaccgtctcatgtccgccgctataaaagattcaaaggcagttcatgccgacatggggtattggattgaaagtgagaaaaatgaaacttggaagctggctcgggcctctttcatcgaggtgaagacatgtatttggccacgaagccacaccctatggtccaacggagtactggaatcagagatgatcatacccaaaatctacggcggtcctattagccaacataattatagaccaggctacttcactcagacagcagggccgtggcacctcggaaagctggagcttgattttaacttgtgcgaaggcaccacggtcgtggtggacgagcactgcgggaataggggaccctctctgcgcactaccacagtcaccggcaaaatcattcatgaatggtgttgccggtcctgtactttacctccactcagattcaggggtgaggatgggtgctggtacggaatggagatccgccccgttaaggaaaaagaggaaaacctggtgcgaagtatggtaagcgcgggctctggtgaggtggactccttttcacttggcctgttgtgtgtcagtataatgattgaagaggtgatgcggagccgttggtcgagaaagatgctcatgacagggaccctggccgttttctttctactgatcatgggacagctcacatggaatgacctgatcaggctttgcattatggtgggcgctaacgtctccgatcgcatggggatgggaactacctatttggccctgatggcaacgttcaagatgcggcctatgtttgctgtgggcttactcttcagaaggctgacatctcgagaggttcttctgctaaccatcggtctcagcctggtggcctcagtcgaattgccaaacagtctggaggaattaggggacggactcgcaatgggcattatgatgctgaaacttctgactgattttcaatcccaccagttgtggaccacactcctgtctctaactttcataaagaccacgctgagccttgactacgcctggaaaacaatggctatggtactctccatcgtgtcactgtttcccttgtgtctgagcaccactagtcagaagacaacctggttaccggttctcctgggctctttcgggtgcaaacctcttactatgtttctgattacagagaataagatctggggacgcaagtcctggccattgaacgaaggtattatggcggtgggcatcgtcagcatactcctgtcgtcactactgaaaaatgatgtgccccttgccgggcctctcatcgcaggaggcatgctgattgcttgttatgtaatctctggtagttccgccgacttgagcttagagcgggccgctgaggtgtcttgggaagaggaagcagagcatagcggggcctcccacaacattctggtcgaagttcaggatgacggaaccatgaagatcaaagatgaggagagagacgatacgctcactatactgcttaaggcgaccctgttggctgtgtcaggcgtgtaccccatgagtattccagccacactattcgtctggtatttctggcaaaaaaagaaacagaggagcggcgtgctgtgggacaccccttctcccccagaagttgagcgtgcagtactcgatgacgggatctaccgcatcctgcagcggggacttttaggtagatcccaggtgggcgtcggggtgtttcaagacggagttttccatacaatgtggcacgtgactaggggcgccgtcctgatgtatcagggtaagcgactcgaaccgtcatgggctagtgtgaagaaagatttgattagctacgggggaggctggcggtttcagggctcctggaataccggggaggaggtacaggtcatagcagtggaacctggaaagaaccccaaaaatgttcaaacgacaccaggtactttcaagacccccgagggcgaagtgggggccatcgcgctggactttaaacctggaacatctggctcgccaattgtcaaccgcgagggtaagatcgtggggctctacggaaatggcgttgtgaccactagcggcacctatgtctcagctattgcccaggcaaaggcctcccaggaagggcccctgcctgagatcgaggatgaagtgttcaaaaagagaaaccttacaataatggacctgcacccgggaagtggtaaaacgaggcggtacttgccagctatcgtacgagaggccattaagagaaaactacgcactctgatcctcgcacccaccagggtggttgcttctgaaatggccgaggcgttaaagggcatgcctattcgttatcaaacaaccgccgtcaagagcgaacatactgggaaagagatcgtggatctgatgtgccacgcaacatttaccatgcggcttctgtccccagtgagagtccccaattacaacatgataattatggacgaggctcatttcacggatcctgcctcaatcgctgcaaggggatatatctctactcgcgtaggcatgggtgaagccgccgctatttttatgacagcgaccccgcccgggagcgtggagagtttcccacagtccaatgcagttatccaggacgaagagcgagatatacctgaaagaagctggaactctggatacgactggattaccgattttcccggcaagactgtgtggttcgtcccatcaatcaaatccggcaatgacattgccaactgtctccggaagaacgggaaaagggtgatccagttgagtcgcaagacattcgacaccgagtatcaaaagacaaaaaataacgattgggactacgttgtgactacggatataagcgagatgggagctaattttcgtgccgacagagtcattgatcctcggaggtgcctgaagcccgtgatcctcaaagacggtccagaacgcgtaatcctggcaggcccgatgcctgtgaccgccgcttcggcggcccagcgaagagggcggattggaaggaaccagaataaggagggcgatcagtacatctatatgggtcaaccccttaacaatgacgaagatcacgcacattggacagaggctaaaatgctactggacaacattaatactccagaggggataatccccgccttgttcgaacctgagcgcgaaaagtctgcagccattgatggcgagtacagattaaggggagaagctcggaagacctttgttgagctgatgcgtcgcggcgacctcccagtctggctgtcctataaagtggccagcgaggggttccagtactcagatcgaagatggtgctttgacggagaaaggaacaatcaggtgcttgaggaaaacatggacgtcgagatctggacaaaggaaggtgagcggaaaaagctgcgccccagatggctcgatgcgaggacctatagtgaccctttggcactgcgggagttcaaagaatttgccgctggccgaagatctgtttccggggatctaatcctggagattggaaagctcccgcagcaccttactctgcgcgcccaaaatgctttagacaacttggtgatgctgcacaatagcgaacagggcggtaaagcatacaggcatgccatggaggaactcccagatacgatagagaccctgatgcttctggctctcatcgccgtattgacagggggcgtgactctgttctttttatcaggaaagggcctagggaagaccagtattggactgctctgtgtcatggcaagctccgtgcttctgtggatggcgtctgttgagccccactggatcgccgctagcattatcttggaattctttctgatggtgctcctgatacctgagcccgaccggcagcgtacaccacaggataaccaacttgcctatgtcgtaatcggtctcctgttcatgattttgaccgtggcagctaacgaaatgggcctgttagagactacaaaaaaggacctagggatcggacatgttgtggccgagaatcaccaccatgcaacgatgctggatattgacctccaccctgcctccgcttggaccctttacgcggtcgccactacaatcataacccccatgatgagacataccattgaaaacacaactgcaaatatctcactgacggctattgccaaccaggccgcaatcttgatgggcctggataaaggttggccaatatctaagatggacatcggggtgcctctcctggctcttggctgctacagtcaggtcaatccgttaaccctgacagccgcggtgctcatgttggttgctcactatgccattatcggacccggcctgcaagcaaaagccactagggaggctcagaagcgcaccgcagccgggattatgaagaacccaacagtggatggaatcgtagcgatagacctagaccctgtggtctacgatgctaaatttgaaaagcagctgggccagattatgctccttatcctgtgtacctcgcaaatcttgctgatgcggactacgtgggccctctgcgagagcattacactggcaaccggtcccttaactaccctttgggaagggtccccaggaaaattctggaatacaactatcgccgtttctatggctaacatattccgaggctcatatctggccggtgcaggcctcgcttttagcctaatgaagtccctggggggaggcagaagggggaccggagcccagggcgagacattgggtgagaaatggaagcgccagctgaatcagctcagtaagtctgaattcaacacgtacaaacggagcgggattatggaggtggacagatcagaagcgaaggagggacttaaacgtggcgaaaccactaagcatgccgtctccaggggtacagcaaaactgcggtggtttgtggagcgcaatttggtaaagcctgagggcaaggtgatcgatctggggtgtggacgaggcgggtggagttattactgcgctggactcaaaaaggttaccgaagtgaaaggctatactaagggtgggcccggacacgaggaaccgattccaatggccacatacggctggaacatcgtcaaattacacagcggcagagacgtgttctttacccctcccgagaagtgtgatacgctgctttgcgacataggggaatcttccccaaatcccaccatcgaggagggaaggacactgcgggtcctaaaaatggtggaaccttggctccgcggtaaccaattctgtattaagatcctgaatccgtacatgccctcagttgtagagactttggaacagatgcagagaaagcatggcgggatgctggtgaggaacccactcagccgaaattcgacccacgagatgtattgggtctcttgcggaacaggcaacattgtgagtgcagttaacatgacttcccggatgcttctgaatcgttttaccatggctcatagaaaacctacatacgagcgcgatgtggacttaggtgccgggaccaggcacgtcgccgtggaacccgagatcgcgaacctggatattatcggacagcggatagaaaatattaagaacgagcacaaaagcacttggcattatgacgaagataatccttacaagacgtgggcttatcacggctcatacgaggtaaaaccatccggctctgcaagcagtatggtgaacggggttgtcagattgctcacaaagccctgggacgtgatccctatggtgacccaaatcgccatgactgacaccacaccattcggacagcagcgcgtctttaaggagaaagttgatacgaggaccccccgaccgaagcggggtactgctcaaattatggaagtgacagccaaatggctgtggggcttcctatccagaaataagaaacctaggatatgtacccgcgaggaatttactcgtaaggtacggagcaacgcagccatcggggctgtgttcgtcgacgagaatcagtggaactctgcgaaggaagccgtggaggatgagagattttgggaccttgttcatagggaacgcgagctgcacaaacagggaaagtgcgcaacatgcgtgtataatatgatgggcaaacgagaaaagaaactcggtgagttcgggaaggctaagggatcacgggccatttggtacatgtggctgggcgcaagattcttggaatttgaggccctgggcttcatgaacgaggatcattggtttagtagggaaaattccctcagcggggtcgagggagaaggtcttcacaaactgggctacatcttacgcgacatttctaagatcccagggggaaacatgtatgctgatgacaccgccggctgggatacaagaataactgaggacgatctgcagaatgaggcgaaaatcaccgacattatggaacccgagcacgcattgctcgccacgtcgatcttcaagctgacctaccaaaacaaagtggtacgggttcagaggcctgctaagtcaggtacagtgatggatgtcattagccgtcgagaccagcgcgggtccggacaggtgggcacttatggcctaaacacctttacaaatatggaagtgcaacttatcagacagatggagagtgaagggatattctctccaagcgagctggagaactccaatctcgccgaacgggtcctggactggttggagaaacatggagttgaaaggttaaagcgcatggcaatttcaggtgatgactgtgtggtaaagcccactgatgacagatttgctaccgccctgacggctctcaacgatatgggcaaagtgcggaaggacatcccgcagtgggagcctagtaaagggtggaatgattggcagcaagtccccttctgctctcaccattttcaccagcttatcatgaaggacggaagggaaattgtggttccatgtcgaaaccaggatgagctggtgggccgtgccagagtcagccagggtgcagggtggtccctacgcgagacagcgtgcctgggaaaatcatacgcccaaatgtggcagctcatgtatttccaccggagggacttgagactggctgccaatgcaatatgtagcgctgtgcctgtaaactgggttcccacctctcgcactacatggtccatccatgcccaccatcagtggatgaccactgaagatatgcttagtgtgtggaatcgggtctggattgaggaaaacccatggatggaggacaagacccacgtgagctcgtgggaagacgttccctacctgggcaagagggaggatcaatggtgcggctccctcatcgggttaacagcacgagccacgtgggcgaccaatattcaggtggctatcaaccaggtcagacggctgataggaaatgagaactatttggactacatgacttctatgaaaaggtttaagaatgaatcagatcctgagggtgccctgtggtga

SEQ ID NO: 14210 - RNA, 9879 nt, synthetic construct
  misc_feature 1..9879: note = derived and/or modified CDS sequence (opt3) from DENV-1__KM403575__SS-prME
  source 1..9879: mol_type = other RNA
agcgtgaccatgctgctcatgcttctgcccaccgcattggctttccacttaactacgagaggaggggaacctcatatgatcgtctccaagcaagaaaggggaaaatctctgttatttaagacctcagccggtgttaacatgtgcacactcattgcaatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggttgacgttgtgctggagcacgggagttgtgtcacaaccatggcaaagaataaacccactttggatatcgaactcctgaagacagaggtgaccaaccctgccgtgcttaggaaactgtgcattgaagctaagatctccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaagggggtgtcttatgtcatgtgtacaggatccttcaaattggagaaggaagtggctgagactcagcacggtaccgttctggtgcaggtaaagtacgagggcacggatgcgccttgcaaaataccaatcagcacacaagacgaaaagggggtcacccagaacggacgcctcattactgcaaatcccatcgtgacagataaagagaagcctgttaacatagaaaccgagccacccttcggcgagtcgtatattgtgatcggtgccggggaaaaagctctgaaactttcttggtttaagaaaggctcctcaatcggaaagatgttcgaggccactgcaagaggcgccaggcggatggctattctgggggacaccgcctgggattttggaagtatcggtggcgtcttcacaagcgtggggaaattggtacatcaggtgtttggaacggcatacggcgttctcttctccggtgtctcttggaccatgaagattgggataggcatcctgttaacttggctgggactaaatagccgatcaacaagtctctccatgacctgtattgcggtgggcatggtgacactgtaccttggggtcatggttcaggctgacagcggatgcgtgatcaactggaaaggccgcgaattgaagtgtggttctgggatctttgtgactaacgaggtacacacctggacggaacaatataagttccaggccgattcaccgaaaagactgagtgcagccattggaaaggcttgggaggagggcgtctgcggtataaggagcgccacacggctcgaaaatatcatgtggaaacagatttccaacgagctgaatcatatcttactggaaaacgacatgaagtttaccgtggttgtgggcgacgcaaatgggattcttactcagggcaagaagatgatccgccctcaacccatggagcacaaatactcttggaagtcgtggggcaaggctaaaataatcggggccgatacccagaacacaactttcattatcgacggaccagatacccctgaatgtcccgacgatcagagagcgtggaatatttgggaggtcgaggactatggctttggtgtgttcacaacgaacatctggttgaagctcagggatagctacacccagatgtgcgaccaccgtctgatgtccgccgctataaaagattcaaaggcagttcatgccgacatggggtattggattgaaagtgagaaaaatgaaacttggaagctagctcgggcctcttttatcgaggtgaagacatgtatttggccacgaagccacaccctgtggtccaacggagtactcgaatcagagatgatcatacccaaaatctacggcggtcctattagccaacataattatagaccaggctacttcactcagacagcagggccgtggcacctgggaaaacttgagttggatttcaacctgtgcgaaggcaccacggtcgtggtggacgagcactgcgggaataggggaccctctttacgcactaccacagtcaccggcaaaatcattcatgaatggtgttgccggtcctgtactctccctccactgagatttaggggtgaggatgggtgctggtacggaatggagatccgccccgttaaggaaaaagaggaaaaccttgtgcgaagtatggtaagcgcgggctctggtgaggtggactccttctcactgggcttgctctgtgtcagtataatgattgaagaggtgatgcggagccgttggtcgagaaagatgctgatgacagggaccctagccgtatttttcctgctcatcatgggacagctgacatggaatgaccttatcaggttgtgcattatggtgggcgctaacgtctccgatcgcatggggatgggaactacctatctggccttaatggcaacgtttaagatgcggcctatgttcgctgtgggcctcctgtttagaaggcttacatctcgagaggttctgctactcaccatcggtctgagcttggtggcctcagtcgaactgccaaacagtttagaggaactcggggacggactggcaatgggcattatgatgcttaaactgttgactgatttccaatcccaccagctctggaccacactgctatctctgacttttataaagaccacgcttagcctcgactacgcctggaaaacaatggctatggtactgtccatcgtgtcattgttccccctgtgtttaagcaccacaagtcagaagacaacctggctcccggttctgcttggctcttttgggtgcaaacctctgactatgttcttgattacagagaataagatctggggacgcaagtcctggccactcaacgaaggtattatggcggtgggcatcgtcagcatactgctatcgtcactgcttaaaaatgatgtgcccctcgccgggcctctgatcgcaggaggcatgttgattgcttgttatgtaatctctggtagttccgccgacttaagcctggagcgggccgctgaggtgtcttgggaagaggaagcagagcatagcggggcctcccacaacattctcgtcgaagttcaggatgacggaaccatgaagatcaaagatgaggagagagacgatacgctgactatacttctgaaggcgaccttgctagctgtgtcaggcgtgtaccccatgagtattccagccacactgtttgtctggtatttctggcagaagaagaaacagaggagcggcgtgctctgggacaccccttctcccccagaagttgagcgtgcagtactggatgacgggatctaccgcatccttcagcggggattactgggtagatcccaggtgggcgtcggggtgttccaagacggagtttttcatacaatgtggcacgtgactaggggcgccgtcctcatgtatcagggtaagcgattggaaccgtcatgggctagtgtgaagaaagatctgattagctacgggggaggctggcggttccagggctcctggaataccggggaggaggtacaggtcatagcagtggaacctggaaagaaccccaaaaatgttcaaacgacaccaggtacttttaagacccccgagggcgaagtgggggccatcgcgctcgacttcaaacctggaacatctggctcgccaattgtcaaccgcgagggtaagatcgtggggctgtacggaaatggcgttgtgaccactagcggcacctatgtctcagctattgcccaggcaaaggcctcccaggaagggccccttcctgagatcgaggatgaagtgtttaaaaagagaaacctgacaataatggacttgcacccgggaagtggtaaaacgaggcggtacctaccagctatcgtacgagaggccattaagagaaaactgcgcactctcatcttagcacccaccagggtggttgcttctgaaatggccgaggcgctgaagggcatgcctattcgttatcaaacaaccgccgtcaagagcgaacatactgggaaagagatcgtggatcttatgtgccacgcaacattcaccatgcggctgctctccccagtgagagtccccaattacaacatgataattatggacgaggctcattttacggatcctgcctcaatcgctgcaaggggatatatctctactcgcgtaggcatgggtgaagccgccgctattttcatgacagcgaccccgcccgggagcgtggaggcatttccacagagtaatgccgttatccaggacgaagaacgagatatacctgaaagatcctggaacagcggatacgactggattaccgatttccccggcaagactgtgtggtttgtcccatctatcaaatcaggcaatgacattgctaactgtttgcggaagaacgggaaaagggtgatccagctgtcccgcaagacattcgacaccgagtatcaaaagactaagaataacgattgggactacgttgtgactacggatataagtgagatgggagccaatttccgtgcagacagagtcattgatcctcggaggtgcctcaagcccgtgatcctgaaagacggtccagaacgcgtaatccttgccggcccgatgcctgtgaccgctgcgagcgccgcacagcgaagagggcggattggaaggaaccagaataaggagggcgatcagtacatctatatgggtcaacccctaaacaatgacgaagatcacgctcattggacagaggccaaaatgctgttggacaacattaatactccagaggggataatccccgcattatttgaacctgagcgcgaaaagtcggccgctattgatggcgagtacagactgaggggagaagcccggaagaccttcgttgagctcatgcgtcgcggcgacctgccagtctggctttcttataaagtggcgtccgaggggtttcagtacagcgatcgaagatggtgcttcgacggagaaaggaacaatcaggtgctggaggaaaacatggacgtcgagatctggacaaaggaaggtgagcggaaaaagctccgccccagatggttggatgcaaggacctattcagaccctctggccctacgggagtttaaagagttcgctgccggccgaagaagtgtttctggggatctgatcctcgagattggaaaacttccgcagcacctgactttacgcgctcaaaatgcattggacaacctggtgatgctccacaattccgaacagggcggtaaagcctacaggcatgctatggaggaactgccagatacgatagagacccttatgctgctcgccttgatcgcagtactgacagggggcgtgactttatttttcctaagcggaaagggcctggggaagacctcaattggactcctttgtgtcatggcgagtagcgtgctgttgtggatggcctccgttgagccccactggatcgctgcctctattatcctggaatttttcctcatggtgctgcttatacctgagcccgaccggcagcgtacaccacaggataaccaactcgcatatgtcgtaatcggtctgttgtttatgattctgaccgtggctgccaacgaaatgggcttactagagactactaagaaggacctggggatcggacatgttgtggcagagaatcaccaccatgccacgatgctcgatattgaccttcaccctgctagcgcgtggaccctgtacgccgtcgcaactacaatcataacccccatgatgagacataccattgaaaacacaactgctaatatctccttgacggccattgccaaccaggcagctatcctgatgggcctcgataaaggttggccaatatcaaagatggacatcggggtgcctctgcttgccttaggctgctactctcaggtcaatccgctgaccctcacagcggctgtgttgatgctggttgcccactatgcaattatcggacccggcctacaagccaaagctactagggaggcacagaagcgcaccgccgcggggattatgaagaacccaacagtggatggaatcgtagctatagacctggaccctgtggtctacgatgccaaattcgaaaagcagctcggccagattatgcttctgatcttgtgtaccagtcaaatcctgctcatgcggactacgtgggcactgtgcgagtcgattacattagccaccggtccccttactaccctgtgggaagggagcccaggaaaattttggaatacaactatcgctgtttccatggccaacatattccgaggctcttatctcgccggtgctggcctagccttctcactgatgaaaagcctagggggaggcagaagggggaccggagcgcagggcgagacactgggtgagaaatggaagcgccagctcaatcagctttccaagagtgaatttaacacgtacaaacggtctgggattatggaggtggacagaagcgaagccaaggagggactgaaacgtggcgaaaccactaagcatgcagtctcaaggggtacagctaaattgcggtggttcgtggagcgcaatctggtaaagcctgagggcaaggtgatcgatctcgggtgtggacgaggcgggtggtcctattactgcgccggactgaaaaaggttaccgaagtgaaaggctatactaagggtgggcccggacacgaggaaccgattccaatggcaacatacggctggaacatcgtcaaactacacagtggcagagacgtgtttttcacccctcccgagaagtgtgatacgcttctgtgcgacataggggaaagctctccaaatcccaccatcgaggagggaaggacactacgggtcctcaaaatggtggaaccttggctgcgcggtaaccaattttgtattaagatcttgaatccgtacatgccctccgttgtagagactctggaacagatgcagagaaagcatggcgggatgctcgtgaggaacccactttcacgaaatagcacccacgagatgtattgggtctcgtgcggaacaggcaacattgtgtctgctgttaacatgacaagtcggatgctgttaaatcgtttcaccatggcccatagaaaacctacatacgagcgcgatgtggacctgggtgccgggaccaggcacgtcgcggtggaacccgagatcgctaacttggatattatcggacagcggatagaaaatattaagaacgagcacaaatccacttggcattatgacgaagataatccttacaagacgtgggcatatcacggcagctacgaggtaaaaccatcaggctccgcctctagcatggtgaacggggttgtcagactcctgacaaagccctgggacgtgatccctatggtgacccaaatcgctatgactgacaccacaccatttggacagcagcgcgtcttcaaggagaaagttgatacgaggacaccccgaccgaagcggggtactgcccaaattatggaagtgacagcaaaatggctatggggctttcttagtagaaataagaaacctaggatatgtacccgcgaggagttcactcgtaaggtacggtccaacgccgctatcggggcggtgtttgtcgacgagaatcagtggaacagcgccaaggaagcagtggaggatgagagattctgggacctggttcatagggaacgcgagctccacaaacagggaaagtgcgctacatgcgtgtataatatgatgggcaaacgagaaaagaaactgggtgagtttgggaaggccaagggatctcgggcaatttggtacatgtggttgggcgccagattcctggagttcgaggctctcggctttatgaacgaggatcattggttctcaagggaaaatagtctttccggggtcgagggagaaggtctgcacaaattaggctacatcctgcgcgacattagcaagatcccagggggaaacatgtatgccgatgacaccgcgggctgggatacaagaataactgaggacgatttgcagaatgaggcaaaaatcaccgacattatggaacccgagcacgccctcctggctacgtctatctttaagctaacctaccaaaacaaagtggtacgggttcagaggcctgccaagtcgggtacagtgatggatgtcatttcacgtcgagaccagcgcgggagcggacaggtgggcacttatggccttaacaccttcacaaatatggaagtgcaactgatcagacagatggagtccgaagggatatttagtccatctgagctcgagaacagcaatctggcagaacgggtcttggactggttagagaaacatggagttgaaaggctgaagcgcatggctatttccggtgatgactgtgtggtaaagcccactgatgacagattcgccaccgctctcacggcccttaacgatatgggcaaagtgcggaaggacatcccgcagtgggagccttcaaaagggtggaatgattggcagcaagtccccttttgcagtcaccatttccaccagctgatcatgaaggacggaagggaaattgtggttccatgtcgaaaccaggatgagctagtgggccgtgcaagagtctctcagggtgcggggtggagcctgcgcgagacagcctgcctcggaaaatcctacgctcaaatgtggcagttgatgtattttcaccggagggacctgagacttgccgcaaatgctatatgttcagccgtgcctgtaaactgggttcccaccagccgcactacatggtctatccatgcacaccatcagtggatgaccactgaagatatgctgtccgtgtggaatcgggtctggattgaggaaaacccatggatggaggacaagacccacgtgagtagctgggaagacgttccctacctcggcaagagggaggatcaatggtgcggctcgttaatcgggctgacagcccgagcgacgtgggctaccaatattcaggtggccatcaaccaggtcagacggttgataggaaatgagaactatctggactacatgacttccatgaaaaggttcaagaatgaatctgatcctgagggtgcactctggtga

SEQ ID NO: 14211 - RNA, 9879 nt, synthetic construct
  misc_feature 1..9879: note = derived and/or modified CDS sequence (opt3) from DENV-1__KM403586__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagatttcgtggagggtcttagcggcgcgacttgggtagacgttgtgttggagcacgggagttgtgtcacaaccatggcaaagaataaacccactctggatatcgaactactcaagacagaggtgaccaaccctgccgtgctgaggaaactttgcattgaagctaagatctccaatacgaccacagactctcggtgtccaactcaaggagaggccaccctggtcgaagagcaggatgcaaactttgtttgccgccgaacattcgtggacagaggctggggtaatgggtgtggattgtttggcaaaggcagcctcctgacttgcgctaagttcaagtgcgtaaccaaattagaggggaagatagtgcagtacgaaaacctgaaatattccgtcattgtgacagttcacaccggagatcagcatcaagtgggtaatgagactacggaacacggcacaatcgccaccattactccccaggcgcctacctcagaggtccagctcacagactacggggcccttaccctggactgtagtccaaggactggattggattttaacgaaatggtgctactgacaatgaaggagaaaagctggctcgtacataagcagtggttcctggaccttccgctgccctggacgtctggcgcatccacctcacaagagacttggaatcggcaggatttgctcgttacatttaaaaccgctcacgccaagaagcaggaagtggtcgtgctgggtagccaagagggggctatgcacacagccttaactggcgcaaccgaaatccagacgagtggaaccacaactatcttcgccggccatctgaaatgccgtctaaagatggacaaactcaccctgaagggggtctcttatgtgatgtgtacaggatccttcaaacttgagaaggaagttgctgagactcagcacggtaccgtgttggtacaggtcaagtacgagggcacggatgcgccttgcaaaattccaataagcacacaagacgaaaagggggtgacccagaacggacgcctgatcactgcaaatcccattgttacagataaagagaagcctgtgaacatcgaaaccgagccaccctttggcgagtcgtatatagtcattggtgccggggaaaaagctctcaagctgtcttggttcaagaaaggctcctcaatcggaaagatgtttgaggccactgcaagaggcgccaggcggatggctatccttggggacaccgcctgggatttcggaagtattggtggcgtgtttacaagcgtagggaaactggtgcatcaggttttcggaacggcatacggcgtcttgttttccggtgtgtcttggaccatgaagatcgggattggcatactcctgacttggttaggactgaatagccgatcaacaagtctatccatgacctgtatcgcggtgggcatggtcacactctacctgggggttatggtgcaggctgacagcggatgcgtgattaactggaaaggccgcgaacttaagtgtggttctgggatcttcgtaactaacgaggtccacacctggacggaacaatataagtttcaggccgattcaccgaaaagattgagtgcagccatcggaaaggcttgggaggagggcgtgtgcggtattaggagcgccacacggctggaaaatataatgtggaaacagatctccaacgagctcaatcatattctgttagaaaacgacatgaagttcaccgttgtggtcggcgacgcatacgggatcctgactcagggaaaaaagatgattcgccctcaacccatggagcacaaatattcttggaagtcgtggggcaaggctaaaatcataggggccgatacccagaatacaacttttatcattgacggaccagatacccctgaatgtcccgacgatcagagagcgtggaacatctgggaggtggaggactacggcttcggtgtttttacaacgaatatttggcttaagttgagggatagctatacccagatgtgcgaccaccgtctcatgtccgccgctatcaaagattcaaaggcagtgcatgccgacatggggtactggatagaaagtgagaaaaacgaaacttggaagctggctcgggcctctttcattgaggtaaagacatgtatctggccacgaagccacaccctatggtccaatggagtcctggaatcagagatgattatccccaaaatatatggcggtcctatcagccaacataactacagaccaggctacttcactcagacagcagggccgtggcacctcggaaagctggagcttgattttaatttgtgcgaaggcaccacggtggtggtcgacgagcactgcgggaacaggggaccctctctgcgcactaccacagttaccggcaaaattatccatgaatggtgttgccggtcctgtactttacctccactcagattcaggggtgaggatgggtgctggtatggaatggagattcgccccgtgaaggaaaaagaggaaaatctggtacgaagtatggtgagcgcgggctctggtgaggtcgactccttttcacttggcctgttgtgtgtgagtatcatgatagaagaggttatgcggagccgttggtcgagaaagatgctcatgacagggaccctggccgtgttctttctactgattatgggacagctcacatggaacgacctgatcaggctttgcatcatggtcggcgctaatgtgtccgatcgcatggggatgggaactacctacttggccctgatggcaacgttcaagatgcggcctatgtttgctgttggcttactcttcagaaggctgacatctcgagaggtgcttctgctaaccattggtctcagcctggtcgcctcagtagaattgccaaacagtctggaggaattaggggacggactcgcaatgggcatcatgatgctgaaacttctgactgattttcaatcccaccagttgtggaccacactcctgtctctaactttcattaagaccacgctgagccttgactatgcctggaaaacaatggctatggtgctctccatagtttcactgtttcccttgtgtctgagcaccactagtcagaagacaacctggttaccggtgctcctgggctctttcgggtgcaaacctcttactatgtttctgatcacagagaacaagatttggggacgcaagtcctggccattgaatgaaggtatcatggcggtcggcattgtgagcatcctcctgtcgtcactactgaaaaacgatgtaccccttgccgggcctctcatagcaggaggcatgctgatcgcttgttacgtgatttctggtagttccgccgacttgagcttagagcgggccgctgaggtctcttgggaagaggaagcagagcatagcggggcctcccacaatatcctggttgaagtgcaggatgacggaaccatgaagattaaagatgaggagagagacgatacgctcactatcctgcttaaggcgaccctgttggctgtgtcaggcgtctatcccatgagtataccagccacactattcgtgtggtacttctggcaaaaaaagaaacagaggagcggcgttctgtgggacaccccttctcccccagaagtagagcgtgcagtgctcgatgacgggatttatcgcatcctgcagcggggacttttaggtagatcccaggtcggcgtgggggtttttcaagacggagtgttccatacaatgtggcacgtcactaggggcgccgtgctgatgtaccagggtaagcgactcgaaccgtcatgggctagtgtaaagaaagatttgatcagctacgggggaggctggcggtttcagggctcctggaacaccggggaggaggtccaggtgattgcagttgaacctggaaagaatcccaaaaacgtgcaaacgacaccaggtactttcaagacccccgagggcgaagtcggggccatagcgctggactttaaacctggaacatctggctcgccaatcgtgaatcgcgagggtaagattgttgggctctatggaaacggcgtggtcaccactagcggcacctacgtgtcagctatcgcccaggcaaaggcctcccaggaagggcccctgcctgagattgaggatgaagtattcaaaaagagaaatcttacaatcatggacctgcacccgggaagtggtaaaacgaggcggtatttgccagctatagtgcgagaggccatcaagagaaaactacgcactctgattctcgcacccaccagggttgtcgcttctgaaatggccgaggcgttaaagggcatgcctatccgttaccaaacaaccgccgtgaagagcgaacatactgggaaagagattgtggatctgatgtgccacgcaacatttaccatgcggcttctgtccccagtcagagtacccaactataatatgatcataatggacgaggctcatttcacggatcctgcctcaattgctgcaaggggatacatctctactcgcgtgggcatgggtgaagccgccgctatctttatgacagcgaccccgcccgggagcgttgaggcattcccacagagtaacgccgtgattcaggacgaagagcgagatatccctgaaagatcctggaatagcggatatgactggataaccgattttcccggcaagactgtctggttcgtgccatctattaaatcaggcaacgacatcgctaattgtctccggaagaacgggaaaagggttattcagttgtcccgcaagacattcgacaccgagtaccaaaagacaaaaaacaatgattgggactacgtggtcactacggatatcagtgagatgggagccaactttcgtgcagacagagtgatagatcctcggaggtgcctgaagcccgtaattctcaaagacggtccagaacgcgtgatcctggccggcccgatgcctgttaccgctgcgagcgccgcacagcgaagagggcggatcggaaggaatcagaacaaggagggcgatcagtatatttacatgggtcaaccccttaataacgacgaagatcacgctcattggacagaggccaaaatgctactggacaatatcaacactccagaggggattatacccgcattgttcgaacctgagcgcgaaaagtcggccgctatcgatggcgagtatagattaaggggagaagcccggaagacctttgtcgagctgatgcgtcgcggcgacctcccagtgtggctgtcttacaaagtggcgtccgaggggttccagtatagcgatcgaagatggtgctttgacggagaaaggaataaccaggtccttgaggaaaatatggacgttgagatttggacaaaggaaggtgagcggaaaaagctgcgccccagatggctcgatgcaaggacctactcagaccctttggccctgcgggagttcaaagaatttgctgccggccgaagaagtgtgtctggggatctaatcctggagatcggaaagctcccgcagcaccttactctgcgcgctcaaaacgcattagacaatttggtaatgctgcacaactccgaacagggcggtaaagcctataggcatgctatggaggaactcccagatacgattgagaccctgatgcttctggccctcatagcagtgttgacagggggcgtcactctgttctttttaagcggaaagggcctagggaagacctcaatcggactgctctgtgtgatggcgagtagcgttcttctgtggatggcctccgtggagccccactggattgctgcctctatcattttggaattctttctgatggtcctcctgatccctgagcccgaccggcagcgtacaccacaggataatcaacttgcatacgtagtgataggtctcctgttcatgatcttgaccgttgctgccaacgaaatgggcctgttagagactacaaaaaaggacctagggattggacatgtggtcgcagagaaccaccaccatgccacgatgctggatatcgacctccaccctgctagcgcgtggaccctttacgccgtggcaactacaattatcacccccatgatgagacataccatagaaaatacaactgctaacatttccctgacggccatcgccaatcaggcagctattttgatgggcctggataaaggttggccaatctcaaagatggacataggggtccctctcctggcccttggctgctattctcaggtgaacccgttaaccctgacagcggctgttctcatgttggtggcccactacgcaatcattggacccggcctgcaagccaaagctactagggaggcacagaagcgcaccgccgcggggatcatgaagaatccaacagtagatggaattgtggctatcgacctagaccctgtcgtttatgatgccaaatttgaaaagcagctgggccagataatgctccttattctgtgtaccagtcaaatcttgctgatgcggactacgtgggcactctgcgagtcgatcacactggccaccggtcccttaactaccctttgggaagggagcccaggacgattctggaacacaactattgctgtgtccatggccaatatcttcagaggctcttacctggcaggtgctggcctcgccttttcactaatgaaaagcctggggggaggcaggcgcgggaccggagcgcagggcgagacattgggtgagaagtggaaacggcagctgaaccagctctccaagagtgaattcaatacgtataagagatctgggataatggaggtcgaccgtagcgaagccaaagagggaatgaagaggggcgaaaccactaaacatgcagtgtcacggggtacagctaagcttcgctggtttgtagagcgaaacctggtgaaacctgagggcaaggttattgatttggggtgtggaagaggcgggtggtcctactattgcgccggactgaagaaagtgaccgaagtcaagggctacactaaaggtgggcccggacacgaggaaccgatcccaatggcaacatacggctggaatattgtgaagctccacagtggcagggacgtcttctttacccctcccgagaaatgtgatacgttactgtgcgacatcggggaaagctctccaaaccccaccatagaggagggacggacacttcgcgtgctgaagatggttgaaccttggctaagaggtaatcaattctgtatcaaaattctcaacccgtatatgccctccgtagtggagactctggaacagatgcagaggaagcatggcgggatgttggtccgaaatccactgtcacggaacagcacccacgagatgtactgggtgtcgtgcggaacaggcaatatcgtttctgctgtgaacatgactagtcgtatgctccttaacagatttaccatggcccatcgcaagcctacatatgagagggatgtcgacctgggtgccgggacccggcacgtggcggtagaacccgagattgctaatttagatatcattggacagagaatcgaaaacataaaaaatgagcacaagtccacttggcattacgacgaagataacccttataaaacgtgggcataccacggcagctatgaggtgaagccatcaggctccgcctctagcatggttaatggggtcgtgcgcctgttgacaaaaccctgggacgtgattcctatggtcacccaaatcgctatgactgacaccacaccattcggacagcagagggtttttaaggagaaggtggatacgcgaaccccccggccgaaaagaggtactgcccaaatcatggaagtaacagcaaagtggctctggggcttcctgagtaggaacaaaaagcctcgcatttgtacccgtgaggaatttactcggaaagtgagatccaatgccgctataggggcggtcttcgtggacgagaaccagtggaatagcgccaaggaagcagttgaggatgagaggttttgggacctagtgcatcgcgaacgagagcttcacaagcagggaaaatgcgctacatgcgtctacaacatgatgggcaagcgggaaaaaaagctgggtgagttcgggaaagccaagggatctagagcaatctggtacatgtggctcggcgccaggttcctggaatttgaggctttgggcttcatgaatgaggatcattggttttcacgcgaaaacagtctgtccggggtggagggagaaggtctccacaagcttggctatattctgagagacatcagcaaaattccagggggaaatatgtacgccgatgacaccgcgggctgggatacacggatcactgaggacgatttacagaacgaggcaaagataaccgacatcatggaacccgagcacgccctgttggctacgtctattttcaaactcacctatcaaaataaggtagttagggtgcagcgtcctgccaaatcgggtacagtcatggatgtgatctcacgacgcgaccagagagggagcggacaggtgggcacttacggcctgaacacctttacaaacatggaagtccaactaattcggcagatggagtccgaagggatcttcagtccatctgagcttgagaatagcaacctggcagaaagggttctcgactggctggagaagcatggagtggaacgcttgaaaagaatggctatatccggtgatgactgtgtagtgaagcccactgatgaccggtttgccaccgctttaacggccctgaatgatatgggcaaggtcaggaaagacattccgcagtgggagccttcaaaggggtggaacgattggcagcaagtgcccttctgcagtcaccattttcaccagctcatcatgaaagacggacgagaaatcgttgtgccatgtcgtaatcaggatgagcttgtcggcagagcacgcgtgtctcagggtgcggggtggagcctgcgggagacagcctgcctaggaaagtcctatgctcaaatgtggcagctgatgtacttccacaggagagacctccgcttggccgcaaacgctatttgttcagccgtacctgttaattgggtgcccaccagccggactacatggtctatacatgcacaccatcagtggatgaccactgaagatatgctgtccgtctggaacagggtgtggatcgaggaaaatccatggatggaggacaaaacccacgttagtagctgggaagacgtgccctatcttggcaagcgagaggatcaatggtgcggctcgctgattgggctcacagccagagcgacgtgggctaccaacatccaggtcgccattaatcaggtgcggaggttaatcggaaacgagaattacctggactacatgacttccatgaagcgctttaaaaacgaatctgatcctgagggtgcattgtggtga

SEQ ID NO: 14212 - RNA, 9879 nt, synthetic construct
  misc_feature 1..9879: note = derived and/or modified CDS sequence (opt3) from DENV-1__KM403602__SS-prME
  source 1..9879: mol_type = other RNA
agcgtgaccatgctgctcatgcttctgcccacagcattggctttccacttaactacgagaggaggggaacctcatatgatcgtctccaagcaggaaagaggaaaatctctgctgtttaagacctcagccggtgttaatatgtgcacactcattgccatggacctgggagagctttgtgaagatactatgacctacaaatgcccacggattacagaggcggaaccggacgatgtggactgttggtgcaatgctaccgatacttgggtaacatatgggacctgtagtcaaacgggagagcaccgccgagacaagcgttccgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggttgacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagaacaagatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccatcaccctggactgtagtccaaggactggattggatttcaacgaaatggtcctactgacaatgaaggagaaaagctggctcgtgcataagcagtggtttctggaccttccgctgccctggacgtctggcgcatccacctcacaagagacttggaatcggcaggatttgctcgtaacattcaaaaccgctcacgccaagaagcaggaagttgtggtcctgggtagccaagagggggctatgcacacagccttaactggcgcaaccgaaattcagacgagtggaaccacaactatatttgccggccatctgaaatgccgtctaaagatggacaaactcaccctgaagggggtgtcttatgtcatgtgtacaggatccttcaaacttgagaaggaagtggctgagactcagcacggtaccgttttggtgcaggtaaagtacgagggcacggatgcgccttgcaaaatcccaattagcacacaagacgaaaagggggtcacccagaacggacgcctgatcactgcaaatcccatagtgacagataaagagaagcctgttaacattgaaaccgagccacccttcggcgagtcgtatatcgtgatcggtgccggggaaaaagctctcaagctgtcttggtttaagaaaggctcctcaattggaaagatgttcgaggccactgcaagaggcgccaggcggatggctatccttggggacaccgcctgggattttggaagtattggtggcgtcttcacaagcgtggggaaactggtacatcaggtgtttggaacggcatacggcgttttgttctccggtgtctcttggaccatgaagatagggatcggcattctcctgacttggttaggactgaatagccgatcaacaagtctatccatgacctgtatcgcggtgggcatggtgacactctacctgggggtcatggttcaggctgacagcggatgcgtgatcaactggaaaggccgcgaacttaagtgtggttctgggatttttgtgactaacgaggtacacacctggacggaacaatataagttccaggccgattcaccgaaaagattgagtgcagccataggaaaggcttgggaggagggcgtctgcggtatcaggagcgccacacggctggaaaatattatgtggaaacagatctcctctgagctcaaccatattctgttagaaaatgacatgaagtttaccgtggttgtgggcgacgcaaacgggatcctgactcagggcaagaagatgatacgccctcaacccatggagcacaaatactcgtggaaaagctggggcaaggctaagatcattggggccgatacccagaatacaactttcatcattgacggaccagatacccctgaatgtcccgacgatcagagagcgtggaacatctgggaggtcgaggactatggctttggtgtgttcacaacgaatatatggcttaagttgagggattcctacacccagatgtgcgaccaccgtctcatgtcagccgctattaaagatagtaaggcagttcatgccgacatggggtattggatcgaatctgagaaaaacgaaacttggaagctggctcgggccagctttattgaggtgaagacatgtatctggccacgatcccacaccctatggtcaaatggagtactggaaagcgagatgataatccccaaaatttacggcggtcctatctctcaacataactatagaccaggctacttcactcagacagcagggccgtggcacctcggaaagctggagcttgatttcaatttgtgcgaaggcaccacggtcgtggtggacgagcactgcgggaacaggggaccctccctgcgcactaccacagtcaccggcaaaattatccatgaatggtgttgccggagttgtactttacctccactcagatttaggggtgaggatgggtgctggtacggaatggagatacgccccgttaaggaaaaagaggaaaatctggtgcgaagcatggtatctgcgggctccggtgaggtggactcattcagtcttggcctgttgtgtgtcagcattatgatcgaagaggtgatgcggtcgcgttggtccaagaagatgctcatgacagggaccctggccgtatttttcctactgatcatgggacagctcacatggaacgacctgattagactttgcatcatggtgggcgctaatgtctctgataggatggggatgggaactacctatttggccctgatggcaacgtttaaaatgcgccctatgttcgctgtgggcttactctttcggagactgacaagcagggaggttcttctgctaaccattggtctctcactggtggccagtgtcgaattgccaaactccctggaggaattaggggacggactcgcaatgggcataatgatgctgaaacttctgactgatttccaatctcaccagttgtggaccacactcctgagcctaacttttatcaaaaccacgctgtcccttgactacgcctggaagacaatggctatggtactctcaattgtgagcctgttccccttgtgtctgagtaccacttctcagaaaacaacctggttaccggttctcctgggctcctttgggtgcaagcctcttactatgttcctgatcacagagaacaagatttggggacgaaaaagctggccattgaatgaaggtatcatggcggtgggcatagtctcgatcctcctgtcatctctactgaagaacgatgtgccccttgccgggcctctcattgcaggaggcatgctgatcgcttgttatgtaattagtggttccagcgccgacttgtctttagagcgcgccgctgaggtgagctgggaagaggaagcagagcattccggggcctcacacaatatcctggtcgaagttcaggatgacggaaccatgaaaataaaggatgaggagcgggacgatacgctcactattctgcttaaagcgaccctgttggctgtgagtggcgtgtaccccatgagcatcccagccacactatttgtctggtatttctggcaaaagaaaaagcagagatctggcgtgctgtgggacaccccttcacccccagaagttgagagggcagtactcgatgacgggatctaccgtattctgcagcgcggacttttaggtcggagccaggtgggcgtcggggtgttccaagacggagtttttcatacaatgtggcacgtgactagaggcgccgtcctgatgtatcagggtaagaggctcgaaccgagttgggctagcgtgaaaaaggatttgatatcctacgggggaggctggcgattccagggctcttggaacaccggggaggaggtacaggtcatcgcagtggaacctggcaaaaatcccaagaacgttcaaacgacaccaggtacttttaaaacccccgagggcgaagtgggggccattgcgctggacttcaagcctggaacatcgggcagcccaatcgtcaatcgggagggtaagattgtggggctctacggaaacggcgttgtgaccacttcaggcacctatgtctccgctatcgcccaggcaaaagccagtcaggaagggcccctgcctgagatagaggatgaagtgtttaagaaacgcaatcttacaatcatggacctgcacccgggatctggtaagacgagaaggtacttgccagctattgtacgggaggccatcaaacgaaagctaagaactctgattctcgcacccacccgcgtggttgctagcgaaatggccgaggcgttaaagggcatgcctatcaggtatcaaacaaccgccgtcaaatccgaacatactgggaaggagatagtggatctgatgtgccacgcaacattcaccatgcgtcttctgtcaccagtgcgggtccccaactacaatatgattatcatggacgaggctcattttacggatcctgcctctatcgctgcaagaggatatattagcactagggtaggcatgggtgaagccgccgctatcttcatgacagcgaccccgcccgggagtgtggaggcatttccacagtccaacgccgttatacaggacgaagaacgcgatattcctgaacgaagctggaactctggatacgactggatcaccgatttccccggcaaaactgtgtggtttgtcccatcaattaagtccggcaacgacatcgctaattgtctcaggaaaaatgggaagcgggtgatacagttgagtaggaagacattcgacaccgagtatcagaaaacaaagaacaatgattgggactacgttgtgactacggatattagcgagatgggagccaacttccgcgcagaccgtgtcatcgatcctagacggtgcctgaaacccgtgatcctcaaggacggtccagaaagggtaattctggccggcccgatgcctgtgaccgctgcgtcggccgcacagcgccgagggagaatcggacggaatcagaacaaagagggcgatcagtacatttatatgggtcaaccccttaataacgacgaagatcacgctcattggacagaggccaagatgctactggacaatataaacactccagaggggatcattcccgcattgtttgaacctgagagggaaaagtctgccgctatcgatggcgagtaccgcttaagaggagaagccaggaaaaccttcgttgagctgatgcggcgtggcgacctcccagtctggctgtcctataaggtggcgagcgaggggtttcagtactcagatcgccgatggtgcttcgacggagaaagaaataaccaggtgcttgaggaaaatatggacgtcgagatctggacaaaagaaggtgagaggaagaaactgcggccccgctggctcgatgcaagaacctatagtgaccctttggccctgagggagtttaaggagttcgctgccggccggcgatctgtttccggggatctaattctggagataggaaaactcccgcagcaccttactctgagagctcaaaacgcattagacaatttggtgatgctgcacaacagcgaacagggcggtaaggcctaccgccatgctatggaggaactcccagatacgatcgagaccctgatgcttctggccctcattgcagtattgacagggggcgtgactctgtttttcttatcaggaaagggcctagggaaaaccagtatcggactgctctgtgtcatggcgagctccgtgcttctgtggatggcctctgttgagccccactggattgctgccagcatcatattggaatttttcctgatggtgctcctgatccctgagcccgacaggcagcggacaccacaggataatcaacttgcatatgtcgtaattggtctcctgtttatgatcttgaccgtggctgccaacgaaatgggcctgttagagactacaaagaaagacctagggattggacatgttgtggcagagaaccaccaccatgccacgatgctggatatcgacctccaccctgcttccgcgtggaccctttacgccgtcgcaactacaataattacccccatgatgcgtcataccatcgaaaatacaactgctaacatttcactgacggccatcgccaatcaggcagctatattgatgggcctggataagggttggccaatctctaaaatggacattggggtgcctctcctggcccttggctgctacagtcaggtcaacccgttaaccctgacagcggctgtgctcatgttggttgcccactatgcaatcattggacccggcctgcaagccaaggctactagagaggcacagaagaggaccgccgcggggatcatgaaaaatccaacagtggatggaatagtagctattgacctagaccctgtggtctacgatgccaagttcgaaaaacagctgggccagatcatgctccttatcctgtgtacctcgcaaattttgctgatgcgcactacgtgggcactctgcgagagcatcacactggccaccggtcccttaactaccctttgggaagggtccccaggaaagttttggaacacaactatagctgtttctatggccaatattttccggggctcatatctggcaggagctggcctcgccttcagcctaatgaaatccctagggggtggccgaagagggaccggagcgcagggcgagacattgggtgagaagtggaagaggcagctgaaccagctcagtaaatctgaatttaatacgtacaagcgcagcgggatcatggaggtggaccggtcagaagccaaagagggacttaagagaggcgaaaccactaaacatgcagtctcccgtggtacagctaagctgaggtggttcgtggagcggaacttggtaaagcctgagggcaaagtgattgatctggggtgtggacgcggcgggtggagttattactgcgccggactcaagaaagttaccgaagtgaagggctatactaaaggtgggcccggacacgaggaaccgatcccaatggcaacatacggctggaatatagtcaagttacacagcggccgagacgtgtttttcacccctcccgagaaatgtgatacgctgctttgcgacatcggggaatcttccccaaaccccaccattgaggagggaagaacactgagggtcctaaagatggtggaaccttggctccggggtaatcaattttgtatcaagattctgaacccgtacatgccctcagttgtagagactttggaacagatgcagcgcaaacatggcgggatgctggtgagaaatccactcagcaggaactcgacccacgagatgtattgggtctcttgcggaacaggcaatatcgtgagtgctgttaacatgacttcccgaatgcttctgaaccggttcaccatggcccatcgtaagcctacatacgagagagatgtggacttaggtgccgggacccgccacgtcgcggtggaacccgagattgctaatctggatatcataggacagaggattgaaaacatcaaaaatgagcacaagagcacttggcattatgacgaagataacccttacaaaacgtgggcatatcacggctcatacgaggtaaagccatccggctctgccagcagtatggtgaatggggttgtccggttgctcacaaagccctgggacgtgatccctatggtgacccaaattgctatgactgacaccacaccatttggacagcagagagtcttcaaagagaaggttgatacgcgcacccccaggccgaaacgaggtactgcccaaataatggaagtgacagcaaagtggctgtggggctttctatcccggaacaaaaagcctagaatctgtaccagggaggagttcactcgcaaggtacgtagcaatgccgctattggggcggtgtttgtcgacgagaaccagtggaactctgccaaagaagcagtggaggatgagcggttctgggaccttgttcatagagaaagggagctgcacaagcagggaaaatgcgctacatgcgtgtataacatgatgggcaagcgcgagaaaaagctcggtgagtttgggaaggccaaaggatcacgagcaatctggtacatgtggctgggcgcccggttcttggagttcgaggctctgggctttatgaatgaggatcattggttcagtagagaaaactccctcagcggggtcgagggagaaggtcttcacaagctgggctacattttaagggacatctctaaaataccagggggaaatatgtatgccgatgacaccgcgggctgggatacacgcatcactgaggacgatctgcagaacgaggcaaagattaccgacatcatggaacccgagcacgccttgctcgctacgtcgatttttaaactgacctaccaaaataaggtggtaagagttcagcggcctgccaaatcaggtacagtgatggatgtcatcagcaggcgtgaccagcgagggtccggacaggtgggcacttatggcctaaacaccttcacaaacatggaagtgcaacttatacgccagatggagagtgaagggatattttctccaagcgagctggaaaattccaacctcgcagaaagagtcctggactggttggagaagcatggagttgaacggttaaagaggatggctatctcaggtgatgactgtgtggtaaaacccactgatgaccgcttcgccaccgctctgacggccctcaatgatatgggcaaggtgagaaaagacatcccgcagtgggagcctagtaaggggtggaacgattggcagcaagtccccttttgctctcaccatttccaccagcttattatgaaagacggacgggaaatagtggttccatgtaggaatcaggatgagctggtgggccgagcacgtgtcagccagggtgcggggtggtccctaagagagacagcctgcctgggaaagtcatacgctcaaatgtggcagctcatgtattttcaccgccgggacttgaggctggccgcaaacgctatctgtagcgccgtgcctgtaaattgggttcccacctctagaactacatggtccattcatgcacaccatcagtggatgaccactgaagatatgcttagtgtgtggaaccgcgtctggatcgaggaaaatccatggatggaggacaagacccacgtgagctcgtgggaagacgttccctacctgggcaaacgggaggatcaatggtgcggctccctcattgggttaacagccagggcgacgtgggctaccaacatccaggtggccataaatcaggtccgaagactgatcggaaacgagaattatttggactacatgacttctatgaagcggttcaaaaacgaatcagatcctgagggtgcactgtggtga

SEQ ID NO: 14213 - RNA, 9879 nt, synthetic construct
  misc_feature 1..9879: note = derived and/or modified CDS sequence (opt3) from DENV-1__KM403582__SS-prME
  source 1..9879: mol_type = other RNA
agcgtgaccatgctgctcatgcttctgcccacagcattggctttccacttaactacgagaggaggggaacctcatatgatcgtctccaagcaagaaaggggaaaatctctgttgtttaagacctcagccggtgttaacatgtgcacactcattgcaatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagaccgtagaagcgtggccctggcaccccatgtcggcttgggtctcgagactaggaccgaaacatggatgtcctctgagggggcctggcggcagatccagcgcgtggaaacttgggctctgagacaccctggattcaccgttattgcactgtttctcgcccatgctatcggcacatcgattacccagaagggcatcattttcatcttactgatgcttgtgacgccatcaatggccatgaggtgcgtcgggattggaaaccgggattttgtggagggtttgagcggcgcgacttgggtagacgttgtgctggagcacgggagttgtgtcacaaccatggccaagaataagcccactctagatatcgaactcctgaagacagaggtgaccaaccctgccgtgcttcgcaaactgtgcattgaagctaagatctccaatacgaccacagactctcgatgtccaactcaaggagaggccaccttggtcgaagaacaagatgcaaacttcgtttgcagaaggacatttgtggaccggggctggggtaatgggtgtggactcttcggcaaaggcagcctgttaacttgcgctaagtttaaatgcgtaaccaagctggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccacgtactggactagatttcaacgaaatggtcctgctcacaatgaaggagaaaagctggctggtgcataagcagtggtttcttgacctgccgttgccctggacgtctggcgcatccacctcacaagagacttggaatcgccaggatctcctggtaacattcaaaaccgctcacgccaagaaacaggaagttgtggtcttaggtagccaagagggggctatgcacacagccctgactggcgcaaccgaaatccagacgagtggaaccacaactatttttgccggccatctaaagtgcagactcaagatggacaaactgacccttaagggggtgtcttatgtcatgtgtacaggatccttcaaattggagaaggaagtggctgagactcagcacggtaccgttctggtgcaggtaaaatacgagggcacggatgcgccttgcaagataccaatcagcacacaagacgaaaagggggtcacccagaacggaaggctcattactgcaaatcccatcgtgacagataaagagaagcctgttaacatagaaaccgagccacccttcggcgagtcgtatattgtgatcggtgccggggaaaaagctctgaaactttcttggtttaaaaagggctcctcaatcggaaagatgttcgaggccactgcacggggcgcccgacgcatggctattctgggggacaccgcctgggattttggaagtatcggtggcgtcttcacaagcgtggggaaattggtacatcaggtgtttggaacggcatacggcgttctcttctccggtgtctcttggaccatgaagattgggataggcatcctgttaacttggctgggactaaatagcagatcaacaagtctctccatgacctgtattgcggtgggcatggtgacactgtaccttggggtcatggttcaggctgacagcggatgcgtgatcaactggaaaggcagggaattgaagtgtggttctgggatctttgtgactaacgaggtacacacctggacggaacaatataaattccaggccgattcaccgaagcggctgagtgcagccattggaaaggcttgggaggagggcgtctgcggtatacgcagcacaaccagactcgaaaatatcatgtggaaacagatttccaacgagctgaatcatatcttactggaaaacgacatgaagtttactgtggttgtgggcgacgccaatgggattcttacccagggcaagaagatgatcaggcctcaacccatggagcacaaatactcttggaagtcgtggggcaaagcaaagataatcggggctgatacacagaacactaccttcattatcgacggaccagatacacctgaatgtcccgacgatcagcgtgcctggaatatttgggaggtcgaggactatggctttggtgtgttcacgaccaacatctggttgaagctccgggatagctacactcagatgtgcgaccaccgactgatgtccgcggccataaaagattcaaaggctgttcatgcagacatggggtattggattgaaagtgagaaaaatgaaacatggaagctagccagagcttcttttatcgaggtgaaaacctgtatttggccaaggagccacactctgtggtccaacggagtactcgaatcagagatggtcatccccaagatatacggcggtcctatcagccaacataattatcgcccaggctacttcacacagaccgccgggccgtggcacctgggaaaacttgagttggatttcaacctgtgcgaaggcacgactgtggtggtcgacgagcactgcgggaatcggggaccctctttaagaaccacaaccgttactggcaaaattatccatgaatggtgttgcaggtcctgtacactccctccactgcgctttcgaggtgaggatgggtgctggtacggaatggagattcggcccgtgaaggaaaaagaggaaaaccttgtacgtagtatggtgagcgcaggctctggtgaggtcgactccttctcactgggcttgctctgtgtgagtatcatgatagaagaggttatgagaagcagatggtcgcgcaagatgctgatgaccgggacactagcgatatttttcctgctcatcatgggacagctgacttggaatgaccttatccggttgtgcattatggtgggcgccaacgtctccgatagaatggggatgggaaccacgtatctggctttaatggccacatttaaaatgaggcctatgttcgcagtgggcctcctgtttcgacgccttacctctcgggaggttctgctactcactatcggtctgagcttggtggcttcagtcgaactgccaaacagtttagaggaactcggggacggactggccatgggcattatgatgcttaagctgttgaccgatttccaatcccaccagctctggacaactctgctatctctgacctttataaagacgacacttagcctcgactacgcatggaaaaccatggccatggtactgtccatcgtgtcattgttccccctgtgtttaagcactacaagtcagaagaccacttggctcccggttctgcttggctcttttgggtgcaaacctctgacaatgttcttgattaccgagaataagatctggggaagaaaatcctggccactcaacgaaggtattatggctgtgggcatcgtcagcatactgctatcgtcactgcttaagaatgatgtgcccctcgcggggcctctgatcgccggaggcatgttgattgcatgttatgtaatctctggtagttccgctgacttaagcctggagagggccgccgaggtgtcttgggaagaggaagctgagcatagcggggcatcccacaacattctcgtcgaagttcaggatgacggaacgatgaagatcaaagatgaggagcgtgacgatactctgaccatacttctgaaggccacattgctagcggtgtcaggcgtgtaccccatgagtattccagctaccctgtttgtctggtatttctggcagaagaagaaacagcgcagcggcgtgctctgggacacaccttctcccccagaagttgagcgggccgtactggatgacgggatctacagaatccttcagaggggattactgggtcgatcccaggtgggcgtcggggtgttccaagacggagtttttcatactatgtggcacgtgacccggggcgcagtcctcatgtatcagggtaagcgcttggaaccgtcatgggccagtgtgaaaaaggatctgattagctacgggggaggctggagattccagggctcctggaatacgggggaggaggtacaggtcatagctgtggaacctggaaagaaccccaaaaatgttcaaacaactccaggtacctttaagacacccgagggcgaagtgggggcaatcgccctcgacttcaaacctggaacctctggctcgccaattgtcaacagggagggtaagatcgtggggctgtacggaaatggcgttgtgactaccagcggcacatatgtctcagcgattgctcaggccaaagcatcccaggaagggccccttcctgagatcgaggatgaagtgtttaagaagcggaacctgacgataatggacttgcacccgggaagtggtaaaactcgaagatacctaccagccatcgtacgcgaggctattaagaggaaactgcgtaccctcatcttagcccccacacgggtggttgcatctgaaatggctgaggccctgaagggcatgcctattagatatcaaaccactgcggtcaaaagcgaacatacagggaaggagatcgtggatcttatgtgccacgccaccttcacgatgaggctgctctccccagtgcgcgtccccaattacaacatgataattatggacgaggcacattttactgatcctgcttcaatcgccgctcgaggatatatctctacaagagtaggcatgggtgaagcagccgccattttcatgaccgctaccccgcccgggagcgtggaggcgtttccacagagtaatgcagttatccaggacgaagaacgggatatacctgaaaggtcctggaacagcggatacgactggattactgatttccccggcaagacagtgtggtttgtcccatctatcaaatcaggcaatgacattgccaactgtttgcgcaagaacgggaaacgtgtgatccagctgtccagaaagaccttcgacacagagtatcagaagactaagaataacgattgggactacgttgtgacgaccgatataagtgagatgggagctaatttccgggccgacagggtcattgatcctcgccgatgcctcaagcccgtgatcctgaaagacggtccagaaagagtaatccttgcaggcccgatgcctgtgacagccgctagcgcggcccagcggagggggcgcattggaagaaaccagaataaggagggcgatcagtacatctatatgggtcaacccctaaacaatgacgaagatcacgcacattggactgaggctaaaatgctgttggacaacattaataccccagaggggataatccccgccttatttgaacctgagagggaaaagtcggcagccattgatggcgagtaccggctgcgtggagaagctcgcaaaacattcgttgagctcatgcgaagaggcgacctgccagtctggctttcttataaggtggcctccgaggggtttcagtacagcgataggcggtggtgcttcgacggagaacgcaacaatcaggtgctggaggaaaacatggacgtcgagatctggaccaaggaaggtgagaggaaaaagctcaggccccggtggttggatgcgcgaacttattcagaccctctggcactaagagagtttaaagagttcgccgctggccgcaggagtgtttctggggatctgatcctcgagattggaaaacttccgcagcacctgacgttacgggcccaaaatgctttggacaacctggtgatgctccacaattccgaacagggcggtaaagcataccgtcatgccatggaggaactgccagataccatagagacacttatgctgctcgctttgatcgccgtactgactgggggcgtgaccttatttttcctaagcggaaagggcctggggaaaacatcaattggactcctttgtgtcatggcaagtagcgtgctgttgtggatggcgtccgttgagccccactggatcgccgcttctattatcctggaatttttcctcatggtgctgcttatacctgagcccgacagacagaggaccccacaggataaccaactcgcctatgtcgtaatcggtctgttgtttatgattctgactgtggcagctaacgaaatgggcttactagagacaacgaagaaggacctggggatcggacatgttgtggccgagaatcaccaccatgcaaccatgctcgatattgaccttcaccctgccagcgcttggactctgtacgcggtcgccacaaccatcataacccccatgatgcgccatacaattgaaaacactacggcaaatatctccttgaccgctattgccaaccaggccgcaatcctgatgggcctcgataaaggttggccaatatcaaagatggacatcggggtgcctctgcttgctttaggctgctactctcaggtcaatccgctgacactcactgccgcggtgttgatgctggttgctcactatgccattatcggacccggcctacaagcaaaagccacccgggaggctcagaagcgaacagcagccgggattatgaaaaacccaaccgtggatggaatcgtagcgatagacctggaccctgtggtctacgatgctaagttcgaaaagcagctcggccagattatgcttctgatcttgtgtacgagtcaaatcctgctcatgagaactacatgggccctgtgcgagtcgattaccttagcaactggtccccttaccacactgtgggaagggagcccaggaaaattttggaatactaccatcgccgtttccatggctaacatattcaggggctcttatctcgccggtgcaggcctagctttctcactgatgaaaagcctagggggaggccgccgggggacaggagcccagggcgagacgctgggtgagaaatggaagagacagctcaatcagctttccaaaagtgaatttaacacctacaagcgttctgggattatggaggtggacaggagcgaagcgaaggagggactgaaacggggcgaaactacaaagcatgccgtctcacgcggtaccgcaaaattgcgatggttcgtggagagaaatctggtaaagcctgagggcaaagtgatcgatctcgggtgtggaaggggcgggtggtcctattactgcgctggattaaagaaggttactgaagtgaaaggctatacaaagggtgggcccggacacgaggaaccgattccaatggccacctacggctggaacatcgtcaaactgcacagtggccgggacgtgtttttcacgcctcccgagaagtgtgatacccttctgtgcgacataggggaaagctctccaaatcccacaatcgaggagggacgcactctaagagtcctcaaaatggtggaaccttggctgaggggtaaccaattttgtattaagatcttgaatccgtacatgccctccgttgtagagaccctggaacagatgcagcgaaaacatggcgggatgctcgtgcggaacccactttcacgtaatagcacacacgagatgtattgggtctcgtgcggaactggcaacattgtgtctgcagttaacatgaccagtagaatgctgttaaatcgcttcacaatggctcataggaagcctacctacgagcgggatgtggacctgggtgccgggactagacacgtcgccgtggaacccgagacggcgaacttggatatcattggacagcgcatcgaaaatataaagaacgagcacaaatccacatggcattatgacgaagataatccttacaagacctgggcttatcacggcagctacgaggtaaaaccatcaggctccgcatctagcatggtgaacggggttgtcaggctcctgactaagccctgggacgtgattcctatggtgacccaaatcgccatgacagacacgaccccatttggacagcagcgagtcttcaaagagaaggttgatactcggacacccagaccgaagaggggtaccgctcaaatcatggaagtgactgccaaatggctatggggctttcttagtcgcaataagaaacctcgtatttgtacacgggaggagttcaccagaaaggtaaggtccaacgcagccataggggctgtgtttgtcgacgagaatcagtggaacagcgcgaaagaagccgtggaggatgagcgcttctgggacctggttcatcgagaacgggagctccacaagcagggaaagtgcgcaacatgcgtgtataatatgatgggcaaaagagaaaagaaactgggtgagtttgggaaggctaaaggatctagggccatctggtacatgtggttgggcgcacgcttcctggagttcgaggccctcggctttatgaacgaggatcattggttctcaagagaaaatagtctttccggggtcgagggagaaggtctgcacaagttaggctacattctgcgggacatcagcaagattccagggggaaacatgtatgctgatgacactgccggctgggataccaggatcacggaggacgatttgcagaatgaggcgaaaataaccgacatcatggaacccgagcacgcactcctggccacatctatttttaagctaacttaccaaaacaaagtggtacgtgttcagcgacctgctaagtcgggtaccgtgatggatgtcatctcacgcagagaccagcgggggagcggacaggtgggcacatatggccttaacactttcaccaatatggaagtgcaactgattaggcagatggagtccgaagggatctttagtccatctgagctcgagaacagcaatctggccgaacgcgtcttggactggttagagaaacatggagttgaaagactgaagcggatggcaatatccggtgatgactgtgtggtaaaacccacggatgacaggttcgctacagccctcaccgctcttaacgatatgggcaaggtgcgaaaggacattccgcagtgggagccttcaaaagggtggaatgattggcagcaagtccccttttgcagtcaccatttccaccagctgatcatgaaggacggacgtgaaatcgtggttccatgtagaaaccaggatgagctagtgggccgcgcccgggtctctcagggtgcagggtggagcctgagggagactgcgtgcctcggaaaatcctacgcccaaatgtggcagttgatgtattttcacagacgcgacctgcggcttgctgccaatgcaatttgttcagctgtgcctgtaaactgggttcccacaagcaggaccacttggtctatacatgcccaccatcagtggatgaccacagaagatatgctgtccgtgtggaatcgagtctggatcgaggaaaacccatggatggaggacaagacgcacgtgagtagctgggaagacgttccctacctcggcaaaagagaggatcaatggtgcggctcgttaattgggctgaccgcacgggccacttgggcgacaaatatccaggtggctattaaccaggtcaggcgcttgatcggaaatgagaactatctggactacatgacctccatgaagcgtttcaagaatgaatctgatcctgagggtgccctctggtga

SEQ ID NO: 14214 - RNA, 9879 nt, synthetic construct
  misc_feature 1..9879: note = derived and/or modified CDS sequence (opt3) from DENV-1__KM403577__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagatttcgtggagggtcttagcggcgcgacttgggtagacgttgtgttggagcacgggagttgtgtcacaaccatggcaaagaataaacccactctggatatcgaactactcaagacagaggtgaccaaccctgccgtgctgaggaaactttgcattgaagctaagatctccaatacgaccacagactctcggtgtccaactcaaggagaggccaccctggtcgaagagcaggatgcaaactttgtttgccgccgaacattcgtggacagaggctggggtaatgggtgtggattgtttggcaaaggcagcctcctgacttgcgctaagttcaagtgcgtaaccaaattagaggggaagatagtgcagtacgaaaacctgaaatattccgtcattgtgacagttcacaccggagatcagcatcaagtgggtaatgagactacggaacacggcacaatcgccaccattactccccaggcgcctacctcagagatccagctcacagactacggggcccttaccctggactgtagtccaaggactggattggattttaacgaaatggtcctactgacaatgaaggagaaaagctggctcgtgcataagcagtggttcctggaccttccgctgccctggacgtctggcgcatccacctcacaagagacttggaatcggcaggatttgctcgtaacatttaaaaccgctcacgccaagaagcaggaagttgtggtcctgggtagccaagagggggctatgcacacagccttaactggcgcaaccgaaatccagacgagtggaaccacaactattttcgccggccatctgaaatgccgtctaaagatggacaaactcaccctgaagggggtgtcttatgtcatgtgtacaggatccttcaaacttgagaaggaagtggctgagactcagcacggtaccgttttggtgcaggtaaagtacgagggcacggatgcgccttgcaaaataccaatcagcacacaagacgaaaagggggtcacccagaacggacgcctgattactgcaaatcccatcgtgacagataaagagaagcctgttaacatagaaaccgagccaccctttggcgagtcgtatattgtgatcggtgccggggaaaaagctctcaagctgtcttggttcaagaaaggctcctcaatcggaaagatgtttgaggccactgcaagaggcgccaggcggatggctattcttggggacaccgcctgggatttcggaagtatcggtggcgtctttacaagcgtggggaaactggtacatcaggtgttcggaacggcatacggcgttttgttttccggtgtctcttggaccatgaagattgggataggcatcctcctgacttggttaggactgaatagccgatcaacaagtctatccatgacctgtattgcggtgggcatggtgacactctacctgggggtcatggttcaggctgacagcggatgcgtgatcaactggaaaggccgcgaacttaagtgtggttctgggatcttcgtgactaacgaggtacacacctggacggaacaatataagtttcaggccgattcaccgaaaagattgagtgcagccattggaaaggcttgggaggagggcgtctgcggtataaggagcgccacacggctggaaaatatcatgtggaaacagatttccaacgagctcaatcatatcctgttagaaaacgacatgaagttcaccgtggttgtgggcgacgcaaatgggattctgactcagggaaaaaagatgatccgccctcaacccatggagcacaaatactcttggaagtcgtggggcaaggctaaaataatcggggccgatacccagaacacaacttttattatcgacggaccagatacccctgaatgtcccgacgatcagagagcgtggaatatttgggaggtcgaggactatggcttcggtgtgtttacaacgaacatctggcttaagttgagggatagctacacccagatgtgcgaccaccgtctcatgtccgccgctataaaagattcaaaggcagttcatgccgacatggggtattggattgaaagtgagaaaaatgaaacttggaagctggctcgggcctctttcatcgaggtgaagacatgtatttggccacgaagccacaccctatggtccaacggagtactggaatcagagatgatcatacccaaaatctacggcggtcctattagccaacataattatagaccaggctacttcactcagacagcagggccgtggcacctcggaaagctggagcttgattttaacttgtgcgaaggcaccacggtcgtggtggacgagcactgcgggaataggggaccctctctgcgcactaccacagtcaccggcaaaatcattcatgaatggtgttgccggtcctgtactttacctccactcagattcaggggtgaggatgggtgctggtacggaatggagatccgccccgttaaggaaaaagaggaaaacctggtgcgaagtatggtaagcgcgggctctggtgaggtggactccttttcacttggcctgttgtgtgtcagtataatgattgaagaggtgatgcggagccgttggtcgagaaagatgctcatgacagggaccctggccgttttctttctactgatcatgggacagctcacatggaatgacctgatcaggctttgcattatggtgggcgctaacgtctccgatcgcatggggatgggaactacctatttggccctgatggcaacgttcaagatgcggcctatgtttgctgtgggcttactcttcagaaggctgacatctcgagaggttcttctgctaaccatcggtctcagcctggtggcctcagtcgaattgccaaacagtctggaggaattaggggacggactcgcaatgggcattatgatgctgaaacttctgactgattttcaatcccaccagttgtggaccacactcctgtctctaactttcataaagaccacgctgagccttgactacgcctggaaaacaatggctatggtactctccatcgtgtcactgtttcccttgtgtctgagcaccactagtcagaagacaacctggttaccggttctcctgggctctttcgggtgcaaacctcttactatgtttctgattacagagaataagatctggggacgcaagtcctggccattgaacgaaggtattatggcggtgggcatcgtcagcatactcctgtcgtcactactgaaaaatgatgtgccccttgccgggcctctcatcgcaggaggcatgctgattgcttgttatgtaatctctggtagttccgccgacttgagcttagagcgggccgctgaggtgtcttgggaagaggaagcagagcatagcggggcctcccacaacattctggtcgaagttcaggatgacggaaccatgaagatcaaagatgaggagagagacgatacgctcactatactgcttaaggcgaccctgttggctgtgtcaggcgtgtaccccatgagtattccagccacactattcgtctggtatttctggcaaaaaaagaaacagaggagcggcgtgctgtgggacaccccttctcccccagaagttgagcgtgcagtactcgatgacgggatctaccgcatcctgcagcggggacttttaggtagatcccaggtgggcgtcggggtgtttcaagacggagttttccatacaatgtggcacgtgactaggggcgccgtcctgatgtatcagggtaagcgactcgaaccgtcatgggctagtgtgaagaaagatttgattagctacgggggaggctggcggtttcagggctcctggaataccggggaggaggtacaggtcatagcagtggaacctggaaagaaccccaaaaatgttcaaacgacaccaggtactttcaagacccccgagggcgaagtgggggccatcgcgctggactttaaacctggaacatctggctcgccaattgtcaaccgcgagggtaagatcgtggggctctacggaaatggcgttgtgaccactagcggcacctatgtctcagctattgcccaggcaaaggcctcccaggaagggcccctgcctgagatcgaggatgaagtgttcaaaaagagaaaccttacaataatggacctgcacccgggaagtggtaaaacgaggcggtacttgccagctatcgtacgagaggccattaagagaaaactacgcactctgatcctcgcacccaccagggtggttgcttctgaaatggccgaggcgttaaagggcatgcctattcgttatcaaacaaccgccgtcaagagcgaacatactgggaaagagatcgtggatctgatgtgccacgcaacatttaccatgcggcttctgtccccagtgagagtccccaattacaacatgataattatggacgaggctcatttcacggatcctgcctcaatcgctgcaaggggatatatctctactcgcgtaggcatgggtgaagccgccgctatttttatgacagcgaccccgcccgggagcgtggaggcattcccacagagtaatgccgttatccaggacgaagagcgagatatacctgaaagatcctggaacagcggatacgactggattaccgattttcccggcaagactgtgtggttcgtcccatctatcaaatcaggcaatgacattgctaactgtctccggaagaacgggaaaagggtgatccagttgtcccgcaagacattcgacaccgagtatcaaaagacaaaaaataacgattgggactacgttgtgactacggatataagtgagatgggagccaattttcgtgcagacagagtcattgatcctcggaggtgcctgaagcccgtgatcctcaaagacggtccagaacgcgtaatcctggccggcccgatgcctgtgaccgctgcgagcgccgcacagcgaagagggcggattggaaggaaccagaataaggagggcgatcagtacatctatatgggtcaaccccttaacaatgacgaagatcacgctcattggacagaggccaaaatgctactggacaacattaatactccagaggggataatccccgcattgttcgaacctgagcgcgaaaagtcggccgctattgatggcgagtacagattaaggggagaagcccggaagacctttgttgagctgatgcgtcgcggcgacctcccagtctggctgtcttataaagtggcgtccgaggggttccagtacagcgatcgaagatggtgctttgacggagaaaggaacaatcaggtgcttgaggaaaacatggacgtcgagatctggacaaaggaaggtgagcggaaaaagctgcgccccagatggctcgatgcaaggacctattcagaccctttggccctgcgggagttcaaagaatttgctgccggccgaagaagtgtttctggggatctaatcctggagattggaaagctcccgcagcaccttactctgcgcgctcaaaatgcattagacaacttggtgatgctgcacaattccgaacagggcggtaaagcctacaggcatgctatggaggaactcccagatacgatagagaccctgatgcttctggccctcatcgcagtattgacagggggcgtgactctgttctttttaagcggaaagggcctagggaagacctcaattggactgctctgtgtcatggcgagtagcgtgcttctgtggatggcctccgttgagccccactggatcgctgcctctattatcttggaattctttctgatggtgctcctgatacctgagcccgaccggcagcgtacaccacaggataaccaacttgcatatgtcgtaatcggtctcctgttcatgattttgaccgtggctgccaacgaaatgggcctgttagagactacaaaaaaggacctagggatcggacatgttgtggcagagaatcaccaccatgccacgatgctggatattgacctccaccctgctagcgcgtggaccctttacgccgtcgcaactacaatcataacccccatgatgagacataccattgaaaacacaactgctaatatctccctgacggccattgccaaccaggcagctatcttgatgggcctggataaaggttggccaatatcaaagatggacatcggggtgcctctcctggcccttggctgctactctcaggtcaatccgttaaccctgacagcggctgtgctcatgttggttgcccactatgcaattatcggacccggcctgcaagccaaagctactagggaggcacagaagcgcaccgccgcggggattatgaagaacccaacagtggatggaatcgtagctatagacctagaccctgtggtctacgatgccaaatttgaaaagcagctgggccagattatgctccttatcctgtgtaccagtcaaatcttgctgatgcggactacgtgggcactctgcgagtcgattacactggccaccggtcccttaactaccctttgggaagggagcccaggaaaattctggaatacaactatcgctgtttccatggccaacatattccgaggctcttatctggcaggtgctggcctcgccttttcactaatgaagagcctggggggaggcagaagggggaccggagcgcagggcgagacattgggtgagaaatggaagcgccagctgaatcagctctccaagagtgaattcaacacgtacaaacggtctgggattatggaggtggacagaagcgaagccaaggagggacttaaacgtggcgaaaccactaagcatgcagtctcaaggggtacagctaaactgcggtggtttgtggagcgcaatttggtaaagcctgagggcaaggtgatcgatctggggtgtggacgaggcgggtggtcctattactgcgccggactcaaaaaggttaccgaagtgaaaggctatactaagggtgggcccggacacgaggaaccgattccaatggcaacatacggctggaacatcgtcaaattacacagtggcagagacgtgttctttacccctcccgagaagtgtgatacgctgctttgcgacataggggaaagctctccaaatcccaccatcgaggagggaaggacactgcgggtcctaaaaatggtggaaccttggctccgcggtaaccaattctgtattaagatcctgaatccgtacatgccctccgttgtagagactttggaacagatgcagagaaagcatggcgggatgctggtgaggaacccactctcacgaaatagcacccacgagatgtattgggtctcgtgcggaacaggcaacattgtgtctgctgttaacatgactagtcggatgcttctgaatcgttttaccatggcccatagaaaacctacatacgagcgcgatgtggacttaggtgccgggaccaggcacgtcgcggtggaacccgagatcgctaacctggatattatcggacagcggatagaaaatattaagaacgagcacaaatccacttggcattatgacgaagataatccttacaagacgtgggcatatcacggcagctacgaggtaaaaccatcaggctccgcctctagcatggtgaacggggttgtcagattgctcacaaagccctgggacgtgatccctatggtgacccaaatcgctatgactgacaccacaccattcggacagcagcgcgtctttaaggagaaagttgatacgaggaccccccgaccgaagcggggtactgcccaaattatggaagtgacagcaaaatggctgtggggcttcctaagtagaaataagaaacctaggatatgtacccgcgaggaatttactcgtaaggtacggtccaacgccgctatcggggcggtgttcgtcgacgagaatcagtggaacagcgccaaggaagcagtggaggatgagagattttgggaccttgttcatagggaacgcgagctgcacaaacagggaaagtgcgctacatgcgtgtataatatgatgggcaaacgagaaaagaaactcggtgagttcgggaaggccaagggatctcgggcaatttggtacatgtggctgggcgccagattcttggaatttgaggctctgggcttcatgaacgaggatcattggttttcaagggaaaatagtctctccggggtcgagggagaaggtcttcacaaactgggctacatcttacgcgacattagcaagatcccagggggaaacatgtatgccgatgacaccgcgggctgggatacaagaataactgaggacgatctgcagaatgaggcaaaaatcaccgacattatggaacccgagcacgccttgctcgctacgtctatcttcaagctgacctaccaaaacaaagtggtacgggttcagaggcctgccaagtcgggtacagtgatggatgtcatttcacgtcgagaccagcgcgggagcggacaggtgggcacttatggcctaaacacctttacaaatatggaagtgcaacttatcagacagatggagtccgaagggatattcagtccatctgagctggagaacagcaatctcgcagaacgggtcctggactggttggagaaacatggagttgaaaggttaaagcgcatggctatttccggtgatgactgtgtggtaaagcccactgatgacagatttgccaccgctctgacggccctcaacgatatgggcaaagtgcggaaggacatcccgcagtgggagccttcaaaagggtggaatgattggcagcaagtccccttctgcagtcaccattttcaccagcttatcatgaaggacggaagggaaattgtggttccatgtcgaaaccaggatgagctggtgggccgtgcaagagtctctcagggtgcggggtggagcctacgcgagacagcctgcctgggaaaatcctacgctcaaatgtggcagctcatgtatttccaccggagggacttgagactggccgcaaatgctatatgttcagccgtgcctgtaaactgggttcccaccagccgcactacatggtctatccatgcacaccatcagtggatgaccactgaagatatgctttccgtgtggaatcgggtctggattgaggaaaacccatggatggaggacaagacccacgtgagtagctgggaagacgttccctacctgggcaagagggaggatcaatggtgcggctcgctcatcgggttaacagcccgagcgacgtgggctaccaatattcaggtggccatcaaccaggtcagacggctgataggaaatgagaactatttggactacatgacttccatgaaaaggtttaagaatgaatctgatcctgagggtgcactgtggtga

SEQ ID NO: 14215 - RNA, 9879 nt, synthetic construct
  misc_feature 1..9879: note = derived and/or modified CDS sequence (opt3) from DENV-1__KM403631__SS-prME
  source 1..9879: mol_type = other RNA
agcgtgaccatgctgctcatgcttctgcccaccgcattggctttccacttaactacgagaggaggggaacctcatatgatcgtctccaagcaagaaaggggaaaatctctgttatttaagacctcagccggtgttaacatgtgcacactcattgcaatggacctgggcgagctttgtgaagatactatgacctacaaatgcccacggataacagaggcggaaccggacgatgtggactgttggtgcaatgctaccgatacttgggtgacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactttggatatcgaactcctgaagacagaggtgaccaaccctgccgtgcttaggaaactgtgcattgaagctaagatctccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaagggggtgtcttatgtcatgtgtacaggatccttcaaattggagaaggaagtggctgagactcagcacggtaccgttctggtgcaggtaaagtacgagggcacggatgcgccttgcaaaataccaatcagcacacaagacgaaaagggggtcacccagaacggacgcctcattactgcaaatcccatcgtgacagataaagagaagcctataaacattgaaaccgagccacccttcggcgagtcgtatatcgttatcggtgccggggaaaaagctctgaaactttcttggtttaagaaaggctcctcaattggaaagatgttcgaggccactgcaagaggcgccaggcggatggctatcctgggggacaccgcctgggattttggaagtattggtggcgtgttcacaagcgtcgggaaattggtgcatcaggtatttggaacggcatacggcgtactcttctccggtgtttcttggaccatgaagatagggatcggcattctgttaacttggctgggactaaatagccgatcaacaagtctctccatgacctgtatcgcggtcggcatggtgacactgtaccttggggtgatggtccaggctgacagcggatgcgttatcaactggaaaggccgcgaattgaagtgtggttctgggatttttgtgactaacgaggtgcacacctggacggaacaatataagttccaggccgattcaccgaaaagactgagtgcagccataggaaaggcttgggaggagggcgtatgcggtatcaggagcgccacacggctcgaaaatattatgtggaaacagatctccaacgagctgaatcatattttactggaaaacgacatgaagtttaccgtcgtggttggcgacgcaaatgggatccttactcagggcaagaagatgatacgccctcaacccatggagcacaaatactcttggaagtcgtggggcaaggctaaaatcattggggccgatacccagaacacaactttcatcattgacggaccagatacccctgaatgtcccgacgatcagagagcgtggaatatctgggaggtggaggactatggctttggtgtcttcacaacgaacatatggttgaagctcagggatagctacacccagatgtgcgaccaccgtctgatgtccgccgctattaaagattcaaaggcagtgcatgccgacatggggtattggatcgaaagtgagaaaaatgaaacttggaagctagctcgggcctcttttattgaggttaagacatgtatctggccacgaagccacaccctgtggtccaacggagtgctcgaatcagagatgataatccccaaaatttacggcggtcctatcagccaacataattatagaccaggctacttcactcagacagcagggccgtggcacctgggaaaacttgagttggatttcaacctgtgcgaaggcaccacggtagtcgtggacgagcactgcgggaataggggaccctctttacgcactaccacagtgaccggcaaaattatccatgaatggtgttgccggtcctgtactctccctccactgagatttaggggtgaggatgggtgctggtacggaatggagatacgccccgtcaaggaaaaagaggaaaaccttgttcgaagtatggtgagcgcgggctctggtgaggtagactccttctcactgggcttgctctgtgtgagtattatgatcgaagaggtcatgcggagccgttggtcgagaaagatgctgatgacagggaccctagccgtgtttttcctgctcatcatgggacagctgacatggaatgaccttattaggttgtgcatcatggttggcgctaacgtgtccgatcgcatggggatgggaactacctatctggccttaatggcaacgtttaagatgcggcctatgttcgctgtcggcctcctgtttagaaggcttacatctcgagaggtgctgctactcaccattggtctgagcttggttgcctcagtggaactgccaaacagtttagaggaactcggggacggactggcaatgggcataatgatgcttaaactgttgactgatttccaatcccaccagctctggaccacactgctatctctgacttttatcaagaccacgcttagcctcgactacgcctggaaaacaatggctatggtcctgtccattgtatcattgttccccctgtgtttaagcaccacaagtcagaagacaacctggctcccggtgctgcttggctcttttgggtgcaaacctctgactatgttcttgatcacagagaataagatttggggacgcaagtcctggccactcaacgaaggtatcatggcggttggcatagtgagcatcctgctatcgtcactgcttaaaaatgatgtccccctcgccgggcctctgattgcaggaggcatgttgatcgcttgttatgtgatttctggtagttccgccgacttaagcctggagcgggccgctgaggtatcttgggaagaggaagcagagcatagcggggcctcccacaacatcctcgtggaagtccaggatgacggaaccatgaagataaaagatgaggagagagacgatacgctgactattcttctgaaggcgaccttgctagctgtttcaggcgtgtaccccatgagtatcccagccacactgtttgtgtggtatttctggcagaagaagaaacagaggagcggcgtcctctgggacaccccttctcccccagaagtggagcgtgcagttctggatgacgggatctaccgcattcttcagcggggattactgggtagatcccaggtaggcgtgggggtcttccaagacggagtgtttcatacaatgtggcacgttactaggggcgccgtgctcatgtatcagggtaagcgattggaaccgtcatgggctagtgtcaagaaagatctgataagctacgggggaggctggcggttccagggctcctggaataccggggaggaggtgcaggtaatcgcagtcgaacctggaaagaaccccaaaaatgtgcaaacgacaccaggtacttttaagacccccgagggcgaagttggggccattgcgctcgacttcaaacctggaacatctggctcgccaatcgtgaaccgcgagggtaagattgtcgggctgtacggaaatggcgtggttaccactagcggcacctatgtgtcagctatcgcccaggcaaaggcctcccaggaagggccccttcctgagatagaggatgaagtctttaaaaagagaaacctgacaatcatggacttgcacccgggaagtggtaaaacgaggcggtacctaccagctattgtgcgagaggccatcaagagaaaactgcgcactctcattttagcacccaccagggtagtggcttctgaaatggccgaggcgctgaagggcatgcctatccgttatcaaacaaccgccgttaagagcgaacatactgggaaagagatagtcgatcttatgtgccacgcaacattcaccatgcggctgctctccccagtgagagtgcccaattacaacatgattatcatggacgaggctcattttacggatcctgcctcaatcgctgcaaggggatatatttctactcgcgtcggcatgggtgaagccgccgctatcttcatgacagcgaccccgcccgggagcgtagaggcatttccacagagtaatgccgtgatacaggacgaagaacgagatattcctgaaagatcctggaacagcggatacgactggatcaccgatttccccggcaagactgtttggtttgtgccatctattaaatcaggcaatgacatcgctaactgtttgcggaagaacgggaaaagggtcatacagctgtcccgcaagacattcgacaccgagtatcaaaagactaagaataacgattgggactacgtggttactacggatattagtgagatgggagccaatttccgtgcagacagagtgatcgatcctcggaggtgcctcaagcccgtcatcctgaaagacggtccagaacgcgtgattcttgccggcccgatgcctgtaaccgctgcgagcgccgcacagcgaagagggcggatcggaaggaaccagaataaggagggcgatcagtacatttatatgggtcaacccctaaacaatgacgaagatcacgctcattggacagaggccaaaatgctgttggacaacataaatactccagaggggatcattcccgcattatttgaacctgagcgcgaaaagtcggccgctatcgatggcgagtacagactgaggggagaagcccggaagaccttcgtggagctcatgcgtcgcggcgacctgccagtttggctttcttataaagtcgcgtccgaggggtttcagtacagcgatcgaagatggtgcttcgacggagaaaggaacaatcaggtgctggaggaaaacatggacgtggagatctggacaaaggaaggtgagcggaaaaagctccgccccagatggttggatgcaaggacctattcagaccctctggccctacgggagtttaaagagttcgctgccggccgaagaagtgtctctggggatctgattctcgagataggaaaacttccgcagcacctgactttacgcgctcaaaatgcattggacaacctggttatgctccacaattccgaacagggcggtaaagcctacaggcatgctatggaggaactgccagatacgatcgagacccttatgctgctcgccttgattgcagtgctgacagggggcgtaactttatttttcctaagcggaaagggcctggggaagacctcaatcggactcctttgtgtgatggcgagtagcgtcctgttgtggatggcctccgtggagccccactggattgctgcctctatcatactggaatttttcctcatggttctgcttatccctgagcccgaccggcagcgtacaccacaggataaccaactcgcatatgtggtcattggtctgttgtttatgatcctgaccgtagctgccaacgaaatgggcttactagagactactaagaaggacctggggattggacatgtggttgcagagaatcaccaccatgccacgatgctcgatatcgaccttcaccctgctagcgcgtggaccctgtacgccgtggcaactacaataattacccccatgatgagacataccatcgaaaacacaactgctaatatttccttgacggccatcgccaaccaggcagctatactgatgggcctcgataaaggttggccaatctcaaagatggacattggggtccctctgcttgccttaggctgctactctcaggtgaatccgctgaccctcacagcggctgtcttgatgctggtggcccactatgcaatcattggacccggcctacaagccaaagctactagggaggcacagaagcgcaccgccgcggggatcatgaagaacccaacagttgatggaatagtggctattgacctggaccctgtagtgtacgatgccaaattcgaaaagcagctcggccagatcatgcttctgatcttgtgtaccagtcaaattctgctcatgcggactacgtgggcactgtgcgagtcgatcacattagccaccggtccccttactaccctgtgggaagggagcccaggaaaattttggaatacaactatagctgtctccatggccaacattttccgaggctcttatctcgccggtgctggcctagccttctcactgatgaaaagcctagggggaggcagaagggggaccggagcgcagggcgagacactgggtgagaaatggaagcgccagctcaatcagctttccaagagtgaatttaacacgtacaaacggtctgggatcatggaggttgacagaagcgaagccaaggagggactgaaacgtggcgaaaccactaagcatgcagtgtcaaggggtacagctaaattgcggtggttcgtcgagcgcaatctggtgaagcctgagggcaaggtaattgatctcgggtgtggacgaggcgggtggtcctattactgcgccggactgaaaaaggtgaccgaagttaaaggctatactaagggtgggcccggacacgaggaaccgatcccaatggcaacatacggctggaacatagtgaaactacacagtggcagagacgtctttttcacccctcccgagaagtgtgatacgcttctgtgcgacatcggggaaagctctccaaatcccaccattgaggagggaaggacactacgggtgctcaaaatggtcgaaccttggctgcgcggtaaccaattttgtatcaagattttgaatccgtacatgccctccgtggttgagactctggaacagatgcagagaaagcatggcgggatgctcgtaaggaacccactttcacgaaatagcacccacgagatgtattgggtgtcgtgcggaacaggcaacatcgtctctgctgtgaacatgacaagtcggatgctgttaaatcgtttcaccatggcccatagaaaacctacatacgagcgcgatgttgacctgggtgccgggaccaggcacgtggcggtcgaacccgagattgctaacttggatatcataggacagcggattgaaaatatcaagaacgagcacaaatccacttggcattatgacgaagataatccttacaagacgtgggcatatcacggcagctacgaggtgaaaccatcaggctccgcctctagcatggtaaacggggtggttagactcctgacaaagccctgggacgtcatccctatggtgacccaaattgctatgactgacaccacaccatttggacagcagcgcgtgttcaaggagaaagtcgatacgaggacaccccgaccgaagcggggtactgcccaaataatggaagttacagcaaaatggctatggggctttcttagtagaaataagaaacctaggatctgtacccgcgaggagttcactcgtaaggtgcggtccaacgccgctattggggcggtatttgtggacgagaatcagtggaacagcgccaaggaagcagtcgaggatgagagattctgggacctggtgcatagggaacgcgagctccacaaacagggaaagtgcgctacatgcgtttataatatgatgggcaaacgagaaaagaaactgggtgagtttgggaaggccaagggatctcgggcaatctggtacatgtggttgggcgccagattcctggagttcgaggctctcggctttatgaacgaggatcattggttctcaagggaaaatagtctttccggggtggagggagaaggtctgcacaaattaggctacattctgcgcgacatcagcaagataccagggggaaacatgtatgccgatgacaccgcgggctgggatacaagaatcactgaggacgatttgcagaatgaggcaaaaattaccgacatcatggaacccgagcacgccctcctggctacgtctatttttaagctaacctaccaaaacaaagtcgtgcgggtacagaggcctgccaagtcgggtacagttatggatgtgatctcacgtcgagaccagcgcgggagcggacaggtcggcacttatggccttaacaccttcacaaatatggaagtgcaactgataagacagatggagtccgaagggatttttagtccatctgagctcgagaacagcaatctggcagaacgggtgttggactggttagagaaacatggagtcgaaaggctgaagcgcatggctatctccggtgatgactgtgttgtgaagcccactgatgacagattcgccaccgctctcacggcccttaacgatatgggcaaagtacggaaggacatcccgcagtgggagccttcaaaagggtggaatgattggcagcaagtgcccttttgcagtcaccatttccaccagctgattatgaaggacggaagggaaatagtcgtgccatgtcgaaaccaggatgagctagttggccgtgcaagagtgtctcagggtgcggggtggagcctgcgcgagacagcctgcctcggaaaatcctacgctcaaatgtggcagttgatgtattttcaccggagggacctgagacttgccgcaaatgctatctgttcagccgtccctgtgaactgggtacccaccagccgcactacatggtctattcatgcacaccatcagtggatgaccactgaagatatgctgtccgtttggaatcgggtgtggatcgaggaaaacccatggatggaggacaagacccacgtcagtagctgggaagacgtgccctacctcggcaagagggaggatcaatggtgcggctcgttaattgggctgacagcccgagcgacgtgggctaccaatatccaggttgccataaaccaggtgagacggttgatcggaaatgagaactatctggactacatgacttccatgaaaaggttcaagaatgaatctgatcctgagggtgcactctggtga

SEQ ID NO: 14216 - RNA, 9879 nt, synthetic construct
  misc_feature 1..9879: note = derived and/or modified CDS sequence (opt3) from DENV-1__KM403632__SS-prME
  source 1..9879: mol_type = other RNA
agcgtgaccatgctgctcatgcttctgcccactgcattggctttccacttaactacgagaggaggggaacctcatatgatcgtctccaagcaggaaaggggaaaatctctgttgtttaagacctcagccggtgttaacatgtgcactctcattgcaatggacctgggcgaactttgtgaagatactatgacctacaaatgcccacggataaccgaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggttgacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaggtgcgtaaccaagctggaggggaaaatagtgcagtacgaaaacctcaagtattccgtcattgtgacagttcacaccggagatcagcatcaagtgggtaatgagactacggaacacggcacaatcgccaccattactccccaggcgcctacctcagagatccagcttacagactacggggccctgaccttggactgtagtccacggactggactagatttcaacgaaatggtcctgctcacaatgaaagagaaaagctggctggtgcataaacagtggtttcttgacctgccgttgccctggacgtctggcgcatccacctcacaagaaacttggaatcgtcaggatctcctggtaacattcaagaccgctcacgccaaaaagcaggaagttgtggtcttaggtagccaagagggggctatgcacacagccctgactggcgcaaccgaaatccagacgagtggaaccacaactatttttgccggccatctaaagtgccgcctcaaaatggacaagctgacccttaaaggggtgtcttatgtcatgtgtacaggatccttcaagttggagaaagaagtggctgagactcagcacggtaccgttctggtgcaggtaaagtacgagggcacggatgcgccttgcaagataccaatcagcacacaagacgaaaaaggggtcacccagaacggaagactcattactgcaaatcccatcgtgacagataaggagaaacctgttaacatagaaaccgagccacccttcggcgagtcgtatattgtgatcggtgccggggaaaaggctctgaaactttcttggtttaagaagggctcctcaatcggaaaaatgttcgaggccactgcaaggggcgcccggcgaatggctattctgggggacaccgcctgggattttggaagtatcggtggcgtcttcacaagcgtggggaagttggtacatcaggtgtttggaacggcatacggcgttctcttctccggtgtctcttggaccatgaaaattgggataggcatcctgttaacttggctgggactaaatagccgctcaacaagtctctccatgacctgtattgcggtgggcatggtgacactgtaccttggggtcatggttcaggctgacagcggatgcgtgatcaactggaagggcagagaattgaaatgtggttctgggatctttgtgactaacgaggtacacacctggacggaacaatataagttccaggccgattcaccgaagaggctgagtgcagccattggaaaggcttgggaggagggcgtctgcggtatacggagcgccacacgcctcgaaaatatcatgtggaagcagatttccaacgagctgaatcatatcttactggaaaacgacatgaaatttaccgtggttgtgggcgacgcaaatgggattcttactcagggaaagaaaatgatcagacctcaacccatggagcacaagtactcttggaaatcgtggggcaaggctaagataatcggggccgatacccagaacacaactttcattatcgacggaccagatacccctgaatgtcccgacgatcagagggcgtggaatatttgggaggtcgaggactatggctttggtgtgttcacaacgaacatctggttgaaactccgtgatagctacacccagatgtgcgaccaccggctgatgtccgccgctataaaggattcaaaagcagttcatgccgacatggggtattggattgaaagtgagaagaatgaaacttggaaactagctcgagcctcttttatcgaggtgaagacatgtatttggccaagaagccacaccctgtggtccaacggagtactcgaatcagagatgatcatacccaagatctacggcggtcctattagccaacataattataggccaggctacttcactcagacagcagggccgtggcacctgggaaaacttgagttggatttcaacctgtgcgaaggcaccacggtcgtggtggacgagcactgcgggaatcgcggaccctctttacggactaccacagtcaccggcaagatcattcatgaatggtgttgcagatcctgtactctccctccactgaggtttcgcggtgaggatgggtgctggtacggaatggagatccgacccgttaaagaaaaggaggaaaaccttgtgcggagtatggtaagcgcgggctctggtgaggtggactccttctcactgggcttgctctgtgtcagtataatgattgaagaggtgatgcgtagcagatggtcgaggaaaatgctgatgacagggaccctagccgtatttttcctgctcatcatgggacagctgacatggaatgaccttatccgcttgtgcattatggtgggcgctaacgtctccgatcggatggggatgggaactacctatctggccttaatggcaacgtttaagatgagacctatgttcgctgtgggcctcctgtttaggcgacttacatctcgcgaggttctgctactcaccatcggtctgagcttggtggcctcagtcgaactgccaaacagtttagaggaactcggggacggactggcaatgggcattatgatgcttaagctgttgactgatttccaatcccaccagctctggaccacactgctatctctgacttttataaaaaccacgcttagcctcgactacgcctggaagacaatggctatggtactgtccatcgtgtcattgttccccctgtgtttaagcaccacaagtcagaaaacaacctggctcccggttctgcttggctcttttgggtgcaagcctctgactatgttcttgattacagagaataaaatctggggacggaagtcctggccactcaacgaaggtattatggcggtgggcatcgtcagcatactgctatcgtcactgcttaagaatgatgtgcccctcgccgggcctctgatcgcaggaggcatgttgattgcttgttatgtaatctctggtagttccgccgacttaagcctggagagagccgctgaggtgtcttgggaagaggaagcagagcatagcggggcctcccacaacattctcgtcgaagttcaggatgacggaaccatgaaaatcaaggatgaggagagggacgatacgctgactatacttctgaaagcgaccttgctagctgtgtcaggcgtgtaccccatgagtattccagccacactgtttgtctggtatttctggcaaaagaaaaagcagcgtagcggcgtgctctgggacaccccttctcccccagaagttgagcgcgcagtactggatgacgggatctaccggatccttcagagaggattactgggtaggtcccaggtgggcgtcggggtgttccaagacggagtttttcatacaatgtggcacgtgactcgaggcgccgtcctcatgtatcagggtaaacggttggaaccgtcatgggctagtgtgaagaaggatctgattagctacgggggaggctggcgcttccagggctcctggaataccggggaggaggtacaggtcatagcagtggaacctggcaaaaaccccaagaatgttcaaacgacaccaggtacttttaaaacccccgagggcgaagtgggggccatcgcgctcgacttcaagcctggaacatctggctcgccaattgtcaacagagagggtaaaatcgtggggctgtacggaaatggcgttgtgaccactagcggcacctatgtctcagctattgcccaggcaaaggcctcccaggaagggccccttcctgagatcgaggatgaagtgtttaagaaaaggaacctgacaataatggacttgcacccgggaagtggtaagacgcggcgatacctaccagctatcgtaagagaggccattaaacgcaagctgaggactctcatcttagcacccacccgtgtggttgcttctgaaatggccgaggcgctgaaaggcatgcctattcggtatcaaacaaccgccgtcaagagcgaacatactgggaaggagatcgtggatcttatgtgccacgcaacattcaccatgagactgctctccccagtgagggtccccaattacaacatgataattatggacgaggctcattttacggatcctgcctcaatcgctgcacgcggatatatctctactcgagtaggcatgggtgaagccgccgctattttcatgacagcgaccccgcccgggagcgtggaggcatttccacagagtaatgccgttatccaggacgaagagagagatatacctgaacggtcctggaacagcggatacgactggattaccgatttccccggcaaaactgtgtggtttgtcccatctatcaagtcaggcaatgacattgctaactgtttgaggaaaaacgggaagcgcgtgatccagctgtcccgtaaaacattcgacaccgagtatcaaaagacaaagaataacgattgggactacgttgtgactacggatataagtgagatgggagccaatttcagagcagaccgggtcattgatcctaggcgctgcctcaaacccgtgatcctgaaggacggtccagaacgagtaatccttgccggcccgatgcctgtgaccgctgcgagcgccgcacagagacgggggaggattggacgcaaccagaataaagagggcgatcagtacatctatatgggtcaacccctaaacaatgacgaagatcacgctcattggacagaggccaagatgctgttggacaacattaatactccagaggggataatccccgcattatttgaacctgagagagaaaaatcggccgctattgatggcgagtacaggctgcggggagaagcccgtaagaccttcgttgagctcatgcgccgaggcgacctgccagtctggctttcttataaggtggcgtccgaggggtttcagtacagcgatagaaggtggtgcttcgacggagaacggaacaatcaggtgctggaggaaaacatggacgtcgagatctggacaaaagaaggtgagcgcaagaaactcagacccaggtggttggatgcacggacctattcagaccctctggccctacgagagtttaaggagttcgctgccggcagacgcagtgtttctggggatctgatcctcgagattggaaaacttccgcagcacctgactttaagggctcaaaatgcattggacaacctggtgatgctccacaattccgaacagggcggtaaggcctaccggcatgctatggaggaactgccagatacgatagagacccttatgctgctcgccttgatcgcagtactgacagggggcgtgactttatttttcctaagcggaaaaggcctggggaagacctcaattggactcctttgtgtcatggcgagtagcgtgctgttgtggatggcctccgttgagccccactggatcgctgcctctattatcctggaatttttcctcatggtgctgcttatacctgagcccgaccgtcagagaacaccacaggataaccaactcgcatatgtcgtaatcggtctgttgtttatgattctgaccgtggctgccaacgaaatgggcttactagagactacaaagaaagacctggggatcggacatgttgtggcagagaatcaccaccatgccacgatgctcgatattgaccttcaccctgctagcgcgtggaccctgtacgccgtcgcaactacaatcataacccccatgatgaggcataccattgaaaacacaactgctaatatctccttgacggccattgccaaccaggcagctatcctgatgggcctcgataagggttggccaatatcaaaaatggacatcggggtgcctctgcttgccttaggctgctactctcaggtcaatccgctgaccctcacagcggctgtgttgatgctggttgcccactatgcaattatcggacccggcctacaagccaaggctactcgcgaggcacagaaacggaccgccgcggggattatgaagaacccaacagtggatggaatcgtagctatagacctggaccctgtggtctacgatgccaagttcgaaaaacagctcggccagattatgcttctgatcttgtgtaccagtcaaatcctgctcatgcgaactacgtgggcactgtgcgagtcgattacattagccaccggtccccttactaccctgtgggaagggagcccaggaaagttttggaatacaactatcgctgtttccatggccaacatattcagaggctcttatctcgccggtgctggcctagccttctcactgatgaaaagcctagggggaggcaggcgcgggaccggagcgcagggcgagacactgggtgagaagtggaaacggcagctcaatcagctttccaagagtgaatttaacacgtacaagagatctgggattatggaggtggaccgtagcgaagccaaagagggactgaagaggggcgaaaccactaaacatgcagtctcacggggtacagctaagttgcgctggttcgtggagcgaaatctggtaaaacctgagggcaaggtgatcgatctcgggtgtggaagaggcgggtggtcctattactgcgccggattaaagaaagttaccgaagtgaagggctatactaaaggtgggcccggacacgaggaaccgattccaatggcaacatacggctggaacatcgtcaagctgcacagtggcagggacgtgtttttcacccctcccgagaaatgtgatacgcttctgtgcgacataggggaaagctctccaaatcccaccatcgaggagggacggacactacgcgtcctcaagatggtggaaccttggctgagaggtaaccaattttgtattaaaatcttgaatccgtacatgccctccgttgtagagactctggaacagatgcagaggaagcatggcgggatgctcgtgcgaaacccactttcacggaatagcacccacgagatgtattgggtctcgtgcggaacaggcaacattgtgtctgctgttaacatgacaagtcgtatgctgttaaatagattcaccatggcccatcgcaagcctacatacgagagggatgtggacctgggtgccgggacccggcacgtcgcggtggaacccgagatcgctaacttggatattatcggacagagaatagaaaatattaaaaacgagcacaagtccacttggcattatgacgaagataatccttacaaaacgtgggcatatcacggcagctacgaggtaaagccatcaggctccgcctctagcatggtgaacggggttgtccgcctcctgacaaaaccctgggacgtgatccctatggtgacccaaatcgctatgactgacaccacaccatttggacagcagagggtcttcaaggagaaggttgatacgcgaacaccccggccgaaaagaggtactgcccaaattatggaagtgacagcaaagtggctatggggctttcttagtaggaataaaaagcctcgcatatgtacccgtgaggagttcactcggaaagtaagatccaacgccgctatcggggcggtgtttgtcgacgagaatcagtggaacagcgccaaggaagcagtggaggatgagaggttctgggacctggttcatcgcgaacgagagctccacaagcagggaaaatgcgctacatgcgtgtataatatgatgggcaagcgggagaagaaactgggtgagtttgggaaagccaagggatctagagcaatttggtacatgtggttgggcgccaggttcctggagttcgaggctctcggctttatgaacgaggatcattggttctcacgcgaaaatagtctttccggggtcgagggagaaggtctgcacaagttaggctacatcctgagagacattagcaaaatcccagggggaaacatgtatgccgatgacaccgcgggctgggatacacggataactgaggacgatttgcagaatgaggcaaagatcaccgacattatggaacccgagcacgccctcctggctacgtctatctttaaactaacctaccaaaacaaggtggtaagggttcagcgtcctgccaaatcgggtacagtgatggatgtcatttcacgacgcgaccagagagggagcggacaggtgggcacttatggccttaacaccttcacaaatatggaagtgcaactgatccggcagatggagtccgaagggatatttagtccatctgagctcgagaacagcaatctggcagaaagggtcttggactggttagagaagcatggagttgaacgcctgaaaagaatggctatttccggtgatgactgtgtggtaaagcccactgatgaccggttcgccaccgctctcacggcccttaacgatatgggcaaggtgaggaaagacatcccgcagtgggagccttcaaaggggtggaatgattggcagcaagtccccttttgcagtcaccatttccaccagctgatcatgaaagacggacgagaaattgtggttccatgtcgtaaccaggatgagctagtgggcagagcacgcgtctctcagggtgcggggtggagcctgcgggagacagcctgcctcggaaagtcctacgctcaaatgtggcagttgatgtattttcacaggagagacctgcgccttgccgcaaatgctatatgttcagccgtgcctgtaaactgggttcccaccagccggactacatggtctatccatgcacaccatcagtggatgaccactgaagatatgctgtccgtgtggaatagggtctggattgaggaaaacccatggatggaggacaaaacccacgtgagtagctgggaagacgttccctacctcggcaagcgagaggatcaatggtgcggctcgttaatcgggctgacagccagagcgacgtgggctaccaatattcaggtggccatcaaccaggtccggaggttgataggaaatgagaactatctggactacatgacttccatgaagcgcttcaaaaatgaatctgatcctgagggtgcactctggtga

SEQ ID NO: 14217 - RNA, 9879 nt, synthetic construct
  misc_feature 1..9879: note = derived and/or modified CDS sequence (opt3) from DENV-1__KM403583__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagaccgtagaagcgtggccctggcaccccatgtcggcttgggtctcgagactaggaccgaaacatggatgtcctctgagggggcctggcggcagatccagcgcgtggaaacttgggctctgagacaccctggattcaccgttattgcactgtttctcgcccatgctatcggcacatcgattacccagaagggcatcatattcatcttactgatgcttgtgacgccatcaatggccatgaggtgcgtcgggattggaaaccgggattttgtggagggtttgagcggcgcgacttgggtagacgttgtgctggagcacgggagttgtgtcacaaccatggcaaaaaataagcccactctagatatcgaactcctgaagacagaggtgaccaaccctgccgtgcttcgcaaactgtgcattgaagctaagatctccaatacgaccacagactctcgatgtccaactcaaggagaggccaccttggtcgaagagcaggatgcaaacttcgtttgcagaaggacatttgtggaccggggctggggtaatgggtgtggactcttcggcaaaggcagcctgttaacttgcgctaagtttaaatgcgtaaccaagctggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccacgtactggactagatttcaacgaaatggtcctgctcacaatgaaggagaaaagctggctggtgcataagcagtggtttcttgacctgccgttgccctggacgtctggcgcatccacctcacaagagacttggaatcgccaggatctcctggtaacattcaaaaccgctcacgccaagaaacaggaagttgtggtcttaggtagccaagagggggctatgcacacagccctgactggcgcaaccgaaatccagacgagtggaaccacaactatttttgccggccatctaaagtgcagactcaagatggacaaactgacccttaagggggtgtcttatgtcatgtgtacaggatccttcaaattggagaaggaagtggctgagactcagcacggtaccgttctggtgcaggtaaaatacgagggcacggatgcgccttgcaagataccaatcagcacacaagacgaaaagggggtcacccagaacggaaggctcattactgcaaatcccatcgtgacagataaagagaagcctgttaacatagaaaccgagccacccttcggcgagtcgtatattgtgatcggtgccggggaaaaagctctgaagctttcttggtttaaaaagggctcctcaatcggaaagatgttcgaggccactgcacggggcgcccgacgcatggctattctgggggacaccgcctgggattttggaagtatcggtggcgtcttcacaagcgtggggaaattggtacatcaggtgtttggaacggcatacggcgttctcttctccggtgtctcttggaccatgaagattgggataggcatcctgttaacttggctgggactaaatagcagatcaacaagtctctccatgacctgtattgcggtgggcatggtgacactgtaccttggggtcatggttcaggctgacagcggatgcgtgatcaactggaaaggcagggaattgaagtgtggttctgggatctttgtgactaacgaggtacacacctggacggaacaatataaattccaggccgattcaccgaagcggctgagtgcagccattggaaaggcttgggaggagggcgtctgcggtatacgcagcgccacaagactcgaaaatatcatgtggaaacagatttccaacgagctgaatcatatcttactggaaaacgacatgaagtttaccgtggttgtgggcgacgcaaatgggattcttactcagggaaaaaagatgatcaggcctcaacccatggagcacaaatactcttggaagtcgtggggcaaagctaagataatcggggccgatacccagaacacaactttcattatcgacggaccagatacccctgaatgtcccgacgatcagcgtgcgtggaatatttgggaggtcgaggactatggctttggtgtgttcacaacgaacatctggttgaagctccgggatagctacacccagatgtgcgaccaccgactgatgtccgccgctataaaagattcaaaggcagttcatgccgacatggggtattggattgaaagtgagaaaaatgaaacttggaagctagctagagcctcttttatcgaggtgaaaacatgtatttggccaaggagccacaccctgtggtccaacggagtactcgaatcagagatgatcatacccaagatctacggcggtcctattagccaacataattatcgcccaggctacttcactcagacagcagggccgtggcacctgggaaagcttgagttggatttcaacctgtgcgaaggcaccacggtcgtggtggacgagcactgcgggaatcggggaccctctttaagaactaccacagtcaccggcaaaatcattcatgaatggtgttgcaggtcctgtactctccctccactgcgctttcgaggtgaggatgggtgctggtacggaatggagatccggcccgttaaggaaaaagaggaaaaccttgtgcgtagtatggtaagcgcgggctctggtgaggtggactccttctcactgggcttgctctgtgtcagtataatgattgaagaggtgatgagaagcaggtggtcgcgcaagatgctgatgacagggaccctagccatctttttcctgctcatcatgggacagctgacatggaatgaccttattcggttgtgcatcatggttggcgctaacgtgtccgatagaatggggatgggaactacctatctggccttaatggcaacgtttaaaatgaggcctatgttcgctgtcggcctcctgtttcgacgccttacatctcgggaggtgctgctactcaccattggtctgagcttggttgcctcagtggaactgccaaacagtttagaggaactcggggacggactggcaatgggcataatgatgcttaagctgttgactgatttccaatcccaccagctctggaccacactgctatctctgacttttatcaagaccacgcttagcctcgactacgcctggaaaacaatggctatggtcctgtccattgtatcattgttccccctgtgtttaagcaccactagtcagaagacaacctggctcccggtgctgcttggctcttttgggtgcaaacctctgactatgttcttgatcacagagaataagatttggggaagaaaatcctggccactcaacgaaggtatcatggcggttggcatagtgagcatcctgctatcgtcactgcttaagaatgatgtccccctcgccgggcctctgattgcaggaggcatgttgatcgcttgttatgtgatttctggtagttccgccgacttaagcctggagagggccgctgaggtatcttgggaagaggaagcagagcatagcggggcctcccacaacatcctcgtggaagtccaggatgacggaaccatgaagataaaagatgaggagcgtgacgatacgctgactattcttctgaaggcgaccttgctagctgtttcaggcgtgtaccccatgagtatcccagccacactgtttgtgtggtatttctggcaaaaaaagaaacagcgcagcggcgtcctctgggacaccccttctcccccagaagtggagcgggcagttctggatgacgggatctacagaattcttcagaggggattactgggtcgatcccaggtaggcgtgggggtcttccaagacggagtgtttcatacaatgtggcacgttactcggggcgccgtgctcatgtatcagggtaagcgcttggaaccgtcatgggctagtgtcaaaaaggatctgataagctacgggggaggctggagattccagggctcctggaataccggggaggaggtgcaggtaatcgcagtcgaacctggaaagaaccccaaaaatgtgcaaacgacaccaggtacttttaagacccccgagggcgaagttggggccattgcgctcgacttcaaacctggaacatctggctcgccaatcgtgaacagggagggtaagattgtcgggctgtacggaaatggcgtggttaccactagcggcacctatgtgtcagctatcgcccaggcaaaagcctcccaggaagggccccttcctgagatagaggatgaagtctttaagaagcggaacctgacaatcatggacttgcacccgggaagtggtaaaacgcgaagatacctaccagctattgtgcgcgaggccatcaagaggaaactgcgtactctcattttagcacccacccgggtagtggcttctgaaatggccgaggcgctgaagggcatgcctatcagatatcaaacaaccgccgttaaaagcgaacatactgggaaggagatagtcgatcttatgtgccacgcaacattcaccatgaggctgctctccccagtgcgcgtgcccaattacaacatgattatcatggacgaggctcattttacggatcctgcctcaatcgctgcacgaggatatatttctactagagtcggcatgggtgaagccgccgctatcttcatgacagcgaccccgcccgggagcgtagaggcatttccacagagtaatgccgtgatacaggacgaagagcgggatattcctgaaaggtcctggaacagcggatacgactggatcaccgatttccccggcaagactgtttggtttgtgccatctattaaatcaggcaatgacatcgctaactgtttgcgcaagaacgggaaacgtgtcatacagctgtccagaaagacattcgacaccgagtatcaaaaaacaaagaataacgattgggactacgtggttactacggatattagtgagatgggagccaatttccgggcagacagggtgatcgatcctcgccgatgcctcaagcccgtcatcctgaaagacggtccagaaagagtgattcttgccggcccgatgcctgtaaccgctgcgagcgccgcacagcggagggggcgcatcggaagaaaccagaataaggagggcgatcagtacatttatatgggtcaacccctaaacaatgacgaagatcacgctcattggacagaggccaaaatgctgttggacaacataaatactccagaggggatcattcccgcattatttgaacctgagagggaaaagtcggccgctatcgatggcgagtaccggctgcgtggagaagcccgcaaaaccttcgtggagctcatgcgaagaggcgacctgccagtttggctttcttataaggtcgcgtccgaggggtttcagtacagcgataggcggtggtgcttcgacggagaacgcaacaatcaggtgctggaggaaaacatggacgtggagatctggacaaaggaaggtgagagaaaaaagctcaggccccggtggttggatgcacgaacctattcagaccctctggccctaagagagtttaaagaattcgctgccggccgcaggagtgtctctggggatctgattctcgagataggaaagcttccgcagcacctgactttacgggctcaaaatgcattggacaacctggttatgctccacaattccgaacagggcggtaaagcctaccgtcatgctatggaggaactgccagatacgatcgagacccttatgctgctcgccttgattgcagtgctgacagggggcgtaactttatttttcctaagcggaaagggcctggggaaaacctcaatcggactcctttgtgtgatggcgagtagcgtcctgttgtggatggcctccgtggagccccactggattgctgcctctatcatactggaatttttcctcatggttctgcttatccctgagcccgacagacagaggacaccacaggataaccaactcgcatatgtggtcattggtctgttgtttatgatcctgaccgtagctgccaacgaaatgggcttactagagactacaaagaaggacctggggattggacatgtggttgcagagaatcaccaccatgccacgatgctcgatatcgaccttcaccctgctagcgcgtggaccctgtacgccgtggcaactacaataattacccccatgatgcgccataccatcgaaaacacaactgctaatatttccttgacggccatcgccaaccaggcagctatactgatgggcctcgataaaggttggccaatctcaaagatggacattggggtccctctgcttgccttaggctgctactctcaggtgaatccgctgaccctcacagcggctgtcttgatgctggtggcccactatgcaatcattggacccggcctacaagccaaagctactcgggaggcacagaagcgaaccgccgcggggatcatgaaaaacccaacagttgatggaatagtggctattgacctggaccctgtagtgtacgatgccaagttcgaaaagcagctcggccagatcatgcttctgatcttgtgtaccagtcaaattctgctcatgagaactacgtgggcactgtgcgagtcgatcacattagccaccggtccccttactaccctgtgggaagggagcccaggaaaattttggaatacaactatagctgtctccatggccaacattttcaggggctcttatctcgcaggtgctggcctagccttctcactgatgaagagcttggggggaggccgccgggggaccggagcgcagggcgagacactgggtgagaaatggaagagacagctcaatcagctttccaaaagtgaatttaacacgtacaagcgttctgggatcatggaggttgacaggagcgaagccaaggagggactgaaacggggcgaaaccactaagcatgcagtgtcacgcggtacagctaaattgcgatggttcgtcgagagaaatctggtgaagcctgagggcaaagtaattgatctcgggtgtggaaggggcgggtggtcctattactgcgccggattaaagaaggtgaccgaagttaaaggctatactaagggtgggcccggacacgaggaaccgatcccaatggcaacatacggctggaacatagtgaaactgcacagtggccgggacgtctttttcacccctcccgagaagtgtgatacgcttctgtgcgacatcggggaaagctctccaaatcccaccattgaggagggacgcacactaagagtgctcaaaatggtcgaaccttggctgaggggtaaccaattttgtatcaagattttgaatccgtacatgccctccgtggttgagactctggaacagatgcagcgaaaacatggcgggatgctcgtacggaacccactttcacgtaatagcacccacgagatgtattgggtgtcgtgcggaacaggcaacatcgtctctgctgtgaacatgactagtagaatgctgttaaatcgcttcaccatggcccataggaagcctacatacgagcgggatgttgacctgggtgccgggaccagacacgtggcggtcgaacccgagattgctaacttggatatcataggacagcgcattgaaaatatcaagaacgagcacaaatccacttggcattatgacgaagataatccttacaagacgtgggcatatcacggcagctacgaggtgaaaccatcaggctccgcctctagcatggtaaacggggtggttaggctcctgacaaagccctgggacgtcatccctatggtgacccaaattgctatgactgacaccacaccatttggacagcagcgagtgttcaaagagaaggtcgatacgcggacccccagaccgaagaggggtactgcccaaataatggaagttacagcaaaatggctatggggctttcttagtcgcaataagaaacctcgtatctgtacccgggaggaattcactagaaaggtgaggtccaacgccgctattggggcggtatttgtggacgagaatcagtggaacagcgccaaagaagcagtcgaggatgagcgcttctgggacctggtgcatcgagaacgggagctccacaagcagggaaagtgcgctacatgcgtttataatatgatgggcaaaagagaaaagaaactgggtgagtttgggaaggccaaaggatctagggcaatctggtacatgtggttgggcgcccgcttcctggaattcgaggctctcggctttatgaacgaggatcattggttctcaagagaaaatagtctttccggggtggagggagaaggtctgcacaagttaggctacattctgcgggacatcagcaagataccagggggaaacatgtatgccgatgacaccgcgggctgggatacaaggatcactgaggacgatttgcagaatgaggcaaaaattaccgacatcatggaacccgagcacgccctcctggctacgtctatttttaagctaacctaccaaaacaaagtcgtgcgtgtacagcgacctgccaagtcgggtacagttatggatgtgatctcacgcagagaccagcgggggagcggacaggtcggcacttatggccttaacaccttcacaaatatggaagtgcaactgataaggcagatggagtccgaagggatttttagtccatctgagctcgagaacagcaatctggcagaacgcgtgttggactggttagagaaacatggagtcgaaagactgaagcggatggctatctccggtgatgactgtgttgtgaaacccactgatgacaggttcgccaccgctctcacggcccttaacgatatgggcaaggtacgaaaggacatcccgcagtgggagccttcaaaagggtggaatgattggcagcaagtgcccttttgcagtcaccatttccaccagctgattatgaaggacggacgtgaaatagtcgtgccatgtagaaaccaggatgagctagttggccgcgcacgggtgtctcagggtgcggggtggagcctgagggagacagcctgcctcggaaaatcctacgctcaaatgtggcagttgatgtattttcacagacgcgacctgcggcttgccgcaaatgctatctgttcagccgtccctgtgaactgggtacccaccagcaggactacatggtctattcatgcacaccatcagtggatgaccactgaagatatgctgtccgtttggaatcgagtgtggatcgaggaaaacccatggatggaggacaagacccacgtcagtagctgggaagacgtgccctacctcggcaaaagagaggatcaatggtgcggctcgttaattgggctgacagcccgggcgacgtgggctaccaatatccaggttgccataaaccaggtgaggcgcttgatcggaaatgagaactatctggactacatgacttccatgaagcgtttcaagaatgaatctgatcctgagggtgcactctggtga

SEQ ID NO: 14218 - RNA, 9879 nt, synthetic construct
  misc_feature 1..9879: note = derived and/or modified CDS sequence (opt3) from DENV-1__KM403579__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaagggggtgtcttatgtcatgtgtacaggatccttcaaattggagaaggaagtggctgagactcagcacggtaccgttctggtgcaggtaaagtacgagggcacggatgcgccttgcaaaataccaatcagcacacaagacgaaaagggggtcacccagaacggacgcctcattactgcaaatcccatcgtgacagataaagagaagcctgttaacatagaaaccgagccacccttcggcgagtcgtatattgtgatcggtgccggggaaaaagctctgaagctttcttggtttaagaaaggctcctcaatcggaaagatgttcgaggccactgcaagaggcgccaggcggatggctattctgggggacaccgcctgggattttggaagtatcggtggcgtcttcacaagcgtggggaaattggtacatcaggtgtttggaacggcatacggcgttctcttctccggtgtctcttggaccatgaagattgggataggcatcctgttaacttggctgggactaaatagccgatcaacaagtctctccatgacctgtattgcggtgggcatggtgacactgtaccttggggtcatggttcaggctgacagcggatgcgtgatcaactggaaaggccgcgaattgaagtgtggttctgggatctttgtgactaacgaggtacacacctggacggaacaatataagttccaggccgattcaccgaaaagactgagtgcagccattggaaaggcttgggaggagggcgtctgcggtataaggagcgccacacggctcgaaaatatcatgtggaaacagatttccaacgagctgaatcatatcttactggaaaacgacatgaagtttaccgtggttgtgggcgacgcaaatgggattcttactcagggaaaaaagatgatccgccctcaacccatggagcacaaatactcttggaagtcgtggggcaaggctaaaataatcggggccgatattcagaacaccacattcatcattgacggaccagatactcctgaatgtcccgacgatcagagagcgtggaatatctgggaggtcgaggactatggctttggtgtgttcaccacaaacatatggttgaagctcagggatagctacacgcagatgtgcgaccaccgtctgatgtccgccgctattaaagattcaaaggcagttcatgccgacatggggtattggatcgaaagtgagaaaaatgaaacctggaagctagctcgggcctcttttattgaggtgaagacttgtatctggccacgaagccacacactgtggtccaacggagtactcgaatcagagatgataatccccaaaatttacggcggtcctatcagccaacataattatagaccaggctacttcacccagactgcagggccgtggcacctgggaaagcttgagttggatttcaacctgtgcgaaggcacaaccgtcgtggtggacgagcactgcgggaataggggaccctctttacgcacgactaccgtcacaggcaaaattatccatgaatggtgttgccggtcctgtaccctccctccactgagatttaggggtgaggatgggtgctggtacggaatggagatacgccccgttaaggaaaaagaggaaaaccttgtgcgaagtatggtaagcgcgggctctggtgaggtggactccttctcactgggcttgctctgtgtcagtattatgatcgaagaggtgatgcggagccgttggtcgagaaagatgctgatgactgggacactagccgtttttttcctgctcatcatgggacagctgacctggaatgaccttattaggttgtgcatcatggtgggcgctaacgtctccgatcgcatggggatgggaacaacttatctggccttaatggcaacctttaagatgcggcctatgttcgctgtgggcctcctgtttagaaggcttacgtctcgagaggttctgctactcacaattggtctgagcttggtggcctcagtcgaactgccaaacagtttagaggaactcggggacggactggcaatgggcataatgatgcttaaactgttgaccgatttccaatcccaccagctctggactaccctgctatctctgacatttatcaagactacccttagcctcgactacgcctggaaaacgatggctatggtactgtccattgtgtcattgttccccctgtgtttaagcacaaccagtcagaagactacatggctcccggttctgcttggctcttttgggtgcaaacctctgaccatgttcttgatcactgagaataagatttggggacgcaagtcctggccactcaacgaaggtatcatggcggtgggcatagtcagcatcctgctatcgtcactgcttaaaaatgatgtgcccctcgccgggcctctgattgcaggaggcatgttgatcgcttgttatgtaatttctggtagttccgccgacttaagcctggagcgggccgctgaggtgtcttgggaagaggaagcagagcatagcggggcctcccacaacatcctcgtcgaagttcaggatgacggaacaatgaagataaaagatgaggagagagacgataccctgacgattcttctgaaggcgactttgctagctgtgtcaggcgtgtaccccatgagtatcccagccaccctgtttgtctggtatttctggcaaaaaaagaaacagaggagcggcgtgctctgggacacaccttctcccccagaagttgagcgtgcagtactggatgacgggatctaccgcattcttcagcggggattactgggtagatcccaggtgggcgtcggggtgttccaagacggagtttttcataccatgtggcacgtgacaaggggcgccgtcctcatgtatcagggtaagcgattggaaccgtcatgggctagtgtgaagaaagatctgataagctacgggggaggctggcggttccagggctcctggaatactggggaggaggtacaggtcatcgcagtggaacctggaaagaaccccaaaaatgttcaaaccacgccaggtacatttaagactcccgagggcgaagtgggggccattgcgctcgacttcaaacctggaacctctggctcgccaatcgtcaaccgcgagggtaagattgtggggctgtacggaaatggcgttgtgacaaccagcggcacttatgtctcagctatcgcccaggcaaaggcctcccaggaagggccccttcctgagatagaggatgaagtgtttaaaaagagaaacctgaccatcatggacttgcacccgggaagtggtaaaacaaggcggtacctaccagctattgtacgagaggccatcaagagaaaactgcgcacgctcattttagcacccactagggtggttgcttctgaaatggccgaggcgctgaagggcatgcctatccgttatcaaaccacagccgtcaagagcgaacataccgggaaagagatagtggatcttatgtgccacgcaactttcacaatgcggctgctctccccagtgagagtccccaattacaacatgattatcatggacgaggctcattttaccgatcctgcctcaatcgctgcaaggggatatatttctacgcgcgtaggcatgggtgaagccgccgctatcttcatgactgcgacaccgcccgggagcgtggaggcatttccacagagtaatgccgttatacaggacgaagagcgagatattcctgaaagatcctggaacagcggatacgactggatcaccgatttccccggcaagaccgtgtggtttgtcccatctattaaatcaggcaatgacatcgctaactgtttgcggaagaacgggaaaagggtgatacagctgtcccgcaagactttcgacacagagtatcaaaagaccaaaaataacgattgggactacgttgtgacaactgatattagtgagatgggagccaatttccgtgcagacagagtcatcgatcctcggaggtgcctcaagcccgtgatcctgaaagacggtccagaacgcgtaattcttgccggcccgatgcctgtgacggctgcgagcgccgcacagcgaagagggcggatcggaaggaaccagaataaggagggcgatcagtacatttatatgggtcaacccctaaacaatgacgaagatcacgctcattggaccgaggccaaaatgctgttggacaacataaatacaccagaggggatcattcccgcattatttgaacctgagcgcgaaaagtcggccgctatcgatggcgagtacagactgaggggagaagcccggaagactttcgttgagctcatgcgtcgcggcgacctgccagtctggctttcttataaagtggcgtccgaggggtttcagtacagcgatcgaagatggtgcttcgacggagaaaggaacaatcaggtgctggaggaaaacatggacgtcgagatctggaccaaggaaggtgagcggaaaaagctccgccccagatggttggatgcaaggacatattcagaccctctggccctacgggagtttaaagaattcgctgccggccgaagaagtgtttctggggatctgattctcgagataggaaagcttccgcagcacctgaccttacgcgctcaaaatgcattggacaacctggtgatgctccacaattccgaacagggcggtaaagcctacaggcatgctatggaggaactgccagatactatcgagacgcttatgctgctcgccttgattgcagtactgaccgggggcgtgacattatttttcctaagcggaaagggcctggggaagacttcaatcggactcctttgtgtcatggcgagtagcgtgctgttgtggatggcctccgttgagccccactggattgctgcctctatcatactggaatttttcctcatggtgctgcttatccctgagcccgaccggcagcgtaccccacaggataaccaactcgcatatgtcgtaattggtctgttgtttatgatcctgacagtggctgccaacgaaatgggcttactagagaccactaaaaaggacctggggattggacatgttgtggcagagaatcaccaccatgccacaatgctcgatatcgaccttcaccctgctagcgcgtggacgctgtacgccgtcgcaaccactataattacacccatgatgagacataccatcgaaaacaccacagctaatatttccttgactgccatcgccaaccaggcagctatactgatgggcctcgataaaggttggccaatctcaaagatggacattggggtgcctctgcttgccttaggctgctactctcaggtcaatccgctgacgctcaccgcggctgtgttgatgctggttgcccactatgcaatcattggacccggcctacaagccaaagctacaagggaggcacagaagcgcactgccgcggggatcatgaagaacccaaccgtggatggaatagtagctattgacctggaccctgtggtctacgatgccaaattcgaaaagcagctcggccagatcatgcttctgatcttgtgtacaagtcaaattctgctcatgcggaccacttgggcactgtgcgagtcgatcacgttagccacaggtccccttaccactctgtgggaagggagcccaggaaaattttggaataccacaatagctgtttccatggccaacattttccgaggctcttatctcgcaggtgctggcctagccttctcactgatgaagagcttggggggaggcagaagggggactggagcgcagggcgagaccctgggtgagaaatggaagcgccagctcaatcagctttccaagagtgaatttaacacatacaaacggtctgggatcatggaggtggacagaagcgaagccaaggagggactgaaacgtggcgaaacgaccaagcatgcagtctcaaggggtactgctaaattgcggtggttcgtggagcgcaatctggtaaagcctgagggcaaggtgattgatctcgggtgtggacgaggcgggtggtcctattactgcgccggattaaaaaaggttacagaagtgaaaggctataccaagggtgggcccggacacgaggaaccgatcccaatggcaacttacggctggaacatagtcaaactgcacagtggcagagacgtgtttttcacacctcccgagaagtgtgatacccttctgtgcgacatcggggaaagctctccaaatcccacgattgaggagggaaggaccctacgggtcctcaaaatggtggaaccttggctgcgcggtaaccaattttgtatcaagattttgaatccgtacatgccctccgttgtagagacactggaacagatgcagagaaagcatggcgggatgctcgtgaggaacccactttcacgaaatagcactcacgagatgtattgggtctcgtgcggaaccggcaacatcgtgtctgctgttaacatgacaagtcggatgctgttaaatcgtttcactatggcccatagaaaacctacctacgagcgcgatgtggacctgggtgccgggacaaggcacgtcgcggtggaacccgagattgctaacttggatatcataggacagcggattgaaaatatcaagaacgagcacaaatccacctggcattatgacgaagataatccttacaagacttgggcatatcacggcagctacgaggtaaaaccatcaggctccgcctctagcatggtgaacggggttgtcagactcctgacgaagccctgggacgtgatccctatggtgacacaaattgctatgaccgacactaccccatttggacagcagcgcgtcttcaaggagaaagttgatacaaggacgccccgaccgaagcggggtaccgcccaaataatggaagtgactgcaaaatggctatggggctttcttagtagaaataagaaacctaggatctgtacacgcgaggaattcacccgtaaggtacggtccaacgccgctattggggcggtgtttgtcgacgagaatcagtggaacagcgccaaggaagcagtggaggatgagagattctgggacctggttcatagggaacgcgagctccacaaacagggaaagtgcgctacttgcgtgtataatatgatgggcaaacgagaaaagaaactgggtgagtttgggaaggccaagggatctcgggcaatctggtacatgtggttgggcgccagattcctggaattcgaggctctcggctttatgaacgaggatcattggttctcaagggaaaatagtctttccggggtcgagggagaaggtctgcacaaattaggctacattctgcgcgacatcagcaagataccagggggaaacatgtatgccgatgacacagcgggctgggataccagaatcacagaggacgatttgcagaatgaggcaaaaattactgacatcatggaacccgagcacgccctcctggctacctctatttttaagctaacgtaccaaaacaaagtggtacgggttcagaggcctgccaagtcgggtaccgtgatggatgtcatctcacgtcgagaccagcgcgggagcggacaggtgggcacatatggccttaacactttcaccaatatggaagtgcaactgataagacagatggagtccgaagggatttttagtccatctgagctcggaaacagcaatctggcagagcgggtcttggactggttagaaaaacatggtgttgagaggctgaagcgcatggctatctccggcgatgactgtgtggtaaagcccacagatgacagattcgccactgctctcaccgcccttaacgatatggggaaagtgcggaaggacatcccgcagtgggaaccttcaaaaggatggaatgattggcagcaagtccccttttgcagtcaccatttccaccagctgattatgaaggacggcagggagatagtggttccatgtcgaaaccaggatgaactagtgggtcgtgcaagagtctctcagggggcgggatggagcctgcgcgagacggcctgcctcggcaaatcctacgctcaaatgtggcagttgatgtattttcaccggagggacctgagacttgccgcaaatgctatctgttcagccgtgcctgtaaactgggttcccacaagccgcaccacttggtctattcatgcacaccatcagtggatgacaaccgaggatatgctgtccgtgtggaatcgggtctggatcgaagagaacccatggatggaagacaagactcacgtgagtagctgggaggacgttccctacctcggcaagagggaagatcaatggtgcgggtcgttaattggactgaccgcccgagcgacatgggctacgaatatccaggtggccataaaccaggtcagaaaattgatcggtaatgagaactatctggactacatgacctccatgaagcggttcaaaaatgagtctgatcctgaaggcgcactctggtga

SEQ ID NO: 14219 - RNA, 9879 nt, synthetic construct
  misc_feature 1..9879: note = derived and/or modified CDS sequence (opt3) from DENV-1__HM469968__SS-prME
  source 1..9879: mol_type = other RNA
agcgtgaccatgctgctcatgcttatgcccacagcactggctttccacttgactacgaggggaggggaacctcatatgatcgtctccaagcaggaaaggggaaaatctttactgtttaagacctcagccggtgttaatatgtgcacactaattgccatggacctcggcgaactgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactgggtcgttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgctttgctcacttggctgggattaaattcacgaagtacatccctgagcatgacctgtattgccgtgggcctagttacactctacctgggggtcatggtgcaggcagattctggatgcgtgatcaactggaaaggccgcgaacttaagtgtggttcagggatcttcgtcactaatgaggttcacacctggacggaacaatataagtttcaggccgacagtccgaaaagattgagcgctgccattggaaaggcatgggaggagggcgtgtgcggtataaggtccgctacacggctggaaaacatcatgtggaaacagatttctaacgagctcaatcatatcctgttagaaaacgacatgaagttcaccgtggtagtcggcgatgtggccgggattctggcgcagggcaagaagatgatccgccctcaacccatggagtacaaatattcgtggaaaagctggggcaaggccaagataatcggggctgacgttcagaatactacctttattatcgatggaccaaacacacctgaatgtcccgacgatcagagagcatggaatatttgggaggtggaggactacggcttcggtatctttactaccaacatatggcttaagttgagggattcctatacacaggtctgcgaccaccgtctcatgtcagccgctattaaagatagtaaggccgtgcacgcagacatggggtactggatcgaatctgagaaaaatgaaacgtggaagctggcgcgggccagcttcattgaggttaagacctgtatctggccaaaatcccatactctatggtcaaacggagtgctggaaagcgagatgataatccccaagatttatggcggtcctatctctcaacacaattaccgaccaggctacttcacacagaccgctgggccgtggcatctcggaaaactggagcttgattttgacttgtgcgaaggcactacagtagtcgtggatgagcactgcgggaacagaggaccctccctgaggaccacgactgtgaccggcaagattatccacgaatggtgttgccgcagttgtacattacctccactccggttcagaggtgaggacgggtgctggtatggaatggagataaggcccgtcaaagaaaaggaggaaaatctggttaagagcatggtgtctgccggctccggtgaggtagactcatttagtcttggcctgttgtgtattagcatcatgatcgaagaggtgatgcgctcgcgatggtcccggaaaatgctcatgaccgggactctggcagtcttctttctactgattatgggacagctcacatggaacgatctgatccgtctttgcattatggtgggcgctaatgcctctgacagaatggggatgggaaccacatacttggcactgatggccactttcaagatgaggcctatgtttgctgttggcttactcttccgccggctgaccagcagagaggtgcttctgctaacgataggtctctcactggtcgcgagtgtggaattgccaaactccctggaggaattaggggatggactcgccatgggcatcatgattctgaaacttctgacagactttcaatctcatcagttgtgggcaaccctcctgagcctaactttcatcaagaccacattttccctgcactatgcttggaaaactatggccatggttctttcaattgtgagcctcttccccctgtgtttgagtaccacgtctcagaagacaacctggctgccggtcttactcggctccctggggtgcaagcctcttactatgtttctgatcgccgagaataaaatatggggaagaaagtcctggccattgaacgaaggtatcatggctgtaggcattgtgtcgatcctcctgtcatctctactgaaaaacgatgttccccttgcagggcctctcattgccggaggcatgctgatcgcgtgttacgtgataagtggttccagcgctgacttgtctttagagaaggccgcagaggtcagctgggaagaggaagccgagcattccggggcttcacacaatattctggtggaagtacaggatgacggaacaatgaaaatcaaggatgaggagcgagacgataccctcactatcctgcttaaagcaacactgttggccgtgagtggcgtctatcccctaagcattccagcgaccctgttcgtttggtacttctggcaaaagaagaaacagcgctctggcgtgctctgggacacgccttcacccccagaagtggagcgggctgtcctggatgacgggatatatagaatcatgcagaggggacttttaggtcgtagccaggtgggcgttggggtatttcaagaaaacgtgttccatactatgtggcacgtcacccgcggagccgtgctgatgtaccagggcaagcggctcgagccgagttgggcaagcgttaaaaaggacttgatttcctacggtgggggatggagactgcagggctcttggaatacaggcgaggaagtgcaggtcatcgccgtggagcctgggaaaaaccccaagaatgtacaaaccgctccaggaacatttaagactcccgaaggtgaggtcggcgccattgcactcgatttcaaacctgggacctcgggaagcccaatcgtgaacagggaaggcaagatagttggtctgtatgggaatggagtggtcacgacatcaggcacttacgtgtccgctatcgcccaggcgaaagccagtcaggagggcccccttcctgagattgaagacgaggtttttcgaaagcggaacctgaccatcatggatttgcacccggggtctggaaaaacacgcagatatctaccagcaattgtgagggaagctatcaagcggaagctgcgaaccctcatattagcccccactagagtcgtggctagcgagatggcagaagccctgaaaggtatgcctattcgctaccaaaccacagccgtaaagtccgagcatacgggcaaagagatcgtggaccttatgtgccacgctactttcaccatgaggctgctctcaccagttcgtgtccccaattataacatgatcattatggatgaagcgcattttacagacccttctagcatcgcagcccgggggtacataagtaccagagtgggaatgggcgaggctgccgcaattttcatgactgccacaccgcccggttccgtggaggcttttccacagagcaatgcggtcatccaggatgaggaaagggacattcctgagcgctcttggaactcagggtatgagtggatcaccgatttccccggaaagacggtatggtttgtgccatccataaaaagtggcaatgacattgccaactgtttgcgaaagaatggcaagagagttatccagctgagccggaaaactttcgatacagaataccaaaagaccaaaaacaacgactgggactacgtggtcaccactgatatctcggagatgggggcaaatttcagggctgaccgcgtgattgatcctcgtagatgcctcaagcccgttatcctgaaagacggaccagaacgggtgattcttgccggtccgatgcctgtcacagtggcatctgccgctcagaggcgcggccgaatagggagaaaccacaataaggagggagatcagtatatctacatgggccagcccctaaacaatgacgaggatcatgcccactggaccgaagcgaagatgctgttggacaacattaatacaccagagggtatcatccccgcattatttgaacctgagcgggaaaaatccgccgctattgatggggagtataggctgcgcggcgaggccagaaagactttcgtagaactcatgaggcggggagacctgccagtgtggcttagctacaaagttgcttcagagggctttcaatatagtgatcgtcgctggtgcttcgacggggaacgaaacaatcaggtcctggaggaaaacatggatgtggagatatggacgaaggagggagaaaggaaaaagctcaggccccggtggttggacgcacgcacctactctgaccctctggccctaagagagtttaaagagttcgctgccggtaggcggtccgtgagcggcgatctgatcctcgagattgggaaacttccgcagcacctgacacagcgagcacaaaatgcgttagacaacttggtcatgctgcataattcagaacagggaggcagagcctatcgccacgctatggaggagctcccagatactatcgaaaccctgatgcttctggccctcattgcagttttgacaggtggggtgaccctgtttttcttaagtggcaggggactaggcaagactagcatcgggctgctctgtgtaatggcttcctctgtgcttctgtggatggccagcgtcgagccccattggatagcagcctccatcattttggaatttttcctgatggtgctcctgatccctgagcccgaccggcagcgtacgccacaggataaccaacttgcttacgttgtgattggactcctgtttatgatcttgaccgtcgcggccaatgagatgggtctgttagaaacaactaaaaaggacctaggcatagggcacgtagcagtggagaaccaccatcacgctgccatgctggatgttgacctccatcctgcctcagcatggaccctttacgctgtggccacaaccattatcactcccatgatgagacacacaattgaaaacacgaccgcgaatatctctctgactgctatagccaaccaggcagccatcttgatgggactggataaaggctggccaattagtaagatggacatcggtgtccctctcctggctcttgggtgctatagccaggtgaatccgttaacactgaccgcagccgtcctcatgttggtggcgcattacgctattatcggccccggactgcaagccaaagcaaccagggaggcccagaagcgcacagctgccggcataatgaagaacccaactgttgatgggattgtggcaatcgacctagatcctgtagtgtatgacgctaaattcgaaaagcagctgggacagatcatgctccttattctgtgtacgagccaaatcttgctgatgcggaccacatgggccctctgcgagtccataactctggcgaccggccccttaacaaccctttgggagggttctccagggaaattttggaatactacgattgccgtctcaatggcaaacatcttccgaggaagctacctggctggcgccggtctcgcattctccctaatgaagagtctgggcgggggaagaaggggcacaggggctcagggagaaaccttgggcgagaaatggaagcgccagctgaatcagctctctaagagcgaatttaacacttataaacggtcaggtattatggaggttgacagatccgaagccaaggaggggcttaaacgtggagagaccacaaagcacgccgtgagtaggggcactgcgaaactgcggtggttcgtcgaacgcaatttggtgaagcctgagggtaaggtaatcgatctgggctgtgggcgaggaggctggagctactattgcgctgggctcaaaaaggtgaccgaagttaaaggatacacaaagggcggtcccgggcacgaggaaccgataccaatggcaacgtacggatggaacttagtgaaactgcattctggcaaggacgtctttttcatccctcccgagaaatgtgatacccttctgtgcgacattggcgagtcctcaccaaatcccactatcgaagaggggagaacactaagggtgctcaagatggtcgaaccttggctgcggggaaaccaattttgtattaagatcttgaatccgtatatgcccagcgtggttgagaccctggagcagatgcagcgcaaatacggtggcatgctcgtaagaaacccactttcgagaaattctactcacgaaatgtattgggtgagttgcgggacaggaaacattgtctccgccgtgaatatgaccagccgaatgctgttaaaccggttcacgatggctcatcgtaagcctacctacgagagagatgttgacctgggcgccggtacacgccacgtggcagtcgaacccgaggtggccaacttggatatcatagggcagaggattgaaaatatcaaacacgagcataagtcaacttggcactatgacgaggataacccttacaaaacctgggcttatcatggatcctacgaagtaaagccatctggcagcgcgagttccatggtgaatggcgttgtcaagctcctgacaaaaccctgggacgtgatccctatggtgactcaaattgccatgaccgatacaaccccatttgggcagcagcgggtcttcaaggagaaagttgacactagaacgcccaaggcaaaacgcggaacagctcaaataatggaagtgaccgccaggtggctatggggttttcttagccgaaacaagaagccgcggatctgtactagagaggagttcaccaggaaagtacgctctaatgcagccattggcgctgtgtttgtcgacgagaaccagtggaactcagccaaggaggcggtggaagatgagcgtttctgggacctggttcaccgggaaagagagctccataaacaggggaagtgcgcaacatgcgtgtacaacatgatgggaaaaagggaaaagaagctgggcgagtttggtaaagccaaggggagtcgcgctatctggtatatgtggttgggagcccgattcctggagttcgaagcactcggctttatgaatgaggatcactggttctcccgggaaaacagcctttctggcgtcgagggggagggactgcacaaattaggttacattctgagagacatctcgaagatacctggcgggaatatgtatgctgatgacacggccggatgggataccaggatcactgaagacgatttgcagaacgaggctaaaattacagacatcatggaaccagagcatgccctcctggcaaaggcgatttttaaactaacctaccaaaataaggtggtacgcgttcagagacccgccaagaacggcactgtgatggatgtcatctcacggagggaccagcgtggtagcggacaggtgggaacatatggccttaataccttcacaaacatggaagctcaactgatacgacagatggagtccgagggcatttttctccctagtgaactggagactccaaacttggccgaacgcgtgttagattggctggagaaatacggggtcgaaagactcaagcggatggcaatctctggagacgactgtgttgtgaaacccatcgatgacaggttcgctaccgcccttacggcactgaatgatatgggtaaggtacgcaaagacattccgcagtgggagcctagcaagggctggaacgattggcagcaagtgcccttttgctcccaccatttccaccagctaataatgaaggacgggagagagatcgtcgtgccatgtcggaatcaggatgaactggttggaagggcccgagtgtcacagggcgcgggttggagtctccgtgagaccgcttgcttggggaaatcttatgcccaaatgtggcagctgatgtactttcacagacgcgaccttcggctggcagccaacgctatttgtagcgccgtccctgtggattgggtacccacatccaggactacctggtcaatccatgcacaccatcagtggatgacaactgaagacatgctcagcgtttggaatagagtgtggattgaggaaaacccatggatggaggataagacccacatctcttcctgggaggacgtcccctacttaggaaaacgcgaagaccaatggtgcggcagtctgataggcttgacggctcgggccacatgggcgaccaatatccaggtggctattaaccaggttaggcgactgatcgggaatgagaactatctcgattacatgactagcatgaagagattcaaaaatgaatcggaccctgagggagccctttggtga

SEQ ID NO: 14220 - RNA, 9879 nt, synthetic construct
  misc_feature 1..9879: note = derived and/or modified CDS sequence (opt3) from DENV-1__KC172834__SS-prME
  source 1..9879: mol_type = other RNA
agcgtgaccatgctgctcatgcttatgcccaccgccctggctttccacttgactacgagaggaggggaacctcatatgatcgtctccaagcaggaaagagggaaatctttactgtttaagacctcagccggtgttaatatgtgcacactgattgccatggacctcggagaactgtgtgaagatactatgacctacaaatgcccacggataacagaggcggaaccggacgatgtggactgttggtgcaatgctaccgatacttgggtaacatatgggacctgtagtcaggccggagagcaccgccgagacaagcgtagcgtggcacttgcaccccatgtcggcctgggtttggagacgagaactgaaacctggatgtcctctgagggggcttggaaacagatccagagggtggaaacatgggcactccggcaccctggattcactgttattgccctgtttctggctcatgccatcggcacctcgattacacagaagggcatcatattcatcctcttaatgctggtgaccccatcaatggcgatgcgctgcgtcgggattggaagcagagattttgtggagggtcttagtggcgcaacgtgggtagacgttgtgttggagcacgggtcctgtgtcactacaatggccaaggataaacccaccctggacatcgaactactcaagactgaggtgacaaaccctgctgtgctgaggaaactttgcattgaagccaagatctctaataccacgaccgatagccggtgtccaacacaaggagaggcaactctggtcgaagaacaggacgctaacttcgtttgccgccgaacctttgtggatagaggctggggtaatgggtgtggattgttcggcaaaggctccctcctgacatgcgccaagtttaagtgcgtaactaaattagaggggaagatagtgcagtacgaaaacctgaaatattcagtcattgtgaccgttcacacaggagaccagcatcaagtgggtaatgagagtaccgaacacggcactacggcgacaatcacaccccaggcccctactaccgagattcagctcacagactacggggcacttaccctggattgtagcccaaggactggattggacttcaacgaaatggtcctactgacaatgaaggagaaatcttggctcgtgcataagcagtggtttctggatcttccgctgccctggacgtccggcgcttcaaccagccaagagacttggaatcggcaggacttgctcgtaacattcaaaaccgcccacgctaagaagcaggaagttgtggtcctgggtagtcaagagggggccatgcacacagcattaactggcgccaccgaaatccagacgtctggaaccacaactatctttgctggccatctgaaatgccgtctaaagatggataaactcaccctgaaggggatgtcctatgtgatgtgtacaggcagcttcaaacttgagaaggaagtcgcggagactcagcacggtaccgtgttggttcagattaagtacgagggcacggacgcaccttgcaaaataccattctcgacacaagatgaaaagggggtgacccagaacggacgcctgatcactgccaatcccattgtaacagacaaagagaagcctgtcaacatcgaagctgagccaccctttggcgagtcttatatagtgattggtgccggggaaaaagcactcaagctgtcctggttcaagaaaggctcaagtatcggaaagatgtttgaggccaccgctagaggcgccaggcggatggcaatccttggggatactgcgtgggacttcggaagcattggtggcgtttttacctccgtggggaaactggtccatcagatcttcggaacagcttacggcgtgttgttttctggtgtaagctggacgatgaagattgggataggcgtgctcctgacctggttaggactaaattcacgaagtacttccctaagcatgacatgtatcgccgttggcctcgtcaccctgtaccttggggtgatggtgcaggcagattctggatgcgtcattaactggaaaggccgcgaattgaagtgtggttcagggatcttcgttacaaatgaggtgcacacttggaccgaacaatataagtttcaggccgacagtccgaaaagactgagcgctgccatcggaaaggcatgggaggagggcgtgtgcggtattaggtccgctacgcggctcgaaaacataatgtggaaacagatctctaacgagctgaatcatattttactggaaaacgacatgaagttcacagtagtcgtgggcgatgttgccgggatccttgcgcagggcaagaagatgattcgccctcaacccatggagtacaaatattcgtggaaaagctggggcaaggccaagatcataggggctgacgtgcaaaattccacctttatcattgatggaccaaacactcctgaatgtcccgacgatcagagagcatggaatatctgggaggtcgaggactacggcttcggtatttttaccacaaacatctggttgaagctcagggattcatatactcaggtgtgcgaccaccgtctgatgagtgccgctataaaagattctaaggccgttcacgcagacatggggtactggattgaaagcgagaaaaatgaaacctggaagctagcgcgggcctccttcatcgaggtgaagacatgtatttggccaaaatcacatacgctgtggagcaacggagtactcgaatctgagatgatcatacccaagatctatggcggtcctatttcccaacacaattaccgaccaggctacttcacccagactgctgggccgtggcatctgggaaaacttgagttggattttgacctgtgcgaaggcacaaccgtcgtggtggatgagcactgcgggaacagaggacccagtttaaggactacaaccgtcacgggcaagatcattcacgaatggtgttgccgcagctgtactctccctccactgcggttcagaggtgaggacgggtgctggtatggaatggagatcaggcccgttaaagaaaaggaggaaaatcttgtgaagtctatggtatccgccggctcaggtgaggtggacagttttagcctgggcttgctctgtatatcgattatgatcgaagaggtcatgcgctcccgatggtctcggaaaatgctgatgaccgggacactagcagtgttctttctgctcatcatgggacagctgacctggaacgatcttattcgtttgtgcatcatggttggcgctaatgccagcgacagaatggggatgggaactacatacctggcattaatggccaccttcaagatgaggcctatgtttgctgtgggcctcctgttccgccggcttacatcaagagaggtcctgctactcactattggtctgagtttggtggcgtccgttgaactgccaaactctttagaggaactcggggatggactggccatgggcataatgatccttaaactgttgaccgactttcaaagccatcagctctgggcaacgctgctatccctgacattcattaagaccactttttcacttcactatgcttggaaaaccatggccatggtgctcagcatcgtcagtctgttccccttgtgtctgtctacaacttcccagaagaccacgtggttaccggtactcctgggcagccttgggtgcaagcctctgacaatgtttttgattgccgagaataaaatctggggaaggaagtcgtggccactcaacgaaggtataatggctgtgggcatcgtttcaattctgctatctagtctgcttaaaaacgatgtgcccctcgcagggcctctgatcgccggaggcatgttgattgcgtgttacgtcatctccggtagctctgctgacttaagcctggagaaggccgcagaggtgtcctgggaagaggaagccgagcattcaggggctagtcacaatatactcgtagaagtgcaggatgacggaaccatgaaaattaaggatgaggagcgagacgatactctgacaatccttctgaaagcaaccttgctagccgtcagcggcgtttatcccctgtctatcccagcgactctcttcgtgtggtacttctggcaaaagaagaaacagcgctccggcgtgctgtgggacacaccttcacccccagaagtcgagcgggctgtgcttgatgacgggatttatagaataatgcagaggggattactgggtcgtagtcaggttggcgtaggggtgtttcaagaaaacgtcttccataccatgtggcacgtgacgcgcggagccgttctcatgtaccagggcaagcggttggagccgagctgggcatccgtgaaaaaggacctgatctcttacggtgggggatggagatttcagggctcgtggaatactggcgaggaagtccaggtgattgccgtagagcctgggaaaaaccccaagaatgtccaaaccgctccaggaacattcaagacccccgaaggtgaggtgggcgccatcgcactcgattttaaacctgggacaagcggatcaccaattgttaacagggaaggcaagatcgtgggtctgtatgggaatggagtcgtgactacctccggcacgtacgttagtgctatagcccaggcgaaagcctctcaggagggcccccttcctgagatcgaagacgaggtgttccgaaagcggaacctgacaattatggatttgcacccggggagcggaaaaactcgcagatatctaccagcaatcgtcagggaagctattaagcggaagctgcgaaccctcatcttagcccccacaagagtggtagcttccgagatggcagaagccctgaaaggtatgcctatacgctaccaaaccactgccgtgaagtcagagcataccggcaaagagattgttgaccttatgtgccacgctacatttacgatgaggctgctctctccagtccgtgtgcccaattataacatgatcatcatggatgaagcgcatttcactgaccctagcagtattgcagcccgggggtacatctccaccagagtgggaatgggcgaggctgccgcaatatttatgacagccaccccgcccggtagcatggaggctttcccacagtctaatgcggtcattcaggatgaggaaagggacatccctgagcgctcatggaacttggggcacgagtggattactgattttcccggaaagacagtatggttcgtgccatccatcaaagccggcaatgacatagcaaactgtctgcgaaagaatggcaagagagttattcagctcagtcggaaaaccttcgatacggaatatcaaaagactaaaaacaacgactgggactacgtggtcacaaccgatatcagcgagatgggggctaattttagggccgaccgcgtgatcgatcctcgtagatgcctgaagcccgttattcttaaagacggaccagaacgggtgatcctagcaggtccgatgcctgtcaccgtggcctcggctgcccagaggcgcggccgaattgggagaaaccataataaggagggagatcagtacatatatatgggccagcccctgaacaatgacgaggatcacgcgcactggactgaagcaaagatgttgttagacaacatcaatacaccagagggtattatccccgccctgttcgaacctgagcgggaaaaatctgctgccatcgatggggagtacaggctccgcggcgaggctagaaagacctttgtagaactgatgaggcggggagaccttccagtgtggctgtcctataaagttgcaagcgagggcttccaatactcagatcgtcgctggtgctttgacggggaacgaaacaatcaggtcctcgaggaaaacatggatgtggagatttggacaaaggagggagaaaggaagaagttgaggccccggtggctggacgcccgcacttatagtgaccctctagctctgagagagttcaaagaatttgccgcaggtaggcggtctgtgtccggcgatctcatacttgagatcgggaagctgccgcagcatttaacgcagcgagcgcaaaatgccttggacaacctggtcattctccacaatagcgaacagggaggcagagcttaccgccatgccatggaggagctgccagataccatcgaaacacttatgctgctcgcattgattgctgttctgactggtggggtgaccttattctttctatcaggcaagggactgggcaaaacaagtatcgggctcctttgtgtaatggccagctccgtgctgttgtggatggcatctgtcgagccccactggatagccgctagcatcattctggagttctttctcatggtgctgcttatccctgagcccgacaggcagcggaccccacaggataaccaactcgcgtatgttgtgattggactgttgttcatgatcctgactgtcgccgcaaatgagatgggtttactagaaacgaccaagaaagacctgggcatagggcacgtagctgtggagaaccatcaccatgccgccatgctcgatgttgaccttcaccctgcatccgcttggacactgtacgccgtggcgactaccattatcacacccatgatgcgtcataccattgaaaacactacagctaatatctcattgacggccatagcaaaccaggccgctatcctgatgggactcgataagggctggccaatttctaaaatggacatcggtgtccctctgcttgcattagggtgctacagtcaggtgaatccgctgaccctcactgccgcggtcttgatgctggtggctcactatgccattatcggccccggactacaagcaaaggccacaagagaggctcagaagaggaccgccgcaggcataatgaaaaacccaaccattgatgggatcgttgctatcgacctggatcctgtggtatacgacgccaagtttgaaaaacagctcggacagattatgcttctgatcttgtgtacatcgcaaatactgctcatgcgcactacgtgggcgctgtgcgagagcattaccttagccacaggcccccttactaccctgtgggagggttccccagggaagttctggaatacaaccatcgcagtgtctatggctaacattttccggggatcatatctcgccggcgcaggtctagcttttagcctgatgaaatccttgggcgggggacgaagaggcactggggcccagggagaaacgctgggcgagaagtggaagaggcagctcaatcagcttagtaaatctgagttcaacacatacaagcgcagcggtatcatggaagtcgaccggtcagaagccaaagaggggctgaagagaggagagaccactaaacacgcggtttcccgtggcaccgctaagttgaggtggtttgtggaacggaatctggtcaagcctgagggtaaagtgatagatctcggctgtgggcgcggaggctggagttattactgcgcagggttaaagaaagtaacagaagtgaagggatatactaaaggcggtcccgggcatgaggaaccgatcccaatggccacctacggatggaacctggttaaacttcacagcggcaaagacgtgttctttgtccctcccgagaagtgtgatacactgctatgcgacattggcgagtcttccccaaatcccacgatcgaagaggggcgaaccctcagagtgctgaagatggtcgaaccttggttgaggggaaaccaattctgtattaaaatcctgaatccgtacatgccctcagtggttgagactctcgagcagatgcagcggaagcatggtggcatgcttgtacgcaacccactgagcagaaattcgacacacgaaatgtattgggtgtcttgcgggaccggaaacattgtcagtgctgtgaatatgacttccaggatgttactgaaccgatttacaatggcccaccggaaacctacctacgagcgtgatgttgacttgggcgcaggtacgagacatgtggccgtcgaacccgaggtggctaacctcgatatcatagggcagcgcattgaaaatatcaagcacgagcataaaagcacctggcactatgacgaggataacccttacaagacatgggcgtatcatggatcatacgaagtaaagccatccggctctgccagcagtatggtgaatggcgttgtcaaactgctaactaagccctgggacgtgatccctatggtgacccaaattgcaatgacagatactaccccattcgggcagcagagggtctttaaagagaaggttgacacacggacccccaaagctaagagaggaactgcccaaataatggaagtgacggcacgctggctttggggtttcctgtccaggaacaagaaaccgcgaatctgtacacgggaggaatttaccagaaaggtaaggagcaatgccgctattggcgccgtgttcgtcgacgagaaccagtggaactctgcgaaagaggcagtggaagatgaccgcttttgggatctcgttcaccgtgagcgggaactgcacaagcaggggaaatgcgccacttgcgtgtataacatgatgggaaagagagagaagaaattgggcgagttcggtaaggctaaagggtcaagggccatctggtacatgtggctgggagcacgcttcctcgagtttgaggctcttggcttcatgaatgaagaccattggtttagtcgagagaactccctgagcggcgtcgaaggggagggattacacaagctgggttacattttgcgggatatctctaaaatacctggcgggaatatgtatgccgacgataccgctggatgggacacaagaatcacggaggatgacctccagaacgaagccaagattaccgatatcatggagccagaacatgcactgctagcgaaatcgattttcaaacttacttaccaaaataaggtggtaagggttcagcgccccgccaaaaacggcacagtgatggacgtcatctcaagacgggatcagaggggtagcggacaggtgggaacctatggcctgaatacttttacaaacatggaggctcaactcatacgtcagatggaatccgagggcattttcagtcctaacgagctggaaaccccaaatttggccgagcgagtgttagactggctggaaaagtacggggtcgagcgcctcaaaagaatggcaatctctggagacgattgtgttgtgaagcccatcgacgatcggtttgctacagcccttactgcactgaacgacatgggtaaagtaaggaaggatattccgcagtgggaacctagcaagggctggaatgactggcagcaagtgcccttctgctcccaccactttcatcagctaataatgaaagatgggcgcgagatcgtcgtgccatgtagaaaccaggacgagctggttggacgggccagggtgtcacagggcgcgggttgggggctccgagaaaccgcttgcttgggaaagagttatgcccaaatgtggcagctgatgtacttccaccgtagagatcttcgcctggcagccaatgctatttgttctgccgtccctgtggactgggtacccacgagccggaccacatggtccatccatgcacaccatcagtggatgactaccgaggatatgctctcagtttggaacagggtgtggattgaagagaatccatggatggaagacaaaacaagaatcagctcttgggaggacgtcccctatttaggcaagcgcgaggatcaatggtgcggctccctgatagggttgactgctcgggccacctgggcgacgaacatccaggtggctattaatcaggttaggcgactgatcggaaacgaaaattacagtgactacatgacaagcatgaaaagatttaagaacgagtcggaacctgagggtgccctctggtga

SEQ ID NO: 14221 - RNA, 9879 nt, synthetic construct
  misc_feature 1..9879: note = derived and/or modified CDS sequence (opt3) from DENV-1__KJ933413__SS-prME
  source 1..9879: mol_type = other RNA
tccgtgaccatgctgctcatgcttctgcccacagccttggctttccacttaactacgaggggaggggaacctcatatgatcgtctccaagcaggaaaggggaaaatctctgctatttaagacctcaacaggtgttaatatgtgcactctcattgcaatggacctgggcgaactttgtgaagataccatgacatacaaatgcccacggataaccgaaactgaaccggacgatgtggactgttggtgcaatgccacagagacctgggtaacgtatgggacttgtagtcaaaccggagagcaccgccgagataagcgtagcgtggcgctggctccccatgtcggcttgggtctcgaaacaagaactgagacctggatgtcctctgaaggggcctggaggcagatccagaaagtggagacatgggcactgcggcaccctggattcaccgttattgccctgtttctcgctcatgcaatcggcacgtcgattactcagaagggcatcatattcatcttactgatgcttgtgacaccatcaatggccatgcgctgcgtcgggattggaaaccgggactttgtggagggtttgagcggcgctacctgggtagatgttgtgctggaacacgggagttgtgtcactacaatggccaaggacaaacccaccctagatatcgagctcctgaagacggaagtgaccaatcctgcggtgcttaggaaactgtgcattgaggcaaagatctccaacacaactaccgactctcggtgtccaacacaaggagaagccactttggtcgaggagcaggataccaatttcgtttgccgccgaacactcgtggacagaggctggggtaacgggtgtggactgtttggcaaaggcagcttaataacctgcgctaagttcaagtgcgtaactaaactggaagggaagattgtgcagtacgagaatctcaaatattccgtcatcgtgacggttcacacaggagatcagcatcaagtgggtaacgaaaccactgagcacggcaccacagccaccattactccccaggcacctacatcagaaatccagcttacggactacggggctctgaccttggactgtagtccaaggactggactagattttaatgagatggtcctgctcacaatgaaggagaaaagctggctggtgcataagcagtggttccttgacctgccgttgccctggacctctggcgcctccacatcacaagaaacttggaaccggcaggatctcctggtaacctttaaaacggcgcacgccaagaagcaggaggttgtggtcttaggtagccaagaaggggcaatgcacaccgctctgacaggcgccactgagatccagaccagtggaacaactaccattttcgctggccatctaaaatgccgtctcaagatggacaaactgacgcttaagggggtgtcttatgtcatgtgtacaggatcctttaaattggaaaaggaggtggccgagacccagcacggtactgttctggtgcaggtaaagtacgaaggcacagatgcaccttgcaaaataccattcaccagccaagacgagaagggggtcactcagaatggacgcctcatcaccgccaaccccattgtgacagataaagaaaagcctgttaatatcgaggctgagccacccttcggcgaatcgtatctggtggtcggtgcgggggagaaagcacttaagctgtcttggtttaagaaaggctcctcaataggaaagatgttcgaagccacggctagaggcgccaggcggatggcaattttgggggacaccgcctgggattttggaagtatcggtggcgtgttcactagcgtagggaaactcatccatcagatttttggaacagcttacggcgtgctgttctccggtgtttcttggaccatgaagatcgggattggcatattactgacatggctaggactcaacagccgatcaacaagtctgtccatgacctgtatcgccgtcggcatggtgacgctttacttgggggtgatggtccaggcagacagcggatgcgttattaattggaaaggccgcgagctgaagtgtggttctgggatctttgtgacaaacgaagtgcacacctggactgagcaatataagttccaggcggattcaccgaaaagactcagtgctgccatcggaaaggcatgggaggaaggcgtatgcggtattaggagcgtcacccggctggagaacataatgtggaaacagatctccaatgaattaaaccatattctgcttgagaatgacatgaagtttacagtggttgtgggcgacgtcaacgggatcttggcccagggcaagaagatgattcgccctcaacccatggaacacaaatactcttggaagtcgtggggcaaggctaaagtgatcggggccgatgttcagaatagcactttcataatcgacggaccaaacacccctgagtgtcccgatgaccagagagcatggaatatttgggaggtggaagattatggctttggtatcttcacaacgaacatttggctcaagctgagggactcctacacccaggtatgcgatcaccgtctaatgtcagctgccatcaaagacagtaaggcggtccatgccgatatggggtattggatagagtctgagaaaaatgagacttggaagctgacacgggctagctttattgaagtgaagacctgtgtgtggccaaaatcccacactctctggtcaaacggagtcctggagagcgagatgatcattcccaagatctacggcggtcctatatctcaacataattatcgaccaggctacttcacacagaccgcagggccgtggcaccttggaaaattggaactggacttcggcttatgcgaggggacgactgttgtggtagatgaacactgcggaaacagaggcccctccctcaggaccacaaccgtgactggtaagatcattcatgagtggtgttgccgcagttgtacactgcctccacttcggtttaaaggggaggacggatgctggtacggcatggaaatcagacccgtcaaggagaaggaagagaatctggtgaaaagcatggtttctgccggttccggcgaagtggattcattcagtttggggctcctgtgtattagcatcatgatagaggaggtcatgaggtcgcgctggtcccgaaagatgctaatgaccggaacactggctgtgtttctcctgcttattatgggccagttgacttggaacgacctgatccggttatgcatcatggttggggccaatgcatctgacaaaatgggaatgggcaccacgtatctcgcgctgatggccacattccgtatgagacctatgtttgctgtgggtcttctgttcaggcgcctaaccagccgggaagtcctcctgttgactgtagggctgtcattagtggccagtgttgagctcccaaactccctggaagaacttggagatggcctggcaatgggcattatgatgttgaagctcctgaccgactttcaatctcaccagctatgggctgccctgcttagcctcacattcgtgaaaactaccttttccctgcattacgcatggaagacgatggccatgatcttgtcaattgtcagcctgttccccttatgtctcagtacaacctctcagaagactacatggctgccggtgcttctggggtccttgggatgcaaacctctcaccatgtttctgataactgaaaacagaatctggggtaggaaaagctggccactaaatgagggcattatggctgtagggatcgtgtcgattctgctttcatctctcctgaaaaacgatgtccccttggcgggacctttaatcgccggcggtatgctgatagcatgttatgttatcagtgggtccagcgctgacctctctctggagaaggccgccgaagtgagctgggaggaagaggctgaacactccggagcatcacataatattcttgtggaggtccaggatgacggcacaatgaaaatcaaggatgaggaacgagacgataccctgacgattttgctaaaagccactctgctcgcgatcagtggcgtgtaccccatgagcataccagctaccctgttcgtttggtatttttggcaaaagaagaaacagcgctctggggtactttgggacacaccttcacccccagaggtggaacgggccgtcttagatgacggaatttacagaatcctgcagaggggtctcttgggcaagagccaggtgggggttggagtgttccaagagggcgtcttccacaccatgtggcacgtgacacgtggtgcagtactgatgtatcaggggaaacgcctcgagccgagttgggccagcgtcaagaaagatctgatctcctacggaggcggctggcggtttcaggggtcttggaacactggagaagaggtgcaggttattgctgtggaacctggtaagaatcccaagaacgtccaaaccgcaccaggcacgttcaaaacacccgagggggaagtgggagccatagcgcttgactttaagcctggcacttcgggtagcccaatcgttaatagagaggggaaaattgtgggactgtacggcaacggcgtcgtgaccacatcagggacctatgtatccgctatcgcccaggcaaaggccagtcaggagggacccttgcctgaaattgaggacgaagtgttcaggaaacgaaatctaactatcatggatctgcatccgggttctggcaagacccggcgctacctcccagctatagttagagaggccatcaagaggaaattacggacactggtccttgcacccacgcgagtggtggctagcgaaatggccgaggcgctgaaggggatgcctattagatatcaaactaccgccgtcaaatccgagcacacaggaaaggaaatcgtagacctcatgtgccatgcaacctttactatgcgcttgctgtcaccagtgagggttcccaactacaatatgattatcatggatgaggctcacttcacagaccctgcctctatagctgcacgtggctatattagcacccgggtgggtatgggggaagccgccgctatctttatgacggcgactccgcccggaagtatggaggcattcccacagtccaacgccgctatccaggatgaagagagagacattcctgagaggagctggaactctggctacgattggatcacagactttcccggcaaaaccgtctggttcgtgccatcaataaagtccgggaacgatattgccaattgtctccgcaagaacggaaaacgagttgtgcagctgagtagaaagacctttgacactgaatatcaaaagactaagaacaatgattgggactacgtcgtgaccacagacatcagcgagatgggtgcaaacttccgggccgatagggtaattgaccctcgccgttgccttaaacccgtgatcctaaaggatggcccagaaagagttatactggctgggccgatgcctgtcactgtggcgtcggccgcacagcggaggggacgcattggccgaaatcagaacaaggagggtgaccagtacatctatatggggcaacccttgaataacgatgaggaccatgctcactggacggaagccaaaatgttactggataatatcaacaccccagagggcattatccccgcactcttcgaacctgagagagaaaagtctgccgctattgacggagagtaccggctgaggggcgaggcccgcaaaacatttgtggaacttatgagaagaggggatctgccagtctggctctcctataaggttgcgagcgagggattccagtactcagaccggcgttggtgctttgatggtgaacgcaataaccaggtgttggaggaaaatatggacgtagagatatggactaaagagggcgaacgaaagaaactgagacccaggtggctagatgcacggacctatagtgaccctctggccctccgcgagttcaaggaatttgctgccgggagaaggtctgtgtccggagaccttatcctggagattggcaagttaccgcagcacttgacacaacgggctcagaacgcactggataatctcgtcatgctgcataacagcgaacagggtgggaaagcctaccgacacgctatggaggagcttccagacaccatcgaaactctgatgctcttggccctgatcgcagtgttaacgggcggagttaccctattctttctgtcaggcagagggctcggaaagacaagtattggtcttctgtgtgtgatggcgagctccgccttgctgtggatggcttctgtcgagccccattggatagccgcaagcatcattctcgagttctttctgatggtacttctcatccctgagcccgatcgccagaggactccacaagacaatcagctggcttatgtggttattggcttgctgttcatgatcttaaccgtggccgcaaacgagatggggctactggaaacaaccaaaaaggatctcggaataggccacgtcgccgctgagtcccaccatcacgcggccatgcttgacgtggatctgcatcctgcatcagcttggactttgtacgccgtcgccacaacggtgatcacccccatgatgcggcacactattgaaaacacaaccgcaaatatctctctgaccgctattgccaaccaggcggctatcctcatgggtctggacaaagggtggccaataagtaagatggatattggcgttcctcttttagccctgggatgctactcgcaagtgaatccgctcacattgactgcagccgtactgatgctagtggctcattatgcaatcattggccccgggctgcaggccaaggcgacgcgtgaggctcagaaaagaaccgccgcaggaatcatgaagaacccaacagtcgacggcatagttgccatcgatctcgaccctgtggtctacgatgctaaatttgaaaagcagcttggtcaaattatgctgttgatcctgtgtactagccagattctcctgatgaggaccacatgggccttatgcgagtccatcacccttgcaactgggcccctgacgacactctgggagggatctccaggcaaattctggaataccactatagctgtgtcaatggccaacatttttcgcggtagctatctagcgggcgccgggctggcattctccttgatgaagagtctgggaggcgggcggcgaggaaccggcgctcagggtgaaacactcggggagaagtggaaaagacagcttaatcaactgtctaagagcgagttcaacacttacaaaaggtcaggaatcatcgaggtagaccgctccgaagccaaggagggcttgaaacggggtgagaccacaaagcacgcagtgagtagaggcacggctaagctgcgttggtttgttgaaaggaatctcgtgaaacctgaggggaaggtcattgacttaggatgtggcagagggggatggagctattactgcgccggcctgaaaaaggtgaccgaagtcaaaggttatactaaagggggacccggccacgaggaaccgatcccaatggccacatacggctggaaccttgtgaaactgcattctgggaaggatgttttctttacccctcccgagaagtgtgacactctactctgcgatataggagagtcctcaccaaatcccacaattgaagagggtcgcaccctgcgagtattgaaaatggtggaaccttggctgagaggcaaccagttctgtatcaaggtcctcaatccgtacatgcccagcgtggttgagacgcttgagcagatgcagaggaaacacgggggaatgctggtgcggaacccattatcgcgcaattctacccatgaaatgtattgggtcagttgcggcacaggtaacattgtgtccgcggtaaatatgactagcagaatgctgttgaacaggtttaccatggctcaccgaaagcctacatacgagcgggacgtggatctcggggcaggaactcgtcacgttgccgtcgaacccgaggtggctaacctggacatcataggccaaagaatcgaaaatattaaaaacgagcataagtcaacctggcactatgatgaggacaatccttacaagacatgggcctatcatggctcctacgaagtgaaaccatctgggagcgcaagttccatggtcaacggagttgtgcgcctacttaccaagccctgggatgtaatccctatggtgactcagattgccatgacggacacaaccccattcggtcagcaaagggtctttaaagagaaggtggatactcggacccccaaagctaagagaggcacagcgcagatcatggaagttacggcccgctggctgtgggggttcctcagcaggaataagaaaccgcgaatttgtacccgggaggaatttactaagaaagtgagatctaacgcagctatcggagccgtcttcgtggacgagaatcagtggaactcagcaaaggaggccgtagaagacgagaggttttgggatctggttcaccgcgaacgtgagttgcataaacagggcaagtgcgctacatgcgtgtataatatgatgggtaagcgggagaaaaagctgggggagttcggaaaagccaagggcagtagagcgatatggtacatgtggctcggcgcaaggtttcttgagttcgaagccctggggttcatgaacgaggaccactggttttcccgcgaaaatagcttatctggagtcgagggtgagggcctgcacaaattggggtacattctccgagatatctcgaagatccctggaggcaacatgtatgctgacgataccgccggttgggacactcggattacagaagatgacctgcaaaatgaggcaaaaataaccgatatcatggaaccagagcatgctctacttgccacatcaattttcaagctgacttaccagaacaaggtggtgagagtccagaggcccgctaaaaatgggaccgttatggacgtgatcagccgcagagatcagcggggatccggccaagtaggcacgtatgggctcaacacctttacaaacatggaagcccagctgattaggcagatggagagtgagggaatcttcttgccttctgaattagagactccaaatctggcagaacgtgtgctcgactggcttgagaagtacggtatagaacgactgaaacgcatggcgatcagcggcgatgactgtgtcgtgaagcccattgacgatagatttgccaccgctctaacagccctgaacgacatggggaaagttcggaaggatatcccgcagtgggagccttccaagggatggaatgactggcaacaggtgcccttctgctcacaccattttcaccagctcattatgaaagatggcagggagatcgtcgtgccatgtcgcaaccaggacgaattggtaggtagagcacgggttagtcaaggggctggatggtctctgagggagactgcctgccttggcaagagctatgcacagatgtggcagctgatgtacttccaccgacgtgatctcagattagccgcgaatgctatatgttccgccgtgcctgtcgactgggtgcccacctcacgcacgacatggagcattcatgcacaccatcaatggatgaccactgaagatatgctgtctgtttggaaccgggtgtggatcgaggaaaatccatggatggaggacaaaacacacgtctccagttgggaggatgtgccctatttgggcaagagggaagaccagtggtgcgggagcctgatcggactcaccgccagagctacttgggccaccaacattcaggtagcaataaatcaggtgcgccggcttatcggtaacgagaattacctggactacatgacatcgatgaaaaggtttaagaacgaatccgatcctgagggcgctctatggtga

SEQ ID NO: 14222 - RNA, 9879 nt, synthetic construct
  misc_feature 1..9879: note = derived and/or modified CDS sequence (opt3) from DENV-1__KU666942__SS-prME
  source 1..9879: mol_type = other RNA
agcgtgaccatgctgctcatgcttatgcccacagcactggctttccacttgactacgagaggaggggaacctcatatgatcgtctccaagcaggaaaggggaaaatctttactgtttaagacctcagccggtgttaacatgtgcacactgattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccattctgaggaaactttgcatcgaagctaagatatctaatacgaccacagatagccggtgtccaactcaaggagaggccaccctggtggaagaacaggacgcaaacttcgtctgccgccgaacatttgttgatagaggctggggtaatgggtgtggattgttcggcaaaggctccctcattacttgcgctaagtttaagtgcgtgaccaaactggaggggaagatcgtacagtacgaaaacttaaaatattcagtgattgtcacagtgcacaccggagaccagcatcaagttggtaatgagagtactgaacacggcacgacagccaccatcactccccaggcgcctaccacagagatccagctgaccgactacggggccctcactcttgattgtagcccaaggacaggactggacttcaacgaaatggtgttgctaacgatgaaggagaaatcttggctggtccataagcagtggtttctcgatctgccgcttccctggacctccggcgcatcaactagccaagagacatggaatcggcaggacctgttggtgaccttcaaaacagctcacgccaagaagcaggaagtagttgtgctcggtagtcaagagggggctatgcacactgccctgaccggcgcaacggaaattcagacctctggaacaactaccatatttgccggccatttaaaatgccgtctgaagatggataaactaacactcaaggggatgtcctatgtcatgtgtactggttcgttcaaactggagaaggaagtggctgagacccagcacggtacggtccttgtgcagatcaagtacgagggcacagacgcgccttgcaaaattccattctcgacccaagatgaaaagggggttactcagaacggacgcttgatcacagcaaatcccatagtgaccgacaaagagaagcctgtaaacattgaagccgagccaccctttggcgagtcttatatcgtcatcggtgctggggaaaaagccctgaagctctcctggttcaagaaaggctcaagtattggaaagatgtttgaggcaactgccagaggcgctaggcggatggccatcctgggggataccgcatgggacttcggaagcattggtggcgtgtttacatccgttgggaaacttgtgcatcagatattcggaacggcgtacggcgtcctgttttctggtgtgagctggaccatgaagatcgggattggcgtattgctcacttggctgggattaaattcacgaagtacatccctgagcatgacctgtatcgctgtgggcctagttacactctacctgggggtcatggtgcaggccgattctggatgcgtgatcaactggaaaggccgcgaacttaagtgtggttcagggattttcgtcactaatgaggttcacacctggacggaacaatataagtttcaggcagacagtccgaaaagattgagcacagccataggaaaggcttgggaggagggcgtgtgcggtatcaggtccgccacccggctggaaaacattatgtggaaacagatctctaacgagctcaatcatattctgttagaaaacggcatgaagttcactgtggtagtcggggacgtggcaggaatcctggctcagggcaaaaagatgatacgccctcaacccatggagcacaaatactcgtggaaaagctgggggaaggccaagatcattggagcggatgttcagaataccacatttatcattgacggcccaaacactcctgaatgtcccgatgaccagagagcctggaatatctgggaggtggaggattatggtttcgggatatttaccacaaacatttggcttaagttgagggactcctacacgcaggtctgcgatcaccgtctcatgtcagctgcaatcaaagacagtaaggccgtgcatgctgatatgggatattggattgaatctgagaaaaatgaaacctggaagctggcccgggcatccttcatcgaggttaagacttgtatatggccaaaatcccacacactatggtcaaacggcgtgctggaaagcgagatgatcattcccaagatctacggtggccctatttctcaacataattatcgaccagggtacttcacccagactgcgggaccgtggcacctcggcaaactggagcttgactttgatttgtgcgaagggacaaccgtagtcgtggacgagcactgcggaaacagaggcccctccctgaggacgactaccgtgacaggtaagatcatacatgaatggtgttgccgcagttgtaccttacctccactccggtacagaggggaggatggatgctggtatggcatggagattaggcccgtcaaagaaaaggaggaaaatctggttaagagcatggtgtctgccggttccggcgaggtagactcattcagtcttgggctgttgtgtatcagcatcatgattgaagaggtgatgcgctcgcgatggtcccggaaaatgctcatgactggaacactggctgtctttttcctactgatcatgggccagctcacctggaacgacctgattcgtctttgcataatggtgggggccaatgcatctgatagaatgggaatgggcacaacttacttggctctgatggccacctttaagatgaggcctatgttcgcagttggtttactctttcgccggctgacgagcagagaggtgcttctgctaacaatcgggctctcactggtcgccagtatggaattgccaaactccctggaggaattaggagacggcctcgctatgggcattatgatcctgaaacttctgaccgatttccaatctcaccagttgtgggcgactctcctgagcctaacctttattaagacaactttctccctgcattatgcctggaaaaccatcgcaatggtgctttcaatagttagcctctttcccctgtgtttgagtacgacatctcagaagaccacttggctgccggtgttactcgggtccctgggatgcaagcctcttacaatgttcctgatcgctgagaataaaatttggggtagaaagagctggccattgaacgaaggcatcatggccgtcgggattgtatcgatcctcctgtcatctctactgaaaaacgacgtgccccttgccggacctctcatagctggcggtatgctgattgcatgttacgttatcagtgggtccagcgccgatttgtctttagagaaggcggctgaggtgagctgggaagaggaagccgagcactccggagcatcacataatatcctggtcgaagtgcaggacgatggcaccatgaaaattaaggacgaggagcgagatgacactctcacaatactgcttaaagccaccctgttggctgtaagtggcgtgtatcccctaagcatcccagcaacgctgtttgtctggtacttctggcaaaagaagaaacagcgctctggggttctctgggatactccttcacccccagaagtggagcgggccgtgctggacgatggaatttatagaatcatgcagaggggtcttttaggccgtagccaggtcggggtgggagttttccaagaaaacgtatttcacaccatgtggcacgtgacacgcggcgcggtcctgatgtaccagggtaagcggctcgagccgagttgggctagcgtgaaaaaggacttgatttcctacgggggaggctggagactgcagggctcttggaataccggggaggaagttcaggtgatcgccgtcgagcctggcaagaatcccaagaatgtgcaaacagcaccaggtactttcaagacccccgaaggcgaggtaggggccatagctctcgactttaaacctggaacgtcgggcagcccaatcgtcaacagggaaggtaagattgtggggctgtatggaaatggcgttgtgacaacttcaggcacctacgtctccgccatcgcacaggctaaagccagtcaggaggggccccttcctgagattgaagatgaggtgttccgaaagcggaacctgacaatcatggacttgcatccgggatctggtaaaacccgcagatatctaccagcgatagttagggaagccattaagcggaagctgcgaactctcatcttagcacccaccagagtggtcgctagcgagatggccgaagctctgaaaggcatgcctatccgctaccaaacaacggcagtgaagtccgagcacactgggaaagagattgtagatcttatgtgccatgccacctttacaatgaggctgctctcaccagtgcgtgttcccaattataacatgatcataatggacgaagcccacttcaccgatccttctagcattgctgcgcggggatacatcagtactagagtcggcatgggtgaggcagccgctatttttatgacagccaccccgcccgggtccgtggaagcattcccacagagcaatgccgtgatccaggacgaggaaagggatatacctgagcgctcttggaactcaggatatgagtggattacggactttcccggcaagactgtctggttcgtaccatccatcaaaagtggcaatgatatcgctaactgtttgcgaaagaatgggaagagagtgattcagctgagccggaaaacatttgacaccgaataccaaaagaccaaaaacaacgattgggactacgttgtgactacagacatctcggagatgggagcgaatttcagggccgatcgcgtcattgaccctcgtagatgcctcaagcccgtgatactgaaagatggtccagaacgggttatccttgcaggcccgatgcctgtgaccgtcgcttctgccgcacagaggcgcgggcgaattggaagaaaccataataaggagggcgaccagtatatctacatgggtcagcccctaaacaatgatgaggaccacgcccactggacagaagctaagatgctgttggataacatcaatactccagaggggattatacccgccttattcgaacctgagcgggaaaaatccgcggcaatcgacggcgagtataggctgcgcggagaggccagaaagacgtttgtggaactcatgaggcggggcgatctgccagtatggcttagctacaaagtggcttcagaggggttccaatatagtgaccgtcgctggtgctttgatggagaacgaaacaatcaggttctggaggaaaacatggacgtcgagatttggaccaaggagggtgaaaggaaaaagctcaggccccggtggttggatgcccgcacatactctgaccctctggctctaagagagttcaaagaatttgcagccggcaggcggtccgtgagcggggacctgatcctcgagattggaaaacttccgcagcatctgactcagcgagctcaaaatgccttagataacttggtgatgctgcacaattcagaacagggcggtagagcatatcgccatgcgatggaggagctcccagacaccatcgaaacactgatgcttctggccctcatagctgtcttgaccgggggcgttactctgttctttttaagtggaaagggcctagggaaaacgagcatcggactgctctgtgtgatggcctcctctgcacttctgtggatggctagcgtagagccccactggattgccgcatccatcattttggagttctttctgatggtgctcctgatccctgagcccgataggcagcggaccccacaggacaaccaacttgcctacgtcgtgataggtctcctgttcatgattttgacagttgctgcgaatgagatgggcctgttagaaactaccaagaaagatctagggatcggacacgtggccgtcgagaaccatcaccatgcagctatgctggacgtagatctccaccctgcctcagcctggacactttacgcagtggctaccactattatcacacccatgatgcgtcatacgatagaaaacaccactgccaatatctctctgacagcgattgctaaccaggccgcaatcttgatgggcctggacaagggttggccaattagtaaaatggatatcggggttcctctcctggcccttggctgctatagccaggtgaatccgttaaccctgaccgctgcagtcctcatgttggtggcccactacgcgataattggacccggcctgcaagctaaggccacaagagaggcacagaagaggactgccgctgggatcatgaaaaacccaacggtcgacggaatcgtggccattgatctagaccctgttgtgtatgatgcaaagtttgaaaaacagctgggccagatcatgctccttatactgtgtaccagccaaattttgctgatgcgcacaacttgggctctctgcgagtccatcaccctggccacaggtcccttaaccactctttgggaggggtctccaggaaagttctggaatacgacaattgcggtatcaatggccaacatctttcggggcagctacctggcaggagctggcctcgccttctccctaatgaaaagtctagggggaggccgaagagggaccggagcacagggcgaaactttgggtgagaagtggaagaggcagctgaatcagctctctaaaagcgagttcaacacctataagcgctcagggataatggaggtggaccggtccgaagctaaagagggacttaagagaggcgagacaactaaacacgccgtcagtcgtggtaccgccaagctgaggtggtttgttgaacggaatttggtgaagcctgagggcaaagtcatcgacctggggtgtggacgcggcgggtggagctactattgcgcgggactcaagaaagtgacagaagtaaagggctacacgaaaggtgggcccggacatgaggaaccggtgccaatggctacctacggctggaacttagttaagctgcactctggcaaagatgtgttctttattcctcccgagaagtgtgacactcttctgtgcgatatcggggagtcctcaccaaatcccacaattgaagagggacgaaccctaagagtcctcaagatggtggaaccttggctgaggggtaaccaattctgtatcaaaattttgaatccgtatatgcccagcgtcgtggagactctggagcagatgcagcggaagcatggcgggatgctcgttcgcaacccactttcgagaaattctacacacgaaatgtactgggtaagttgcggaaccggcaacatcgtgtccgcaataaatatgacgagcaggatgctgttaaaccgatttaccatggcccaccggaaacctacatatgagcgtgacgtcgatctgggtgctgggactagacatgtggccgttgaacccgaggtggcaaacttggacattatcggacagcgcatcgaaaatattaagtgtgagcacaaatcaacctggcattacgatgaggacaacccttataagacatgggcctaccacggctcctatgaagtcaagccatctggcagcgctagttccatggtgaatggggtagtgaaactcctgactaagccctgggatgttatacctatggtcacccaaatcgcgatgacagacaccactccattcggacagcagagggtgtttaaagagaaggtggatacgcggacacccaaagccaagagaggtaccgcacaaattatggaagtcactgctcgctggctatggggcttccttagcaggaacaagaaaccgcgaatctgcacccgggaggaatttacaagaaaggttaggtctaatgccgcaattggggccgtgttcgtagacgagaaccagtggaactcagctaaagaggccgtggaagacgagcgcttttgggatctggtccatcgtgaacgggagctccacaagcagggaaaatgcgcgacgtgtgtgtacaacatgatgggcaagagagaaaagaaactgggtgagttcgggaaggcaaaaggaagtagggccatctggtacatgtggttgggcgctcgctttctggagttcgaagccctcggcttcatgaatgaggaccactggttttcccgagaaaacagcctttctggggttgagggagagggtctgcataagttaggctatatactgcgggatatctcgaaaatttcagggggaaatatgtacgcagacgataccgctggctgggacactagaatcacagaagatgacttgcagaacgaggccaagattaccgaaatcatggagcctgaacacgctcaactcgccaaagcaatattcaagctgacttatcagaataaggtggtcagggtgcagcgcccagcgaaaaacggtacagtaatggatgttattagcagacgggaccagagggggtccggacaagtgggcacctacggcctaaatacatttactaacatggaggcccagcttatccgtcagatggagagtgaagggatcttctctcccagcgagctggaaacccctaacctcgctgagcgagtcctggattggttggaaaagtatggagtggagcgcttaaaaagaatggccatttccggtgacgattgcgtggtcaagccaatagacgaccggtttgcaacggctctgaccgccctcaatgatatgggcaaagttaggaaggacatcccccagtgggagccgtcaaaggggtggaacgattggcaacaggtgcctttctgtagtcatcactttcaccagcttattatgaaagacggacgcgaaatcgtagtgccctgcagaaatcaggatgagctggtcggccgggcaagggtgtctcaaggtgccgggtggagcctacgagaaacagcgtgtctgggaaagtcctacgctcagatgtggcagctcatgtatttccatcgtagagacttgcgcctggccgcaaacgccatttgctcagctgttccagtggattgggtccctactagccggaccacatggtctatccacgcccatcaccaatggatgactaccgaggacatgctttccgtgtggaatagggtatggatagaagagaacccctggatgaaagataagacgcatatcagtagctgggaggacgttccatacctgggcaaaagagaagatcagtggtgtggctcgctcattgggttaacagcacgcgctacctgggccactaatatccaggtggcgattaaccaggtccggaggctgatcggaaatgagaactacttggactatatgacatccatgaagcgatttaagaatgaatctgaccccgagggtgctctgtggtga

SEQ ID NO: 14223 - RNA, 9879 nt, synthetic construct
  misc_feature 1..9879: note = derived and/or modified CDS sequence (opt3) from DENV-1__KU666939__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggttctccggcaccctggattcaccgtgattgctctgtttctggcacatgccatcggcacatcgattacccagaagggcatcatattcatcctcttaatgctggtcacgccatcaatggctatgcgctgcgtggggattggaagcagagattttgtagagggtcttagtggcgccacttgggttgacgtggtcttggagcacgggtcctgtgtgacaaccatggcgaaggataaacccactctggacatcgaactactcaagacagaggtgaccaaccctgcagtcctgaggaaactttgcattgaagccaagatctctaatacgaccacagatagccggtgtccaactcaaggagaggctaccctggttgaagagcaggacgccaacttcgtgtgccgccgaacatttgtagatagaggctggggtaatgggtgtggattgttcggcaaaggctccctcataacttgcgcaaagtttaagtgcgtgaccaaactggaggggaagattgtccagtacgaaaacttaaaatattcagtgatcgttacagtgcacaccggagaccagcatcaagtcggtaatgagagtactgaacacggcacgacagctaccattactccccaggcccctaccacagagatccagctgaccgactacggggcgctcactcttgattgtctgccaaggacaggattggacttcaacgaaatggtgctactgacgatgaaggagaaaagctggctcgtacataagcagtggtttctggatcttccgctgccctggacctctggcgcctccacttcacaagagacatggaatcggcaggacttgctcgttaccttcaaaacagcacacgctaagaagcaggaagtggtcgtgctgggtagccaagagggggccatgcacactgctttaaccggcgccacggaaatccagaccagtggaacaactaccatttttgcaggccatctgaaatgccgtctaaagatggataaactcacactgaaggggatgtcttatgtcatgtgtactggatccttcaaacttgagaaggaagtggccgagacccagcacggtacggttttggtgcagataaagtacgagggcacagacgctccttgcaaaatcccattcagcacccaagatgaaaagggggtaactcagaacggacgcctgattacagcgaatcccatcgtcaccgacaaagagaagcctgtgaacatagaagcagagccaccctttggcgagtcgtatattgttatcggtgccggggaaaaagctctcaagctgtcttggttcaagaaaggctcctcaatcggaaagatgtttgaggccactgcaagaggcgccaggcggatggctattcttggggataccgcctgggacttcggaagtatcggtggcgtgtttacaagcgtcgggaaactggtgcatcagattttcggaacggcatacggcgtattgttttccggtgtgtcttggaccatgaagatagggatcggcgttctcctgacttggttaggactgaatagccgatcaacaagtctatccatgacctgtattgcggtcggcctcgtgacactgtaccttggggtgatggtccaggctgatagcggatgcgttatcaactggaaaggccgcgaattgaagtgtggttctgggatcttcgtgactaatgaggtgcacacctggacggaacaatataagtttcaggccgactcaccgaaaagactgagtgcagccattggaaaggcttgggaggagggcgtatgcggtataaggagcgccacacggctcgaaaacatcatgtggaaacagatttccaacgagctgaatcatatcttactggaaaacgacatgaagttcaccgtcgtggttggcgatgtggcagggattcttgctcagggaaaaaagatgatccgccctcaacccatggagcacaaatactcttggaagtcgtggggcaaggccaaaataatcggggcggacgtccagaatactacctttattatcgatggaccaaacacacctgaatgtcccgacgatcagagagcctggaatatttgggaggtggaggactatggcttcggtatctttactaccaacatatggttgaagctcagggatagctacacacaggtttgcgaccaccgtctgatgtccgctgcaattaaagattcaaaggccgtgcatgctgacatggggtattggatcgaaagtgagaaaaatgaaacgtggaagctagcccgggcatctttcattgaggtaaagacctgtatctggccaaaaagccacactctgtggtccaacggagtcctcgaatcagagatgataatccccaagatttacggcggtcctatcagccaacataattatcgaccaggctacttcacacagaccgcggggccgtggcacctgggaaaacttgagttggattttgacctgtgcgaaggcactacagtggtggtcgatgagcactgcgggaacagaggaccctctttaaggaccacgactgttaccggcaagattatccatgaatggtgttgccgctcctgtacactccctccactgcggttcagaggtgaggacgggtgctggtacggaatggagataaggcccgtgaaagaaaaggaggaaaatcttgtaaagagtatggtgagcgccggctctggtgaggtcgactccttttcactgggcttgctctgtattagtatcatgatcgaagaggtgatgcgcagccgatggtcgcggaaaatgctgatgaccgggactctagctgttttctttctgctcattatgggacagctgacatggaacgatcttatccgtttgtgcattatggtgggcgccaatgcatccgacagaatggggatgggaaccacatatctggctttaatggccactttcaagatgaggcctatgtttgcagtcggcctcctgttccgccggcttacctctagagaggtgctgctactcacgataggtctgagcttggttgcctcagtggaactgccaaacagtttagaggaactcggggatggactggctatgggcatcatgattcttaaactgttgacagactttcaatcccaccagctctgggcgaccctgctatctctgactttcatcaagaccacatttagccttcattacgcctggaaaactatggcaatggtcctctccattgtatcactgatccccttgtgtctgagcaccacgagtcagaagacaacctggttaccggtgctcctgggctctcttgggtgcaagcctctgactatgttcttgatagctgagaataaaatctggggaaggaagtcctggccactcaacgaaggtattatggccgttggcatcgtgagcattctgctatcgtcactgcttaaaaacgatgtccccctcgccgggcctctgatcgctggaggcatgttgatagcatgttatgtgatttctggtagttccgccgacttactgctcgagaaggcggctgaggtaagctgggaagaggaagccgagcactctggggcaagccataatatcctggtggaagtccaggatgacggaacaatgaaaatcaaggatgaggagcgagacgatacccttactattctgttgaaagccacactactggctatatccggcgtttaccccctctcaatcccagcaaccctgtttgtgtggtatttctggcaaaagaagaaacagcgcagtggcgtgctttgggacacgcctagccccccagaagtcgagcgggccgtgttagatgacgggatttacagaatcatgcagaggggactgctcggtcgttctcaggttggcgtaggggtgttccaagaaaacgtctttcacactatgtggcacgtgacccgcggagcggttttgatgtatcagggcaagcggctggagccgtcctgggcttcagtgaaaaaggacctcattagttacggtgggggatggagactgcagggcagctggaatacaggcgaggaagtccaggtgatcgccgtagagcctgggaaaaaccccaagaatgtccaaaccgcaccaggaacattcaagactcccgaaggtgaggtgggcgccatagctcttgattttaaacctgggacctccggatctccaatcgttaacagggaaggcaagattgtgggtctgtacgggaatggagtcgtgacgacatcgggcacttatgttagcgccatcgcacaggctaaagcctcacaggagggccccttgcctgagattgaagacgaggtgttccgaaagcggaacctaaccatcatggatctgcatccggggtccggaaaaacacgcagatacctcccagcgatagtcagggaagccattaagcggaagttacgaaccctgatccttgcacccactagagtggtagctagtgagatggccgaagctctgaaaggtatgcctatccgctatcaaaccacagcagtgaagtctgagcacacgggcaaagagattgttgacctcatgtgccatgccacttttaccatgaggttgctgagcccagtccgtgtgcccaattacaacatgatcataatggatgaagcccacttcacagacccttcctcaattgctgcgcgggggtatatctctaccagagtgggaatgggcgaggcagccgctatttttatgactgccacaccgcccggtagcgtcgaagcattcccacagagtaatgccgtaatccaggatgaggaaagggacatacctgagcgctcctggaacagcgggtacgagtggattaccgattttcccggaaagacggtgtggttcgttccatctatcaaatcaggcaatgacatcgctaactgtctccgaaagaatggcaagagagtgattcagctgtcccggaaaacttttgatacagaatatcaaaagaccaaaaacaacgactgggactacgtcgtgaccactgatatcagtgagatgggggcgaatttcagggccgaccgcgttattgatcctcgtagatgccttaagcccgtgatactaaaagacggaccagaacgggtcatcctggcaggtccgatgcctgtgacagtagctagcgccgcacagaggcgcggccgaattgggagaaaccataataaggagggagatcagtacatctatatgggccagcccttgaacaatgacgaggatcacgcccactggaccgaagctaagatgttactggacaacatcaatacaccagagggtattatacccgccctcttcgaacctgagcgggaaaaatcggcggcaatcgatggggagtacaggctgcgcggcgaggccagaaagacttttgtggaacttatgaggcggggagacctgccagtttggctctcttataaagtcgcttccgagggcttccaatacagcgatcgtcgctggtgctttgacggggaacgaaacaatcaggtgttggaggaaaacatggatgtggagatttggacgaaggagggagaaagaaaaaagctgaggccccggtggctagacgcccgcacctattcagaccctctggctctcagagagttcaaagaatttgcagccggtaggcggagtgtctctggcgatcttatcctggagattgggaagttaccgcagcatttgacacagcgagctcaaaatgccctggacaacctcgttatgctgcacaattccgaacagggaggcagagcataccgccatgcgatggaggagcttccagatactatcgaaaccctgatgctcttggccctgatagctgtgttaacaggtggggtaaccctattctttctgagcggcaggggactcggcaagacttcaatcgggcttctgtgtgtgatggccagtagcgtcttgctgtggatggcatccgtggagccccactggattgctgcctctatcattctcgaattctttctgatggttcttctcatccctgagcccgaccggcagcgtacgccacaggataaccaactggcatatgtggtcataggattgctgttcatgattttaaccgtagccgctaatgagatgggtctactggaaacaactaaaaaggacctcggcatcgggcacgtggcggttgagaaccatcaccatgccaccatgcttgatgtggacctgcaccctgcaagcgcttggacattgtacgccgtcgccaccactattatcacacccatgatgagacatacgatagaaaacaccactgcaaatatctccctgacagctattgccaaccaggcggctatcctcatgggactggataaaggctggccaatttcaaagatggacatcggtgtgcctcttttagccctggggtgctactctcaggtcaatccgctcaccttgaccgcagccgtgctgatgctagttgctcactatgcaataattggccccggactgcaagccaaagcgacaagggaggctcagaagcgcactgccgcaggcatcatgaagaacccaacggtggatgggatcgtagccattgacctcgatcctgtggtctacgacgctaaatttgaaaagcagcttggacagatcatgctgttgatactgtgtaccagtcaaattctcctgatgcggacaacttgggccttatgcgagtcgatcacccttgcaacaggccccctgaccactctctgggagggtagcccagggaaattctggaatacgacaattgctgtttccatggccaacatctttcgaggatcttatctagcgggcgccggtctggcattctcattgatgaagagcctgggcgggggaagaaggggcaccggggctcagggagaaactctcggcgagaaatggaagcgccagcttaatcagctgtccaagagtgaattcaacacctacaaacggtctggtataatggaggtggacagaagcgaagccaaggaggggttgaaacgtggagagacaactaagcacgcagtctcaaggggcaccgctaaactgcggtggtttgtggaacgcaatctcgtaaagcctgagggtaaggtgatcgatttaggctgtgggcgaggaggctggtcctattactgcgccgggctgaaaaaggttacagaagtgaaaggatatacgaagggcggtcccgggcatgaggaaccgattccaatggccacctacggatggaaccttgtcaaactgtacagtggcaaggacgtgttctttatccctcccgagaaatgtgatactctactctgcgacattggcgagagctctccaaatcccacaatcgaagaggggagaaccctgagggtcttgaagatggtggaaccttggctgcggggaaaccaattctgtattaagatcctcaatccgtatatgccctccgttgtagagactcttgagcagatgcagcgcaaacacggtggcatgctggtgagaaacccattatcaaggaatagcacacatgaaatgtactgggtctcgtgcgggaccggaaacatagtgtctgcggttaatatgacgagtcgaatgctgttgaaccggtttaccatggctcaccgtaagcctacatatgagagagatgtggacctcggcgcaggtactcgccacgtcgccgtggaacccgaggtagctaacctggatattatcgggcagaggatcgaaaatattaaacatgagcacaagtccacctggcattacgacgaggataacccttataaaacatgggcctaccacggaagctatgaagtgaagccatcaggctccgcatctagcatggttaatggcgtcgtgaagctacttactaaaccctgggacgtgatacctatggtcacccaaatcgccatgacagataccactccattcgggcagcagcgggtttttaaggagaaagtggacacgagaacacccaaggctaaacgcggaaccgcgcaaattatggaagtaactgccaggtggctgtggggtttcctcagtcgaaacaagaagccgcggatctgtaccagagaggaatttacaaggaaagtgcgctccaatgcagctattggcgccgtcttcatcgacgagaaccagtggaatagcgcaaaggaggccgtggaagatgagcgtttttgggacctggttcatcgggaaagagagttgcacaaacaggggaagtgcgctacgtgcgtgtacaacatgatgggaaaaagggaaaagaagctgggcgagttcggtaaagccaaggggtctcgcgcgatatggtacatgtggctcggagcacgatttcttgagttcgaagccctgggcttcatgaatgaggatcactggttttcacgggaaaacagtttatccggcgtcgagggggagggactgcataaattgggttatatcctcagagacattagcaagatccctggcgggaatatgtacgctgatgacaccgccggatgggatactaggattacagaagacgatctgcagaacgaggcaaaaatcaccgacataatggaaccagagcacgctctacttgccaaggctattttcaaactgacttatcaaaataaggtggtacgcgttcagagacccgccaagaacggcacagtgatggatgtcatctctcggagggaccagcgtggttcggggcaggtgggaacctacggcctcaatacatttactaacatggaagcacaactgatccgacagatggagtcagagggcattttcagcccttccgaattggagaccccaaacttagcggaacgcgtgctggattggctcgggaaatatggagtcgagagacttaagcggatggccataagtggtgacgactgtgttgtgaaacccatcgatgacaggtttgctacggccctgaccgcactaaatgatatgggcaaggtacgcaaagacattccgcagtgggaaccttctaaggggtggaacgattggcagcaagtgcccttctgcagccatcactttcaccagctgatcatgaaggacggaagagagattgtcgtgccatgtcggaatcaggatgagctcgttggcagggctcgagtgtcccagggtgccgggtggtcattgcgtgaaacagcatgcctgggaaaaagttacgcccaaatgtggcagcttatgtatttccatagacgcgacctgcggctcgcggctaacgccatctgttctgcagtccctgtggattgggtacccactagcaggaccacatggtccatacacgcccatcaccagtggatgactaccgaggacatgttatcagtttggaatagagtgtggatcgaagagaacccatggatggaagataagacgcatattagctcttgggaggacgtcccctacctgggcaaacgcgaggaccaatggtgcggctccttgatcgggctgacagctcgggccacctgggcaactaatattcaggtggctatcaaccaggttaggcgactcattggaaatgaaaactaccttgattatatgacaagtatgaagagatttaaaaatgagagcgaccctgaaggtgccctgtggtga

SEQ ID NO: 14224 - RNA, 9879 nt, synthetic construct
  misc_feature 1..9879: note = derived and/or modified CDS sequence (opt3) from DENV-1__KU666940__SS-prME
  source 1..9879: mol_type = other RNA
agcgtgaccatgctgctcatgcttacccccactgcactggctttccacttgacgaccagaggaggggaacctcatatgatcgtctccaagcaggaaaggggaaaatctttactgtttaagacgtcagccggtgttaatatgtgcactctaattgccatggacctcggcgagctgtgtgaagataccatgacatacaaatgcccacggataaccgaggcggaaccggacgatgtggactgttggtgcaatgctactgatacatgggtaacctatgggacgtgtagtcaaactggagagcaccgccgagacaagcgtagcgtggcccttgcaccccatgtcggcctgggtttggagaccagaacagaaacttggatgtcctctgagggggcctggaaacagatccagagggtggaaacctgggctctccggcaccctggattcacagttattgcactgtttctggcccatgctatcggcacctcgattacgcagaagggcatcatattcatcctcttaatgctggtgactccatcaatggccatgcgctgcgtcgggattggaagcagagattttgtggagggtcttagtggcgcgacatgggtagacgttgtgttggagcacgggtcctgtgtcaccactatggcaaaggataaacccacactggacatcgaactactcaagaccgaggtgacgaaccctgccgtgctgaggaaactttgcattgaagctaagatctctaataccacaactgatagccggtgtccaacccaaggagaggccacactggtcgaagaacaggacgcaaacttcgtttgccgccgaacttttgtggatagaggctggggtaatgggtgtggattgttcggcaaaggctccctcataacctgcgctaagtttaagtgcgtaacaaaactggaggggaagattgtgcagtacgaaaacttaaaatattcagtcatcgtgaccgttcacactggagaccagcatcaagtgggtaatgagagtacggaacacggcacaaccgccactattacaccccaggcgcctacaaccgagatccagctgactgactacggggccctcacacttgattgtagcccaaggacgggactggacttcaacgaaatggtcttgctaaccatgaaggagaaatcttggctggtgcataagcagtggtttctcgatctgccgcttccctggacttccggcgcatcaacaagccaagagacctggaatcggcaggacctgttggtaacattcaaaactgctcacgccaagaagcaggaagttgtggtcctcggtagtcaagagggggctatgcacaccgccctgacgggcgcaaccgaaatccagacatctggaactaccacaatttttgccggccatttaaaatgccgtctgaagatggataaactaactctcaaggggatgtcctatgtgatgtgtaccggtagcttcaaactggagaaggaagtcgctgagacgcagcacggaacagtgcttgttcagataaagtacgagggcaccgacgcgccttgcaaaatcccattctcgactcaagatgaaaagggggtgacacagaacggacgcttgattaccgcaaatcccatcgtaactgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaaccgccagaggcgctaggcggatggccattctgggggatacagcatgggacttcggaagcatcggtggcgtttttacgtccgtggggaaacttgtccatcagattttcggaaccgcgtacggcgtgctgttttctggtgtaagctggactatgaagatagggatcggcgtgttgctcacatggctgggattaaattcacgaagtacctccctgagcatgacatgtattgctgttggcctagtcactctctacctgggggtgatggtgcaggccgattctggatgcgtcatcaactggaaaggccgcgaacttaagtgtggttcagggatcttcgttaccaatgaggtgcacacgtggacagaacaatataagtttcaggcagacagtccgaaaagattgagcgccgctattggaaaggcctgggaggagggcgtgtgcggtataaggtccgcaacccggctggaaaacatcatgtggaaacagatttctaacgagctcaatcatatcctgttagaaaacgacatgaagttcactgtagtcgtgggcgatgttgctgggattctggcccagggcaagaagatgatccgccctcaacccatggagcacaaatactcgtggaaaagctggggcaaggcgaagataatcggggccgacgtgcagaataccacatttattatcgatggaccaaacactcctgaatgtcccgacgatcagagagcttggaatatttgggaggtcgaggactatggcttcggtatctttaccacaaacatatggcttaagttgagggattcctacacacaggtgtgcgaccaccgtctcatgtcagcagccattaaagatagtaaggctgttcatgccgacatggggtattggatcgaatctgagaaaaatgaaacctggaagctggcacgggcgagcttcattgaggtgaagacttgtatctggccaaaatcccacacactatggtcaaacggagtactggaaagcgagatgataatccccaagatttacggcggtcctatctctcaacataattatcgaccaggctacttcacccagactgccgggccgtggcacctcggaaaactggagcttgattttgacttgtgcgaaggcacaaccgtcgtggtggatgagcactgcgggaacagaggaccctccctgaggacgactaccgtcacaggcaagattatccatgaatggtgttgccgcagttgtaccttacctccactccggtacagaggtgaggacgggtgctggtatggaatggagataaggcccgttaaagaaaaggaggaaaatctggtgaagtccatggtatctgctggctccggtgaggtggactcattcagtcttggcctgttgtgtattagcatcatgatcgaagaggtcatgcgctcgcgatggtcccggaaaatgctcatgactgggacactggccgtgtttttcctactgattatgggacagctcacctggaacgatctgatccgtctttgcattatggttggcgcaaatgcttctgacagaatggggatgggaacaacttacttggccctgatggcaacctttaagatgaggcctatgttcgccgtgggcttactctttcgccggctgacgagcagagaggtccttctgctaacaataggtctctcactggtggctagtgttgaattgccaaactccctggaggaattaggggatggactcgcgatgggcatcatgattctgaaacttctgaccgacttccaatctcaccagttgtgggccactctcctgagcctaacctttatcaagacaactttctccctgcattatgcatggaaaaccattgctatggtgctttcaatcgtcagcctctttcccctgtgtttgagtacgacatctcagaagaccacttggctgccggtattactcggctccctggggtgcaagcctcttacaatgttcctgatagccgagaataaaatctggggaagaaagagctggccattgaacgaaggtattatggccgtgggcatcgtttcgattctcctgtcatctctactgaaaaacgatgtgccccttgctgggcctctcatcgcaggaggcatgctgatagcctgttacgtcattagtggttccagcgcggacttgtctttagagaaggctgccgaggtgagctgggaagaggaagcagagcactccggggcctcacataatatcctggtagaagtgcaggatgacggaaccatgaaaatcaaggatgaggagcgagacgatactctcacaattctgcttaaagctaccctgttggcagtcagtggcgtttatcccctaagcataccagccacgctgtttgtgtggtacttctggcaaaagaagaaacagcgctctggcgtgctctgggacactccttcacccccagaagtcgagcgggcggtgctggatgacgggatctatagaattatgcagaggggacttttaggtcgtagccaggttggcgtaggggtgttccaagaaaacgtctttcacaccatgtggcacgtgacacgcggagctgttctgatgtaccagggcaagcggctcgagccgagttgggccagcgtgaaaaaggacttgatctcctacggtgggggatggagactgcagggctcttggaataccggcgaggaagtccaggtgattgcagtagagcctgggaaaaaccccaagaatgtccaaacagccccaggaactttcaagacccccgaaggtgaggtgggcgctatcgccctcgattttaaacctgggacgtcgggaagcccaatagttaacagggaaggcaagatcgtgggtctgtatgggaatggagtcgtgacaacttcaggcacctacgtttccgcaattgctcaggccaaagcgagtcaggagggcccccttcctgagatcgaagacgaggtgttccgaaagcggaacctgacaattatggatttgcatccggggtctggaaaaacccgcagatatctaccagccatcgtcagggaagcaataaagcggaagctgcgaactctcattttagctcccaccagagtggtagccagcgagatggctgaagcactgaaaggtatgcctatccgctaccaaacaacggccgtgaagtccgagcacactggcaaagagatcgttgaccttatgtgccatgccacctttacaatgaggctgctctcaccagtccgtgtgcccaattataacatgattatcatggatgaagctcacttcaccgacccttctagcatagcggcacgggggtacattagtactagagtgggaatgggcgaggccgctgccatctttatgacagcaaccccgcccggttccgtcgaagccttcccacagagcaatgctgtaattcaggatgaggaaagggacatccctgagcgctcttggaactcagggtatgagtggataacggattttcccggaaagactgtgtggttcgttccatccattaaaagtggcaatgacatcgcgaactgtttgcgaaagaatggcaagagagtgatccagctgagccggaaaacatttgataccgaataccaaaagaccaaaaacaacgactgggactacgtcgtgactacagatatttcggagatgggggccaatttcagggcagaccgcgttatcgatcctcgtagatgcctcaagcccgtgattctgaaagacggaccagaacgggtcatacttgctggtccgatgcctgtgaccgtagcctctgcagcccagaggcgcggccgaatcgggagaaaccataataaggagggagatcagtatatttacatgggccagcccctaaacaatgacgaggatcacgctcactggacagaagccaagatgctgttggacaacatcaatactccagagggtatcattcccgcgttattcgaacctgagcgggaaaaatccgcagccatagatggggagtataggctgcgcggcgaggctagaaagacgtttgtggaactcatgaggcggggagacctgccagtttggcttagctacaaagtcgcctcagagggcttccaatatagtgatcgtcgctggtgctttgacggggaacgaaacaatcaggtgctggaggaaaacatggatgtggagatctggaccaaggagggagaaaggaaaaagctcaggccccggtggttggacgctcgcacatactctgaccctctggcactaagagagttcaaagaatttgccgctggtaggcggtccgtcagcggcgatctgattctcgagatcgggaaacttccgcagcatctgactcagcgagcccaaaatgcattagacaacttggttatgctgcacaattcagaacagggaggcagagcgtatcgccatgccatggaggagctcccagataccattgaaacactgatgcttctggctctcatcgccgtgttgaccggtggggtaactctgttctttttaagtggcaagggactaggcaaaacgagcatagggctgctctgtgtgatggcatcctctgtccttctgtggatggctagcgtggagccccactggatcgccgcatccattatcttggagttctttctgatggttctcctgattcctgagcccgacaggcagcggaccccacaggataaccaacttgcctacgtggtcatcggactcctgttcatgatattgacagtagctgcgaatgagatgggtctgttagaaactaccaagaaagacctaggcattgggcacgtggccgttgagaaccatcaccatgcagctatgctggatgtggacctccaccctgcctcagcctggacactttacgcagtcgctaccactatcattacacccatgatgcgtcatacgatcgaaaacaccactgccaatatatctctgacagcgatcgctaaccaggccgcaattttgatgggactggataagggctggccaatcagtaaaatggacattggtgtgcctctcctggcccttgggtgctattcgcaggtcaatccgttaaccctgaccgctgcagtgctcatgttggttgcccactacgcgatcataggccccggactgcaagctaaggccacaagagaggcacagaagaggactgccgctggcattatgaaaaacccaacggtggatgggatcgtagccatcgacctagatcctgtggtctatgacgcaaagtttgaaaaacagctgggacagattatgctccttatcctgtgtaccagccaaatattgctgatgcgcacaacttgggctctctgcgagtccattaccctggccacaggccccttaaccactctttgggagggttctccagggaagttctggaatacgacaatcgcggtttcaatggccaacatttttcggggaagctacctggcaggcgctggtctcgccttctccctaatgaaaagtctgggcgggggacgaagaggcaccggggcacagggagaaactttgggcgagaagtggaagaggcagctgaatcagctctctaaaagcgagttcaacacctataagcgctcaggtatcatggaggtggaccggtccgaagctaaagaggggcttaagagaggagagacaactaaacacgccgtcagtcgtggcaccgccaagctgaggtggtttgtggaacggaatttggtaaagcctgagggtaaagtgatagatctgggctgtgggcgcggaggctggagctactattgcgcggggctcaagaaagttacagaagtgaagggatacacgaaaggcggtcccgggcatgaggaaccggtcccaatggctacctacggatggaacttagtgaagctgcactctggcaaagacgtcttctttatccctcccgagaagtgtgatactcttctgtgcgacattggcgagtcctcaccaaatcccacaatcgaagaggggcgaaccctaagagtgctcaagatggttgaaccttggctgaggggaaaccaattctgtattaaaatcttgaatccgtatatgcccagcgtagtggagactctggagcagatgcagcggaagcatggtggcatgctcgtccgcaacccactttcgagaaattctacacacgaaatgtactgggtgagttgcgggaccggaaacattgtttccgcaatcaatatgacgagcaggatgctgttaaaccgatttaccatggcccaccggaaacctacatatgagcgtgatgtggacctgggcgctggtactagacatgtcgccgtggaacccgaggtagcaaacttggatataattgggcagcgcatcgaaaatatcaagtgtgagcacaaatcaacctggcattacgacgaggataacccttataagacatgggcctaccacggatcctatgaagtgaagccatctggcagcgctagttccatggttaatggcgtcgtgaaactcctgactaagccctgggacgtgattcctatggtcacccaaatagcgatgacagataccactccattcgggcagcagagggtttttaaagagaaggtggacacgcggacacccaaagccaagagaggaaccgcacaaatcatggaagtaactgctcgctggctatggggtttccttagcaggaacaagaaaccgcgaatttgcacccgggaggaatttacaagaaaggtgaggtctaatgccgcaatcggcgccgtcttcgtggacgagaaccagtggaactcagctaaagaggccgttgaagatgagcgcttttgggacctggtgcatcgtgaacgggagctccacaagcaggggaaatgcgcgacgtgtgtctacaacatgatgggaaagagagaaaagaaactgggcgagttcggtaaggcaaaagggagtagggccatttggtacatgtggttgggagctcgctttctggagttcgaagccctcggcttcatgaatgaggatcactggttttcccgagaaaacagcctttctggcgtggagggggagggactgcataagttaggttatatcctgcgggacatatcgaaaatctcaggcgggaatatgtacgcagatgacaccgctggatgggatactagaattacagaagacgatttgcagaacgaggccaagatcaccgaaattatggagcctgaacacgctcaactcgccaaagcaatcttcaagctgacttatcagaataaggtagttagggtgcagcgcccagcgaaaaacggcacagtcatggacgtgataagcagacgggatcagaggggttccgggcaagtgggaacctacggcctaaatacatttactaacatggaggcccagcttattcgtcagatggagagtgaaggcatcttctctcccagcgagctggaaacccctaacctcgctgagcgagtcctggactggttggaaaagtatggggttgagcgcttaaaaagaatggccatctccggagatgactgcgtggtaaagccaattgacgatcggtttgcaacggctctgaccgccctcaatgacatgggtaaagtgaggaaggatataccccagtgggagccgtcaaagggctggaacgactggcaacaggtccctttctgtagtcatcactttcaccagcttatcatgaaagatgggcgcgaaattgtggttccctgcagaaatcaggacgagctggtgggacgggcaagggtctctcaaggcgccggttggagcctacgagaaacagcgtgtctggggaagtcctacgctcagatgtggcagctcatgtatttccatcgtagagatttgcgcctggccgcaaacgccatctgctcagctgtgccagtagactgggttcctactagccggaccacatggtctattcacgcccatcaccaatggatgactaccgaggatatgctttccgtgtggaatagggtctggatcgaagagaacccctggatgaaagacaagacgcatataagtagctgggaggatgtgccatacctgggaaaaagagaagaccagtggtgtggctcgctcatcggcttaacagcacgcgctacctgggccactaatattcaggttgcgatcaaccaggtgcggaggctgattgggaatgagaactacttggactatatgacatccatgaagcgatttaagaatgaatctgatcccgagggagctctgtggtga

SEQ ID NO: 14225 - RNA, 9879 nt, synthetic construct
  misc_feature 1..9879: note = derived and/or modified CDS sequence (opt3) from DENV-1__KU666941__SS-prME
  source 1..9879: mol_type = other RNA
agcgtgaccatgctgctcatgcttatgcccacagcactggctttccacttgactacgagaggaggggagcctcatatgatcgtctccaagcaggaaaggggaaaatctttactgtttaagacctcagccggtgttaacatgtgcacactgattgccatggacctcggagagctgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattggagctaagatctctaatacgaccacagatagccggtgtccaactcaaggcgaagccaccctggtcgaggaacaggacgcaaacttcgtttgccgccgaacatttgtggatagaggttgggggaatggatgtggcttgttcggcaaagggtccctcataacttgcgctaagtttaagtgcgtaaccaaactggagggaaagattgtgcagtacgagaacttaaaatattcagtcatcgtgacagttcacaccggtgaccagcatcaagtgggcaatgaaagtactgagcacgggacgacagccaccattactccccaggcgcctaccacagaaatccagctgaccgactacggagccctcactcttgattgtagcccaaggacaggcctggacttcaacgagatggtcttgctaacgatgaaggaaaaatcttggctggtgcataagcagtggtttctcgatctgccgcttccctggacctccggtgcatcaactagccaagagacatggaatcggcaggacctgttggtaaccttcaaaacagctcacgccaagaagcaggaggttgtggtcctcgggagtcaagaaggcgctatgcacactgccctgaccggagcaacggagatccagacctctggcacaactaccatttttgccgggcatttaaaatgccgtctgaagatggataaactaacactcaagggaatgtcctatgtgatgtgtactggtagcttcaaactggaaaaggaggtcgctgaaacccagcacggcacggtgcttgttcagataaagtacgaggggacagacgcgccttgcaaaatcccattctcgacccaagatgagaagggagtgactcagaacggccgcttgattacagcaaatcccatcgtaaccgacaaagaaaagcctgtcaacatagaggccgaaccaccctttggtgagtcttatattgtgatcggggctggcgagaaagccctgaagctctcctggttcaagaaaggatcaagtatcggcaagatgtttgaagcaactgccagaggggctaggcggatggccattctgggagataccgcatgggacttcggtagcatcggcggggtttttacatccgtgggaaaacttgtccatcagattttcggcacggcgtacggtgtgctgttttctggggtaagctggaccatgaagataggcatcggagtgttgctcacttggctgggcttaaattcacgaagtacatccctgagcatgacctgtattgctgttgggctagtcacactctacctgggagtgatggtgcaggccgattctggctgcgtcatcaactggaaaggtcgcgagcttaagtgtgggtcaggaatcttcgttactaatgaagtgcacacctggacggagcaatataagtttcaggcagacagtccgaaaagattgagcgccgctattggcaaggcctgggaagagggtgtgtgcggcataaggtccgcaacacggctggagaacatcatgtggaaacagatttctaacgaactcaatcatatcctgttagagaacgacatgaagttcaccgtagtcgtgggggatgttgctggcattctggcccagggcaaaaagatgatccgccctcaacccatggaacacaaatactcgtggaaaagctgggggaaggcgaagataatcggagccgacgtgcagaatactacctttattatcgatggcccaaacacacctgagtgtcccgacgatcagagagcttggaatatttgggaagtcgaggactatggtttcgggatctttactaccaacatatggcttaagttgagggattcctacacacaggtgtgcgaccaccgtctcatgtcagcagccattaaagatagtaaggctgttcatgccgacatgggatattggatcgagtctgagaagaatgagacgtggaagctggcacgggcgagcttcattgaagtgaagacctgtatctggccaaaatcccacactctatggtcaaacggcgtactggagagcgaaatgataatccccaagatttacggtggccctatctctcaacataattatcgaccagggtacttcacacagaccgccggaccgtggcacctcggcaaactggagcttgattttgacttgtgcgaggggactacagtcgtggtggatgaacactgcggaaacagaggcccctccctgaggaccacgactgtcaccggtaagattatccatgagtggtgttgccgcagttgtacattacctccactccggtacagaggggaagacggatgctggtatggcatggagataaggcccgttaaagagaaggaagagaatctggtgaagtccatggtatctgctggttccggcgaagtggactcattcagtcttgggctgttgtgtattagcatcatgatcgaggaagtcatgcgctcgcgatggtcccggaaaatgctcatgaccggaactctggccgtgtttttcctactgattatgggccagctcacatggaacgatctgatccgtctttgcattatggttggggcaaatgcttctgacagaatgggaatgggcaccacatacttggccctgatggcaacttttaagatgaggcctatgttcgccgtgggtttactctttcgccggctgaccagcagagaggtccttctgctaacgatagggctctcactggtggctagtgttgagttgccaaactccctggaagagttaggagatggcctcgcgatgggcatcatgattctgaaacttctgacagacttccaatctcaccagttgtgggccaccctcctgagcctaacttttatcaagaccacattctccctgcattatgcatggaaaactattgctatggtgctttcaatcgtcagcctctttcccctgtgtttgagtaccacgtctcagaagacaacctggctgccggtattactcgggtccctgggatgcaagcctcttactatgttcctgatagccgaaaataaaatctggggtagaaagagctggccattgaacgagggcattatggccgtggggatcgtttcgattctcctgtcatctctactgaaaaacgatgtgccccttgctggacctctcatcgcaggcggtatgctgatagcctgttacgtcattagtgggtccagcgcggacttgtctttagaaaaggctgccgaggtgagctgggaggaagaggcagaacactccggagcctcacataatatcctggtagaggtgcaggatgacggcacaatgaaaatcaaggatgaagaacgagacgataccctcactattctgcttaaagctacactgttggcagtcagtggcgtttatcccctaagcataccagccaccctgtttgtgtggtacttctggcaaaagaagaaacagcgctctggggtgctctgggacacgccttcacccccagaggtcgaacgggcggtgctggatgacggaatctatagaattatgcagaggggtcttttaggccgtagccaggttggggtaggagtgttccaagagaacgtctttcacactatgtggcacgtgacccgcggcgctgttctgatgtaccagggtaagcggctcgaaccgagttgggccagcgtgaaaaaggacttgatctcctacgggggaggctggagactgcagggctcttggaatacaggggaggaggtccaggtgattgcagtagaacctggcaaaaatcccaagaatgtccaaaccgccccaggtacattcaagactcccgagggcgaagtgggggctatcgccctcgattttaaacctggaacctcgggcagcccaatagttaacagggagggtaagatcgtggggctgtatggaaatggcgtcgtgacgacatcaggcacttacgtttccgcaattgctcaggccaaagcgagtcaggaagggccccttcctgagatcgaggacgaagtgttccgaaagcggaacctgaccattatggatttgcatccgggatctggtaaaacacgcagatatctaccagccatcgtcagggaggcaataaagcggaagctgcgaaccctcattttagctcccactagagtggtagccagcgaaatggctgaggcactgaaaggcatgcctatccgctaccaaaccacagccgtgaagtccgaacacacggggaaagagatcgttgaccttatgtgccatgccacttttaccatgaggctgctctcaccagtccgtgtgcccaattataacatgattatcatggatgaggctcacttcacagacccttctagcatagcggcacggggatacattagtaccagagtgggcatgggtgaagccgctgccatctttatgactgcaacaccgcccgggtccgtcgaggccttcccacagagcaatgctgtaattcaggatgaagagagggacatccctgaacgctcttggaactcaggatatgagtggataaccgattttcccggcaagacggtgtggttcgttccatccattaaaagtggcaatgacatcgcgaactgtttgcgaaagaatgggaagagagtgatccagctgagccggaaaacttttgatacagagtaccaaaagaccaaaaacaacgactgggactacgtcgtgaccactgatatttcggaaatgggagccaatttcagggcagaccgcgttatcgatcctcgtagatgcctcaagcccgtgattctgaaagacggtccagagcgggtcatacttgctggcccgatgcctgtgacagtagcctctgcagcccagaggcgcgggcgaatcggaagaaaccataataaggaaggcgatcagtatatttacatgggtcagcccctaaacaatgacgaggatcacgctcactggaccgaggccaagatgctgttggacaacatcaatacaccagaagggatcattcccgcgttattcgagcctgaacgggagaaatccgcagccatagatggcgaatataggctgcgcggagaggctagaaagacttttgtggagctcatgaggcggggcgacctgccagtttggcttagctacaaagtcgcctcagaagggttccaatatagtgatcgtcgctggtgctttgacggagagcgaaacaatcaggtgctggaagagaacatggatgtggaaatctggacgaaggagggtgagaggaaaaagctcaggccccggtggttggacgctcgcacctactctgaccctctggcactaagagagttcaaagagtttgccgctggcaggcggtccgtcagcggggatctgattctcgaaatcggaaaacttccgcagcatctgacacagcgagcccaaaatgcattagacaacttggttatgctgcacaattcagagcagggcggtagagcgtatcgccatgccatggaagaactcccagatactattgagaccctgatgcttctggctctcatcgccgtgttgacagggggcgtaaccctgttctttttaagtggaaagggcctagggaaaactagcataggactgctctgtgtgatggcatcctctgtccttctgtggatggctagcgtggaaccccactggatcgccgcatccattatcttggagttctttctgatggttctcctgattcctgaacccgacaggcagcggacgccacaggataaccaacttgcctacgtggtcatcggtctcctgttcatgatattgaccgtagctgcgaatgagatgggcctgttagagacaactaagaaagacctagggattggacacgtggccgttgaaaaccatcaccatgcagctatgctggatgtggacctccaccctgcctcagcctggaccctttacgcagtcgctacaaccatcattactcccatgatgcgtcatacaatcgagaacacgaccgccaatatatctctgactgcgatcgctaaccaggccgcaattttgatgggcctggataagggttggccaatcagtaaaatggacattggggtgcctctcctggcccttggctgctattcgcaggtcaatccgttaacactgaccgctgcagtgctcatgttggttgcccactacgcgatcataggacccggcctgcaagctaaggccaccagagaagcacagaagaggacagccgctgggattatgaaaaacccaactgtggatggaatcgtagccatcgacctagatcctgtggtctatgacgcaaagtttgagaaacagctgggccagattatgctccttatcctgtgtacgagccaaatattgctgatgcgcaccacatgggctctctgcgaatccattactctggccaccggtcccttaacaaccctttgggaggggtctccaggaaagttctggaatactacgatcgcggtttcaatggccaacatttttcggggcagctacctggcaggagctggcctcgccttctccctaatgaaaagtctagggggtggccgaagagggacaggagcacagggcgagaccttgggtgaaaagtggaagaggcagctgaatcagctctctaaaagcgagttcaacacttataagcgctcagggatcatggaagtggaccggtccgaggctaaagaaggacttaagagaggcgagaccacaaaacacgccgtcagtcgtggtactgccaagctgaggtggtttgtggagcggaatttggtaaagcctgaaggcaaagtgatagatctggggtgtggacgcggcgggtggagctactattgcgcgggactcaagaaagttaccgaggtgaagggctacacaaaaggtgggcccggacatgaagaaccggtcccaatggctacgtacggctggaacttagtgaagctgcactctggcaaagacgtcttctttatccctcccgaaaagtgtgatacccttctgtgcgacattggggagtcctcaccaaatcccactatcgaggaaggacgaacactaagagtgctcaagatggttgagccttggctgaggggtaaccaattctgtattaaaatcttgaatccgtatatgcccagcgtagtggaaaccctggagcagatgcagcggaagcatggcgggatgctcgtccgcaacccactttcgagaaattctactcacgagatgtactgggtgagttgcggaacaggcaacattgtttccgcaatcaatatgaccagcaggatgctgttaaaccgatttacgatggcccaccggaaacctacctatgaacgtgatgtggacctgggtgctgggacaagacatgtcgccgtggagcccgaagtagcaaacttggatataattggacagcgcatcgagaatatcaagtgtgaacacaaatcaacttggcattacgacgaggataacccttataagacctgggcctaccacggctcctatgaggtgaagccatctggcagcgctagttccatggttaatggggtcgtgaaactcctgacaaagccctgggacgtgattcctatggtcactcaaatagcgatgaccgatacaaccccattcggacagcagagggtttttaaagaaaaggtggacactcggacgcccaaagccaagagaggtacagcacaaatcatggaggtaaccgctcgctggctatggggcttccttagcaggaacaagaaaccgcgaatttgcactcgggaagagtttaccagaaaggtgaggtctaatgccgcaatcggggccgtcttcgtggacgaaaaccagtggaactcagctaaagaggccgttgaggatgaacgcttttgggacctggtgcatcgtgagcgggaactccacaagcagggaaaatgcgcgacatgtgtctacaacatgatgggcaagagagagaagaaactgggtgagttcgggaaggcaaaaggaagtagggccatttggtacatgtggttgggcgctcgctttctggagttcgaggccctcggcttcatgaatgaagatcactggttttcccgagagaacagcctttctggggtggaaggagagggtctgcataagttaggctatatcctgcgggacatatcgaaaatctcagggggaaatatgtacgcagatgacacggctggctgggataccagaattactgaggacgatttgcagaacgaagccaagatcacagagattatggaacctgagcacgctcaactcgccaaagcaatcttcaagctgacctatcagaataaggtagttagggtgcagcgcccagcgaaaaacggtactgtcatggacgtgataagcagacgggatcagagggggtccggacaagtgggcacatacggcctaaatacctttacaaacatggaagcccagcttattcgtcagatggagagtgaggggatcttctctcccagcgaactggagactcctaacctcgctgaacgagtcctggactggttggagaagtatggagttgaacgcttaaaaagaatggccatctccggtgatgactgcgtggtaaagccaattgacgatcggtttgcaaccgctctgacggccctcaatgacatgggcaaagtgaggaaggatataccccagtgggagccgtcaaaggggtggaacgactggcaacaggtccctttctgtagtcatcactttcaccagcttatcatgaaagatggacgcgagattgtggttccctgcagaaatcaggacgaactggtgggccgggcaagggtctctcaaggtgccgggtggagcctacgagagaccgcgtgtctgggaaagtcctacgctcagatgtggcagctcatgtatttccatcgtagagatttgcgcctggccgcaaacgccatctgctcagctgtgccagtagactgggttcctacaagccggactacctggtctattcacgcccatcaccaatggatgacaactgaagatatgctttccgtgtggaatagggtctggatcgaggaaaacccctggatgaaagacaagacccatataagtagctgggaggatgtgccatacctgggcaaaagagaggaccagtggtgtggctcgctcatcgggttaacggcacgcgctacatgggccaccaatattcaggttgcgatcaaccaggtgcggaggctgattggaaatgaaaactacttggactatatgacttccatgaagcgatttaagaatgagtctgatcccgaaggtgctctgtggtga

SEQ ID NO: 14226 - RNA, 9879 nt, synthetic construct
  misc_feature 1..9879: note = derived and/or modified CDS sequence (opt3) from DENV-1__KC172835__SS-prME
  source 1..9879: mol_type = other RNA
agcgtgaccatgctgctcatgcttatgcccacagccctggctttccacttgactacgaggggaggggaacctcatatgatcgtctccaagcaggaaagggggaaatctttactgtttaagacctcagccggtgttaatatgtgcacactaattgccatggacctcggagaactgtgtgaagatactatgacctacaaatgcccacggatcacagaggcggaaccggacgatgtggactgttggtgcaatgctaccgatacttgggtgacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggcagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggccgattctggatgcgtcgttaactggaaaggccgcgaacttaagtgtggttcagggatcttcgtgactaatgaggtgcacacctggacggaacaatataagtttcaggcagacagtccgaaaagattgagcgccgctatcggaaaggcctgggaggagggcgtatgcggtattaggtccgcaacacggctggaaaacgtcatgtggaaacagatatctaacgagctcaatcatatcctgttagaaaacgacatgaagttcaccgtggttgtgggcgatgtcgctgggattctggcccagggcaagaagatgatccgccctcaacccatggagtacaaatattcgtggaaaagctggggcaaggcgaagattatcggggccgacgtgcagaatactacctttataatcgatggaccaaacacacctgaatgtcccgacgatcagagagcttggaatatttgggaggttgaggactacggcttcggtatctttactaccaacatttggcttaggttgcgtgattcctatacacaggtgtgcgaccaccggctcatgtcagcagccatcaaggatagtaaagctgtacacgccgacatggggtactggatagaatctgagaagaatgaaacgtggaaactggcacgagcgagcttcattgaggtcaagacctgtatctggccaaagtcccatactctatggtcaaacggagtgctggaaagcgagatgattatccccaaaatatatggcggtcctatctctcaacacaattacagaccaggctacttcacacagaccgccgggccgtggcatctcggaaagctggagcttgattttgacttgtgcgaaggcactacagtggtcgttgatgagcactgcgggaacaggggaccctccctgcgcaccacgactgtgaccggcaaaacaattcacgaatggtgttgccggagttgtaccttacctccactcagattcaggggtgaggacgggtgctggtatggaatggagatccgccccgtaaaggaaaaagaggaaaatctggtaaagagcatggtctctgctggctccggtgaggtggactcatttagtcttggcctgttgtgtattagcatcatgatagaagaggttatgcgatcgcggtggtcccgtaagatgctcatgactgggacactggccgtgttctttctactgattatcggacagctcacctggaacgatctgatcagactttctattatggtcggcgcaaatgctagcgacaaaatggggatgggaacaacttacttggccctgatggcaaccttcaagatgaggcctatgtttgccgtgggcttactcttccgccggctgacgtcaagagaggttcttctgctaacaatcggtctcagtctggtggcttccgtcgaattgccaaactctctggaggaattaggggatggactcgcgatgggcattatgatactgaaacttctgaccgactttcaaccccatcagttgtgggccactctcctgagcctaaccttcatcaagacaactttttccctgcactatgcatggaaaaccatggctatggtactttcaattgtgagcctcttcccgctgtgcttgagtacgacatctcagaagaccacttggctgcctgttttactcggctccctggggtgtaagccacttacaatgtttctgatcaccgagaataaaatttggggaagaaagagctggcccttgaacgaaggtatcatggccgtgggcatagtctcgatcctcctgtcatctctactgaaaaacgatgtgcctcttgccgggcccctcattgctggaggcatgctgatcgcatgctacgtaattagtggttccagcgccgacttgtctttagagaaggcggctgaggtgagctgggaagaggaagccgagcattccggggcatcacacaatatcctggtcgaagttcaggatgacggaactatgaaaataaaggatgaggagcgagacgatacactcaccattctgcttaaagccacgctgttggctgtgagtggcgtgtatccactaagcatccctgcaactctgttcgtctggtacttctggcaaaagaagaaacagcgctctggcgtgctctgggacaccccctccccaccggaagttgagcgggccgcgctggatgacgggatctatagaattatgcagaggggacttttaggtcgttcacaggtaggcgtgggggtctttcaagaaaacgtgttccatacaatgtggcacgttacccgcggagctgtgctgatgtaccagggcaagcggctcgagcctagttgggccagcgtcaaaaaggacttgatatcctacggtgggggatggagactgcagggctcttggaatacaggcgaggaagtgcaggtaatcgcagtcgagcccgggaaaaacccaaagaatgtgcaaactgcccccggaacctttaagacgcctgaaggtgaggttggcgctattgccctcgatttcaaaccagggacatcgggaagccccatcgtgaacagggaaggcaagattgtcggtctgtatgggaatggagtggttactacctcaggcacatacgtgtccgcaatcgctcaggccaaagcgagtcaggagggccctcttccggagatagaagacgaggtctttcgaaagcggaacctgaccatcatggatttgcacccagggtctggaaaaactcgcagatatctacccgccattgtgagggaagcaatcaagcggaagctgcgaaccctcattttagctcctacaagagtagtggccagcgagatggctgaagcactgaaaggtatgccaatccgctaccaaacgactgccgttaagtccgagcataccggcaaagagatagtcgaccttatgtgtcacgccacattcaccatgaggctgctctcacccgtgcgtgtgcctaattataacatgattatcatggatgaagctcattttactgacccgtctagcatcgcggcacgggggtacattagtacaagagtcggaatgggcgaggccgctgccatcttcatgaccgcaacgcccccaggttccgtagaagcctttcctcagagcaatgctgtgatacaggatgaggaaagggacattcccgagcgctcttggaactcagggtatgagtggatcactgatttcccaggaaagacagtttggtttgtgccttccattaaaagtggcaatgacatcgcgaactgcttgcgaaagaatggcaagagagtcatacagctgagccggaaaaccttcgataccgaataccaaaagactaaaaacaacgactgggactacgtggttacaaccgatatttcggagatgggggccaatttcagggcagaccgcgtgatcgatccccgtagatgtctcaagccagtcatcctgaaagacggaccggaacgggtgattcttgctggtcctatgcccgtaacagtggcctctgcagcccagaggcgcggccgaatcgggagaaaccacaataaggagggagatcagtatatttacatgggccagccactaaacaatgacgaggatcatgctcactggactgaagccaagatgctgttggacaacataaatacgcccgagggtatcattcctgcgttatttgaaccagagcgggaaaaatccgcagccatcgatggggagtataggctgcgcggcgaggctagaaagaccttcgttgaactcatgaggcggggagacctgcccgtctggcttagctacaaagtggcctcagagggctttcaatatagtgatcgtcgctggtgcttcgacggggaacgaaacaatcaggtgctggaggaaaacatggatgtcgagatctggacaaaggagggagaaaggaaaaagctcaggcctcggtggttggacgctcgcacttactctgacccgctggcactaagagagtttaaagagttcgccgctggtaggcggtccgttagcggcgatctgattctcgagatagggaaacttccacagcacctgacccagcgagcccaaaatgcattagacaacttggtgatgctgcataattcagaacagggaggcagagcgtatcgccacgccatggaggagctccccgatacaatcgaaaccctgatgcttctggctctcattgccgtattgactggtggggtgacgctgtttttcttaagtggcaggggactaggcaagaccagcatcgggctgctctgcgtcatggcatcctctgtgcttctgtggatggctagcgttgagcctcattggattgccgcatccatcatattggaatttttcctgatggtgctcctgatccccgagccagaccggcagcgtacacctcaggataaccaacttgcctacgtcgtaattggactcctgtttatgatcttgactgtggctgcgaatgagatgggtctgttagaaaccaccaaaaaggacctaggcattgggcacgttgccgatgagaaccaccatcacgcagctatgctggacgtggatctccatcccgcctcagcctggaccctttacgcagtcgctactacaatcataacgccaatgatgagacacaccattgaaaacactacagccaatatctctctgaccgcgattgctaaccaggccgcaatcttgatgggactggacaaaggctggcctataagtaagatggatatcggtgtgccgctcctggcccttgggtgttattcgcaggtcaatcccttaaccctgacagctgcagtgctcatgttggttgcccattacgcgattatcggcccaggactgcaagctaaagccactagggaggcacagaagcgcacggccgctggcattatgaagaaccctaccgtggacgggatcgtagccatagatctagaccccgtggtctatgacgcaaaattcgaaaagcagctgggacagattatgctccttatcctgtgcacaagccaaatcttgctgatgcggactacctgggctctctgtgagtccattacactggccaccggcccattaactacgctttgggagggttctcctgggaaattttggaatacaaccatcgcggtttcaatggccaacatattccgaggaagctacctggcaggcgctggtctcgccttctccctaatgaagagtctgggcgggggaagaaggggcactggggcacagggagaaaccttgggcgagaaatggaagcgccagctgaatcagctctctaagagcgaatttaacacatataaacggtcaggtattatggaggtggatagatccgaagctaaggaggggcttaaacgtggagagactaccaagcacgccgtcagtaggggcacagccaaactgcggtggttcgtggaacgcaatttggtaaagcccgagggtaaggtgatcgacctgggctgcgggcgaggaggctggagctactattgtgcggggctcaaaaaggttacggaagtgaaaggatacaccaagggcggtccggggcacgaggaaccaattcctatggctacttacggatggaacttagtcaaactgcattctggcaaggatgtgtttttcatacccccagagaaatgcgacacacttctgtgtgatataggcgagtcctcacccaatcctaccatcgaagaggggagaactctaagggtcctcaagatggtggaaccgtggctgcggggaaaccaattttgcattaagatcttgaatccctatatgccaagcgttgtagagacactggagcagatgcagcgcaaacacggtggcatgctcgtgagaaaccctctttcgagaaattctacccatgaaatgtactgggtcagttgtgggacgggaaacattgtgtccgcagttaatatgaccagccgaatgctgttaaaccggttcacaatggtgcaccgtaagcccacttatgagagagacgtcgatctgggcgccggtacccgccacgtggctgtagaacctgaggtggccaacttggacatcattgggcagaggatcgaaaatataaaacatgagcacaagtcaacatggcattacgatgaggacaacccatataaaacttgggcataccacggatcctatgaagttaagccctctggcagcgccagttccatggtcaatggcgtggtgaagctcctgaccaaaccttgggatgtcattccaatggttacacaaatcgctatgaccgacactacgccctttgggcagcagcgggtgttcaaggagaaagtagacacaagaaccccgaaggcgaaacgcggaactgcccaaatcatggaagtgaccgcaaggtggctatggggttttcttagccgaaacaagaagcctcggatttgcacaagagaggagttcacgaggaaagtccgctctaatgctgccataggcgcagtgtttatcgatgagaaccagtggaactcagccaaggaggctgttgaagacgagcgtttctgggatctggtgcatcgggaaagagagctccacaaacaggggaagtgtgcaacatgcgtctacaacatgatgggaaaaagggaaaagaagctgggcgagtttggtaaagcgaaggggagtcgcgcaatttggtacatgtggttgggagcccgattcctggagttcgaagctctcggctttatgaatgaggaccactggttctcccgggaaaacagcctttctggcgtggagggggagggactgcataaattaggttatatcctgagagatatttcgaagatcccaggcgggaatatgtacgccgacgatactgcaggatgggacacaaggataaccgaagatgacttgcagaacgaggctaaaatcactgatattatggaatcagagcacgccctcctggctaagagcatctttaaactaacatatcaaaataaggtagttcgcgtgcagagacccgccaagaacggcaccgtcatggacgtgatttcccggagggatcagcgtggtagtggacaggtgggaacatacggccttaatactttcaccaacatggaagcacaactgatccgacagatggagtctgagggcatatttagcccttccgaactcgagacgccaaacctggcggaacgcgccttggactggttagagaaacatggggtcgaaagactgaagcggatggctatttcaggagacgattgcgttgtgaaacccatcgacgataggttcgccaccgcactcacagctcttaatgacatgggtaaggtacgcaaagatatcccgcagtgggagcctagtaagggctggaacgactggcagcaagtgcccttttgttctcaccacttccatcagctgattatgaaggatgggagagagatagtcgtgccatgccggaatcaggacgagctagttggaagggcccgagtgagccagggcgcaggttggtccctgcgtgagactgcctgtctcgggaaatcatatgcgcaaatgtggcagttgatgtactttcacagacgcgatctgcggcttgctgccaacgcaatctgcagcgccgtccctgtggactgggtacccacctctaggacaacttggtccattcatgctcaccatcagtggatgaccacggaagatatgctgagtgtttggaatagagtgtggatcgaggaaaacccatggatggaggacaagacacacattagctcgtgggaggacgtcccctatctcggaaaacgcgaagatcaatggtgtggctccttaatcggcctgaccgcccgggcaacttgggctacaaatatacaggtggccatctctcaggttaggcgattgattgggaacgagaattacctggactacatgacctcaatgaagagattcaaaaacgaaagcgatcctgagggagcgctctggtga

SEQ ID NO: 14227 - RNA, 9879 nt, synthetic construct
  misc_feature 1..9879: note = derived and/or modified CDS sequence (opt3) from DENV-1__EU848545__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacaattatagccatggacctcggcgagctgtgtgaagatactatgacctacaaatgcccacggatcacaaaggcggagccggacgatgtggactgttggtgcaatgctaccgatacttgggtaacatatgggacctgtagtcgcacgggagaacaccgacgtgacaaaagaagcgtggcccttgcaccccatgtcggcctgggtttggagactagggccgagacctggatgtcctctgaaggggcttggaagcaaattcagaaggtggagacatgggcactccggcaccctggattcactgttatcgccctgtttctggctcatgccattggcacctcgatcacacagaaaggcataatcttcattctcttaatgctggtgaccccatcaatggcgatgcgctgcgtcgggatcggaaacagagattttgtggaaggtcttagcggcgcaacgtgggtagacgttgtgttggagcacgggagttgtgtcactacaatggccaaggataaacccaccctggacattgagctactcaagactgaagtgacaaaacctgctgtgctgaggaagctttgcatcgaggccaagatatccaataccacgaccgattctcggtgtccaacacagggagaagcaactctggtcgaggaacaagacgctaacttcgtttgccgccgaacctttgtggatagaggctggggtaatgggtgtggattgttcggcaaaggcagcctcattacatgcgccaagtttaaatgcgtaactaagctggaggggaaaatcgtgcagtacgagaacttaaagtattccgtcattgtgaccgttcacacaggagaccagcatcaggtgggtaatgaaaccactgagcacggcacgatcgcgacaatcaccccccaagcccctacttcagaaattcagctgaccgactacggggcactcacacttgattgtagtccaaggaccggactggacttcaacgagatggtcttgctaactatgaaagaaaagagctggctggtgcataagcagtggtttctcgatctgccgcttccctggacatctggcgcttccacgcctcaggagacctggaatcgggaggacctgttggtaactttcaaaacagcccacgctaagaaacaagaagttgtggtcctcggttcacaggagggggccatgcacaccgcactgacaggcgccactgaaatacagaccagcggaacgaccaagatctttgctggccatttaaaatgccgtctgaagatgaacaagctaacactcaaagggatgagttatgtgatgtgtactggatctttcaagctggagaaagaagtcgcggagacccaacacggtacagtgcttgttcaggtgaagtacgagggcactgatgcaccatgcaaaattcccttctccacccaggacgaaaagggggtaacgcagaatggacgcttgatcacagccaaccctatagtcaccgataaggagaaaccagtgaatattgaagctgagcccccgtttggcgagagctatatcgttgtgggtgccggggaaaaggcactgaaactctcgtggttcaagaaaggctcttccatcggaaagatgctggaggccactgctagaggcgccaggcggatggcaattcttggggacacagcgtgggattttggatcaatcggtggcgtcttcaccagtgtggggaagctggtacatcaaatttttggaactgcttacggcgtgttgttcagcggtgtttcctggaccatgaaaatagggatcggcattctcctgacatggttaggactgaactctcgaagcgcctcactaagtatgacgtgtatcgcagtcggcatggtgaccctctacctgggggtgatggtccaggccgactccggatgcgttatcaattggaagggccgcgaacttaaatgtggtagcgggatttttgtgactaacgaggtgcacacatggaccgaacagtataagttccaggctgattctcctaaaagattgtcagccgcaataggaaaggcttgggaggagggcgtatgcggtatcaggagtgccacacggctggaaaacattatgtggaaacaaatcagcaatgagctcaaccatattctgttagaaaatgacatgaagtttactgtcgtggttggcgacgtgtccgggatcctgacccagggacgcaagatgataggcccccagccaatggagcacaaatactcttggaagtcgtgggggaaagcgaagatcattggagccgatgtccagaacacgacattcatcattgacggccctaatacccccgaatgtccagatgaccaaagagcttggaacatctgggaggtggaggattatggttttgggatattcactaccaatatttggcttaaattgagggacagctacacacaggtttgcgatccccgtctcatgtccgcagccatcaaggactcaaaggctgtgcacgccgatatgggatattggattgaaagtgagaaaaacgaaacttggaagctggcacgggcgtcttttatcgaggtaaaaacctgtgtctggcctaagagccatacactatggtccaatggcgtgctggaatcagagatgataatcccaaaaatttacggtggcccgatcagccagcacaactatcgacccgggtactctacgcagaccgccggaccttggcatctcggcaagctggagcttgacttcgatttgtgcgaagggactacagtggtcgttgacgagcactgcggaaatagaggcccatccctgaggaccactacagtgaccggtaagattatccacgaatggtgttgccgcagttgtacgttaccccctctccggttcaaaggggaggatggatgctggtacggcatggagataagaccagtaaaggacaaagaagagaacctggtgaagagccttgtctctgctggttccggcgaagtggactcatttagtctggggttgctctgtattagcatcatgatcgaggaagttatgaggtcgcgctggtcccgaaaaatgctgatgactggaaccctagccgtgttcctgctcctgattatgggccaacttacatggaatgatttgatccggctgtgcattatggtcggggcaaacgcttctgaccgtatgggaatgggcaccacttatttagccctcatggcaacatttaagatgagacccatgttcgccgtgggtctgctttttaggcgcctgaccagccgggaggttctactcctgacaatagggttgtcactggtggctagtgtcgagttaccgaattccctcgaagagctgggagatggccttgcgatgggcatcatgattctgaagttgctcactgacttccagtctcatcagctgtgggccgcactactgagccttacctttatcaaaacgacattctccctccactacgcttggaagaccgtagccatggtgctgtcaattgttagcttgtttcctctgtgtttaagtactacctctcaaaaaacaacttggctcccagtgctgcttgggtccctgggatgcaagcccttgaccatgttcctcatcgccgaaaacaaaatatggggtagaaagagctggcctctgaacgagggcatcatggctgtcgggattgtgtcgatcctactgtcatctcttctcaaaaatgatgtacccctggcaggaccattgattgccggcggtatgttaatcgcgtgttatgtgataagtgggtccagcgctgacctgtctctcgaaaaggccgcagagattagctgggaggaagaggccgaacattccggagcttcacacaacatcctggtcgaggttcaggatgacggcacgatgaagatcaaagatgaagagagggacgatacacttaccattctgttgaaggcaactctactggccgtgagtggcgtgtaccctataagcatccccgcgacactctttgtctggtatttctggcagaaaaagaaacagcgatctggggtgctgtgggacaccccatccccgcctgaggttgaacgcgctgtacttgatgacggaatttaccggatcttacaaagaggtctgctcggcaggtcacaggtgggggtcggagtgtttcaggagggcgttttccatactatgtggcacgtgacacgtggtgccgtcttgatgtatcaggggaagcgcctggaacccagttgggcaagcgtgaagaaagacctcatttcctacggaggcggctggcggttccaagggtcttggaataccggagaggaggtacaggtcatcgccgtggaaccaggtaagaaccccaaaaatgttcagacggctcctggcacttttaagaccccagagggggaagtgggagccatagcactggatttcaaacccggcacatcgggtagccctatcgtcaacagagaggggaagattgtgggactttacggcaatggcgttgtgaccacatcagggacttatgtctccgctatcgcccaggcgaaggccagtcaagaaggaccgctgccagagattgaggacgaagtgtttaggaaacgaaacttgaccatcatggatctacaccccggttctggcaagacgcggcgctacctgcctgcaatagtaagagaggctattaaaaggaagctccggacattaatcctggccccaactcgagtggttgctagcgaaatggcagaggcccttaaagggatgcccatcagatatcagaccacagccgtcaagtccgaacataccggacgcgagattgtggacctgatgtgccacgctactttcaccatgaggctcttgtcacctgtgcgtgtcccgaattacaacatgatcataatggatgaggcgcattttacagaccccgcatctattgccgctcggggctatatcagcacgagagtaggtatgggggaagccgcagccattttcatgactgctaccccacctggaagtgtggaggcgtttccccagtccaatgccgttatccaagatgaagagagggacataccagaacgcagctggaactctggctacgattggattacagacttccctggcaagaccgtgtggtttgtcccctcaatcaaatccgggaatgatatcgcaaactgtctgcgaaagaatggaaaaagagtgattcagctcagtcggaagactttcgacacagagtatcagaaaaccaagaacaacgactgggattacgttgtgacgactgacatcagcgagatgggtgctaattttagggccgatcgcgtcattgacccacgtagatgcctgaagccggtgatacttaaagatggccctgaacgggtaatcctagcagggcccatgccagtgacagttgcctcggctgcccagaggcgcggacgaattggcagaaaccaaaataaggagggtgaccagtacatctatatggggcagcccctgaacaatgatgaagaccacgcgcattggaccgaggcaaaaatgttgttagataacatcaatacccctgagggcattataccagccctgttcgaacccgagcggggaaagtctgctgccatcgacggcgaatacaggctccgcggggaggctagaaaaactttcgtcgaactgatgaggcggggagatcttcctgtgtggctgtcctataaggtggcaagcgagggttttcagtactcagaccgtaaatggtgcttcgatggcgagcgcaacaatcaagtcctcgaagagaacatggacgttgaaatttggacaaaggagggggaacgaaagaaattgagaccgaggtggctggacgcccggacctatagtgatccacaggctctacgcgagtttaaggagttcgccgcaggaagaaggtctgtgtccggcgacctgatcctcgaaattggtaaacttccccagcacctgacacagcgggcgcaaaatgccttagataacttggtaatgctgcacaatagcgagcaggggggcaaggcttaccgacatgccatggaagagctccctgacactatcgaaacgctgatgcttctggcactcatagctgtgttgaccggaggcgtcacactgtttttcttatcagggagaggactaggtaaaactagtatcggcctgctctgtgtgatggccagctccgttcttctgtgggtggcatctgtcgagccccactggattgccgctagcatcattttggagtttttcctgatggtactcctgatcccagaacctgatcgccagaggaccccccaggacaaccaacttgcgtatgtggttatagggctcctgtttatgattttgacagtggccgcaaatgagatgggactgttagaaaccactaagaaggatctaggcatcggtcatgtcgctgtggagaaccaccaccatgccacgatgctggacgtcgatctccggccagcctccgcatggaccctttacgctgtggccacaactattatcacccctatgatgcgtcacacaatagagaacaccactgcgaatatctcactgacagctattgccaaccaggcagccatcttgatggggctggacaaaggctggccgatttctaagatggatatcggagttcccctcctggctcttggctgctacagtcaggtgaatccattaacgctgatagcagccgtactcatgttggtggcgcattatgctattatcgggcctggactgcaagccaaagcaaccagagaagcccagaagaggactgctgccggcatcatgaaaaaccccacagtcgacggtattgttgcaatcgatctagacccagtggtctacgacgctaagttcgagaagcagctggggcagataatgctccttattctgtgtacctcgcaaatcttgctgatgcgcaccacatgggccctctgcgaaagcattactctggcgacgggacctttaaccacactttgggagggctcccccggtaaattttggaatactaccatcgccgtgtctatggcaaacatattccggggctcatatctggctggggccggactcgcatttagcctaatgaagtccctgggcgggggacgaagaggcacaggtgctcagggggaaaccttgggagagaaatggaagaggcagctgaatcagctcagtaaatctgagttcaacacttacaagcgcagcggcatcatggaagtagatcggtcagaggccaaggaaggtcttaaaagaggcgagacgacaaagcacgccgtgtcccgtgggaccgcgaaactgaggtggttcgttgaacggaatttggtgaagccggagggaaaagtcattgacctgggctgtgggcgcggaggctggagttattactgcgctggtctcaagaaagtgactgaggtcaaggggtataccaagggaggcccaggccatgaagagcctatccccatggcaacatacgggtggaacttagtgaaactgcacagcggaaaggatgtttttttcactccacccgaaaaatgtgacacccttctgtgcgatattggtgagtcttcccctaatccgacaatcgaagagggccgaacgctaagagtactcaagatggtggagccctggctgagggggaaccaattttgtattaaaatcttgaatccatacatgccttcagtcgtggaaaccctggagcagatgcagcggaagcacggaggcatgctcgttcgcaacccccttagcagaaattcgactcatgaaatgtattgggtgtcttgcggtacagggaacatagtcagtgccgtgaatatgacctccaggatgctgttaaaccgattcactatggctcaccggaagcctacatacgagcgtgacgtagatctgggagccggcaccagacatgtggcagttgagccagaagtcgccaacttggacattatcggccagcgcatcgagaatattaaaaacgaacacaagagcacgtggcactatgatgaggacaatccctacaaaacctgggcttatcatgggtcatacgaagtgaagccttccggatctgcgagcagtatggtgaacggtgtcgttaggctcctgacaaaaccatgggatgtgatacccatggtaactcaaatcgccatgaccgacacaactccgtttggccagcagcgggtgttcaaggagaaggtcgacaccagaacacctaaagcaaagcgcgggaccgctcaaattatggaggtgactgccaggtggctatggggatttctttcccgaaataaaaagccacggatctgtacgagagaagagttcacaaggaaagttcgcagcaacgcagccattggcgctgtgtttgtcgatgaaaatcagtggaactctgccaaggaggcggtggaagacgagcgtttctgggatctggtacaccgggagagagaactccataagcagggtaaatgcgcaacctgcgtttataatatgatggggaagagggagaaaaagctgggagaatttggcaaagccaagggctcacgcgctatctggtacatgtggttgggggcccgattcctggagtttgaagcactcggattcatgaacgaggaccactggttcagtcgggagaattcccttagcggtgtggaaggcgaggggctgcataaattaggatacatactgagagatatctctaagattcccggcggtaacatgtatgctgacgatactgccgggtgggacaccaggatcacagaagatgacttgcagaatgaggctaagattacggatatcatggagcctgaacacgccctcctggcaacctcgatatttaaactaacttaccaaaacaaggtcgtgcgcgtgcagagaccagcgaaaaatggaacagtcatggacgttatttcacggagggatcagcgtggcagcggccaggtggggacctatggacttaacactttcacaaacatggaggtacaactgatccgacagatggaatccgagggtatctttagtccctctgaactcgagaccccgaatctggccgagcgcgtgttggactggttagaaaagcacggcgtcgagagactgaaacggatggctattagcggggacgattgtgtggttaagcctacagacgataggttcgccactgcactcaccgctcttaacgacatgggaaaggtgcgcaaagatataccccagtgggaaccatccaagggctggaatgactggcagcaagtccctttttgctcacatcacttccatcagctgatcatgaaagatggtagagagattgtggtaccctgtcggaaccaggacgaactagttgggagggcccgagtgagtcagggagcaggctggtctctgcgtgagacggcctgcctcggcaagagctacgcgcaaatgtggcagttgatgtattttcacagacgcgatctgcggcttgctgccaatgcaatctgttccgccgtcccaattgactgggtgcccacctcaaggacaacttggagcatccacgctcatcaccagtggatgaccacagaggatatgctgtctgtttggaacagagtgtggatagaagagaatccttggatggaagacaaaactcatgtctccagttgggaggacgtgccatacctcgggaagcgcgaagatcaatggtgcggaagcttaatcggtctgaccgcccgggcaacgtgggctacaaacattcaggtagccatcaatcaggtgaggcgattgattggcaacgagaattatctggactacatgacctcgatgaagagattcaaaaacgagtccgatctcgaaggggcgctttggtga

SEQ ID NO: 14228 - RNA, 9879 nt, synthetic construct
  misc_feature 1..9879: note = derived and/or modified CDS sequence (opt3) from DENV-1__KR024708__SS-prME
  source 1..9879: mol_type = other RNA
agcgtgaccatgctgctcatgcttctgcccacagcattggctttccacttaactacgagaggaggggaacctcatatgatcgtctccaagcaggaaaggggaaaatctctgttgtttaagacctcagccggtgttaacatgtgcacactcattgcaatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagaaggtggaaacttgggctctgaggcaccctggattcaccgttattgcactgtttctcgcccatgctatcggcacatcgattacccagaagggcatcatattcatcttactgatgcttgtgacgccatcaatggccatgcggtgcgtcgggattggaaaccgcgattttgtggagggtttgagcggcgcgacttgggttgacgttgtgctggagcacgggagttgtgtcacaaccatggccaagaataagcccactctagatatcgaactcctgaaaacagaggtgaccaaccctgccgtgcttagaaagctgtgcattgaagctaaaatctccaatacgaccacagactctaggtgtccaactcaaggagaggccaccttggtcgaagaacaggatgcaaacttcgtttgccggcgcacatttgtggaccgaggctggggtaatgggtgtggactcttcggcaagggcagcctgttaacttgcgctaagtttaaatgcgtaaccaagctggaggggaaaatagtgcagtacgaaaacctcaagtattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaagaactggactagatttcaacgaaatggtcctgctcacaatgaaagagaaaagctggctggtgcataaacagtggtttcttgacctgccgttgccctggacgtctggcgcatccacctcacaagaaacttggaataggcaggatctcctggtaacattcaagaccgctcacgccaagaaacaggaagttgtggtcttaggtagccaagagggggctatgcacacagccctgactggcgcaaccgaaatccagacgagtggaaccacaactatttttgccggccatctaaagtgccggctcaaaatggacaagctgacccttaaaggggtgtcttatgtcatgtgtacaggatccttcaagttggagaaggaagtggctgagactcagcacggtaccgttctggtgcaggtaaaatacgagggcacggatgcgccttgcaagataccaatcagcacacaagacgaaaaaggggtcacccagaacggacgtctcattactgcaaatcccatcgtgacagataaggagaaacctgttaacatagaaaccgagccacccttcggcgagtcgtatattgtgatcggtgccggggaaaaggctctgaaactttcttggtttaaaaagggctcctcaatcggaaaaatgttcgaggccactgcacgcggcgccagaaggatggctattctgggggacaccgcctgggattttggaagtatcggtggcgtcttcacaagcgtggggaagttggtacatcaggtgtttggaacggcatacggcgttctcttctccggtgtctcttggaccatgaaaattgggataggcatcctgttaacttggctgggactaaatagccggtcaacaagtctctccatgacctgtattgcggtgggcatggtgacactgtaccttggggtcatggttcaggctgacagcggatgcgtgatcaactggaagggccgagaattgaagtgtggttctgggatctttgtgactaacgaggtacacacctggacggaacaatataaattccaggccgattcaccgaagcgcctgagtgcagccattggaaaggcttgggaggagggcgtctgcggtataagaagcgccacaaggctcgaaaatatcatgtggaagcagatttccaacgagctgaatcatatcttactggaaaacgacatgaaatttaccgtggttgtgggcgacgcaaatgggattcttactcagggaaagaaaatgatccggcctcaacccatggagcacaagtactcttggaagtcgtggggcaaagctaagataatcggggccgatacccagaacacaactttcattatcgacggaccagatacccctgaatgtcccgacgatcagcgcgcgtggaatatttgggaggtcgaggactatggctttggtgtgttcacaacgaacatctggttgaaactcagagatagctacacccagatgtgcgaccacaggctgatgtccgccgctataaaggattcaaaagcagttcatgccgacatggggtattggattgaaagtgagaagaatgaaacttggaagctagctcgtgcctcttttatcgaggtgaaaacatgtatttggccacggagccacaccctgtggtccaacggagtactcgaatcagagatgatcatacccaagatctacggcggtcctattagccaacataattatcgaccaggctacttcactcagacagcagggccgtggcacctgggaaaacttgagttggatttcaacctgtgcgaaggcaccacggtcgtggtggacgagcactgcgggaatagaggaccctctttaaggactaccacagtcaccggcaagatcattcatgaatggtgttgccgctcctgtactctccctccactgcggtttagaggtgaggatgggtgctggtacggaatggagatcaggcccgttaaagaaaaggaggaaaaccttgtgcgcagtatggtaagcgcgggctctggtgaggtggactccttctcactgggcttgctctgtgtcagtataatgattgaagaggtgatgcgaagccggtggtcgcgtaagatgctgatgacagggaccctagccgtatttttcctgctcatcatgggacagctgacatggaatgaccttatcagattgtgcattatggtgggcgctaacgtctccgataggatggggatgggaactacctatctggccttaatggcaacgtttaaaatgcgccctatgttcgctgtgggcctcctgtttcggagacttacatctagggaggttctgctactcaccatcggtctgagcttggtggcctcagtcgaactgccaaacagtttagaggaactcggggacggactggcaatgggcattatgatgcttaagctgttgactgatttccaatcccaccagctctggaccacactgctatctctgacttttataaaaaccacgcttagcctcgactacgcctggaagacaatggctatggtactgtccatcgtgtcattgttccccctgtgtttaagcaccacaagtcagaaaacaacctggctcccggttctgcttggctcttttgggtgcaagcctctgactatgttcttgattacagagaataagatctggggacgaaaatcctggccactcaacgaaggtattatggcggtgggcatcgtcagcatactgctatcgtcactgcttaagaatgatgtgcccctcgccgggcctctgatcgcaggaggcatgttgattgcttgttatgtaatctctggtagttccgccgacttaagcctggagcgcgccgctgaggtgtcttgggaagaggaagcagagcatagcggggcctcccacaacattctcgtcgaagttcaggatgacggaaccatgaaaatcaaggatgaggagcgggacgatacgctgactatacttctgaaagcgaccttgctagctgtgtcaggcgtgtaccccatgagtattccagccacactgtttgtctggtatttctggcaaaagaaaaagcagagaagcggcgtgctctgggacaccccttctcccccagaagttgagagggcagtactggatgacgggatctaccgtatccttcagcgcggattactgggtcggtcccaggtgggcgtcggggtgttccaagacggagtttttcatacaatgtggcacgtgactagaggcgccgtcctcatgtatcagggtaagaggttggaaccgtcatgggctagtgtgaaaaaggatctgattagctacgggggaggctggcgattccagggctcctggaataccggggaggaggtacaggtcatagcagtggaacctggcaaaaaccccaagaatgttcaaacgacaccaggtacttttaaaacccccgagggcgaagtgggggccatcgcgctcgacttcaagcctggaacatctggctcgccaattgtcaaccgggagggtaagatcgtggggctgtacggaaatggcgttgtgaccactagcggcacctatgtctcagctattgcccaggcaaaagcctcccaggaagggccccttcctgagatcgaggatgaagtgtttaagaaacgcaacctgacaataatggacttgcacccgggaagtggtaagacgagaaggtacctaccagctatcgtacgggaggccattaaacgaaagctgagaactctcatcttagcacccacccgcgtggttgcttctgaaatggccgaggcgctgaagggcatgcctattaggtatcaaacaaccgccgtcaaaagcgaacatactgggaaggagatcgtggatcttatgtgccacgcaacattcaccatgcgtctgctctccccagtgcgggtccccaattacaacatgataattatggacgaggctcattttacggatcctgcctcaatcgctgcaagaggatatatctctactagggtaggcatgggtgaagccgccgctattttcatgacagcgaccccgcccgggagcgtggagagttttccacagtccaatgcagttatccaggacgaagaacgcgatatacctgaacgaagctggaactctggatacgactggattaccgatttccccggcaaaactgtgtggtttgtcccatcaatcaagtccggcaatgacattgccaactgtttgaggaaaaacgggaagcgggtgatccagctgagtaggaagacattcgacaccgagtatcagaaaactaagaataacgattgggactacgttgtgactacggatataagcgagatgggagctaatttccgcgccgaccgtgtcattgatcctagacggtgcctcaaacccgtgatcctgaaggacggtccagaaagggtaatccttgcaggcccgatgcctgtgaccgccgcttcggcggcccaacgccgagggagaattggacggaaccagaataaagagggcgatcagtacatctatatgggtcaacccctaaacaatgacgaagatcacgcacattggacagaggctaagatgctgttggacaacattaatactccagaggggataatccccgccttatttgaacctgagagggaaaagtctgcagccattgatggcgagtaccgcctgagaggagaagctaggaaaaccttcgttgagctcatgcggcgtggcgacctgccagtctggctttcctataaggtggccagcgaggggtttcagtactcagatcgccgatggtgcttcgacggagaaagaaacaatcaggtgctggaggaaaacatggacgtcgagatctggacaaaagaaggtgagaggaagaaactccggccccgctggttggatgcgagaacctatagtgaccctctggcactaagggagtttaaggagttcgccgctggccggcgatctgtttccggggatctgatcctcgagattggaaaacttccgcagcacctgactttaagagcccaaaatgctttggacaacctggtgatgctccacaatagcgaacagggcggtaaggcataccgccatgccatggaggaactgccagatacgatagagacccttatgctgctcgctttgatcgccgtactgacagggggcgtgactttatttttcctatcaggaaagggcctggggaaaaccagtattggactcctttgtgtcatggcaagctccgtgctgttgtggatggcgtctgttgagccccactggatcgccgctagcattatcctggaatttttcctcatggtgctgcttatacctgagcccgacaggcagcggacaccacaggataaccaactcgcctatgtcgtaatcggtctgttgtttatgattctgaccgtggcagctaacgaaatgggcttactagagactacaaagaaagacctggggatcggacatgttgtggccgagaatcaccaccatgcaacgatgctcgatattgaccttcaccctgcctccgcttggaccctgtacgcggtcgccactacaatcataacccccatgatgcgtcataccattgaaaacacaactgcaaatatctcattgacggctattgccaaccaggccgcaatcctgatgggcctcgataagggttggccaatatctaaaatggacatcggggtgcctctgcttgctttaggctgctacagtcaggtcaatccgctgaccctcacagccgcggtgttgatgctggttgctcactatgccattatcggacccggcctacaagcaaaggccactagagaggctcagaagaggaccgcagccgggattatgaaaaacccaacagtggatggaatcgtagcgatagacctggaccctgtggtctacgatgctaagttcgaaaaacagctcggccagattatgcttctgatcttgtgtacctcgcaaatcctgctcatgcgcactacgtgggccctgtgcgagagcattacattagcaaccggtccccttactaccctgtgggaagggtccccaggaaagttttggaatacaactatcgccgtttctatggctaacatattccggggctcatatctcgccggtgcaggcctagctttcagcctgatgaaatccctagggggaggccgaagagggaccggagcccagggcgagacactgggtgagaagtggaagaggcagctcaatcagcttagtaaatctgaatttaacacgtacaagcgcagcgggattatggaggtggaccggtcagaagcgaaagagggactgaagagaggcgaaaccactaaacatgccgtctcccgtggtacagcaaagttgaggtggttcgtggagcggaatctggtaaagcctgagggcaaagtgatcgatctcgggtgtggacgcggcgggtggagttattactgcgctggattaaagaaagttaccgaagtgaagggctatactaaaggtgggcccggacacgaggaaccgattccaatggccacatacggctggaacatcgtcaagctgcacagcggccgagacgtgtttttcacccctcccgagaaatgtgatacgcttctgtgcgacataggggaatcttccccaaatcccaccatcgaggagggaagaacactaagggtcctcaagatggtggaaccttggctgcggggtaaccaattttgtattaagatcttgaatccgtacatgccctcagttgtagagactctggaacagatgcagcgcaaacatggcgggatgctcgtgagaaacccacttagcagaaattcgacccacgagatgtattgggtctcttgcggaacaggcaacattgtgagtgcagttaacatgacttcccgaatgctgttaaatcggttcaccatggctcatcgtaagcctacatacgagagagatgtggacctgggtgccgggacccgccacgtcgccgtggaacccgagatcgcgaacttggatattatcggacagaggatagaaaatattaaaaacgagcacaagagcacttggcattatgacgaagataatccttacaaaacgtgggcttatcacggctcatacgaggtaaagccatccggctctgcaagcagtatggtgaacggggttgtccggctcctgacaaagccctgggacgtgatccctatggtgacccaaatcgccatgactgacaccacaccatttggacagcagagagtcttcaaagagaaggttgatacgcgcacccccaggccgaaacgaggtactgctcaaattatggaagtgacagccaagtggctatggggctttctttcccggaataaaaagcctagaatatgtaccagggaggagttcactcgcaaggtacgtagcaacgcagccatcggggctgtgtttgtcgacgagaatcagtggaactctgcgaaagaagccgtggaggatgagcggttctgggacctggttcatagagaaagggagctccacaagcagggaaaatgcgcaacatgcgtgtataatatgatgggcaagcgcgagaaaaagctgggtgagtttgggaaggctaaaggatcacgagccatttggtacatgtggttgggcgcacggttcctggagttcgaggccctcggctttatgaacgaggatcattggttcagtagagaaaattcccttagcggggtcgagggagaaggtctgcacaagttaggctacatcctgagggacatttctaaaatcccagggggaaacatgtatgctgatgacaccgccggctgggatacacgcataactgaggacgatttgcagaatgaggcgaagatcaccgacattatggaacccgagcacgcactcctggccacgtcgatctttaaactaacctaccaaaacaaggtggtaagagttcagcggcctgctaaatcaggtacagtgatggatgtcattagcaggcgtgaccagcgagggtccggacaggtgggcacttatggccttaacaccttcacaaatatggaagtgcaactgatccgccagatggagagtgaagggatattttctccaagcgagctcgagaactccaatctggccgaaagagtcttggactggttagagaagcatggagttgaacggctgaagaggatggcaatttcaggtgatgactgtgtggtaaaacccactgatgaccgcttcgctaccgccctcacggctcttaacgatatgggcaaggtgagaaaagacatcccgcagtgggagcctagtaaggggtggaatgattggcagcaagtccccttttgctctcaccatttccaccagctgatcatgaaagacggacgggaaattgtggttccatgtaggaaccaggatgagctagtgggccgagcccgtgtcagccagggtgcagggtggtccctgagagagacagcgtgcctcggaaagtcatacgcccaaatgtggcagttgatgtattttcaccgccgggacctgaggcttgctgccaatgcaatatgtagcgctgtgcctgtaaactgggttcccacctctagaactacatggtccatccatgcccaccatcagtggatgaccactgaagatatgctgagtgtgtggaatcgcgtctggattgaggaaaacccatggatggaggacaagacccacgtgagctcgtgggaagacgttccctacctcggcaaacgggaggatcaatggtgcggctccttaatcgggctgacagcaagggccacgtgggcgaccaatattcaggtggctatcaaccaggtccgaagattgataggaaatgagaactatctggactacatgacttctatgaagcggttcaaaaatgaatcagatcctgagggtgccctctggtga

SEQ ID NO: 14229 - RNA, 9879 nt, synthetic construct
  misc_feature 1..9879: note = derived and/or modified CDS sequence (opt3) from DENV-1__KR024705__SS-prME
  source 1..9879: mol_type = other RNA
agcgtgaccatgctgctcatgcttctgcccactgcattggctttccacttaactacgagaggaggggaacctcatatgatcgtctccaagcaggaaagaggaaaatctctgttgtttaagacctcagccggtgttaacatgtgcaccctcattgcaatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagaaggtggaaacttgggctctgaggcaccctggattcaccgttattgcactgtttctcgcccatgctatcggcacatcgattacccagaagggcatcatattcatcttactgatgcttgtgacgccatcaatggccatgcggtgcgtcgggattggaaaccgcgattttgtggagggtttgagcggcgcgacttgggttgacgttgtgctggagcacgggagttgtgtcacaaccatggccaagaataagcccactctagatatcgaactcctgaaaacagaggtgaccaaccctgccgtgcttagaaagctgtgcattgaagctaaaatctccaatgccacgaccgactctaggtgtccaacacaaggagaggcaactttggtcgaagaacaagatgctaacttcgtttgccggcgcacctttgtggaccgaggctggggtaatgggtgtggactcttcggcaagggcagcctgttaacatgcgccaagtttaaatgcgtaactaagctggaggggaaaatagtgcagtacgaaaacctcaagtattccgtcattgtgaccgttcacacaggagatcagcatcaagtgggtaatgagaccactgaacacggcacgatcgcgacaattacaccccaggcccctacttcagagatccagcttaccgactacggggcactgacattggactgtagtccaagaaccggactagatttcaacgaaatggtcctgctcactatgaaagagaaaagctggctggtgcataaacagtggtttcttgacctgccgttgccctggacatctggcgcttccacgtcacaagaaacctggaataggcaggatctcctggtaactttcaagacagcccacgctaagaaacaggaagttgtggtcttaggtagccaagagggggccatgcacaccgcactgacaggcgccactgaaatccagaccagtggaacgaccacaatttttgctggccatctaaagtgccggctcaaaatggacaagctgactcttaaaggggtgtcttatgtcatgtgtaccggatccttcaagttggagaaggaagtggcggagacacagcacggtactgttctggtgcaggtaaaatacgagggcaccgatgcaccttgcaagataccaatcagcacgcaagacgaaaaaggggtcacacagaacggacgtctcattaccgccaatcccatcgtgactgataaggagaaacctgttaacatagaaacagagccacccttcggcgagtcgtatattgtgatcggtgctggggaaaaggccctgaaactttcttggtttaaaaagggctcctcaatcggaaaaatgttcgaggcaaccgcccgcggcgctagaaggatggccattctgggggacactgcatgggattttggaagtatcggtggcgtcttcaccagcgtggggaagttggtacatcaggtgtttggaacagcgtacggcgttctcttctccggtgtctcttggacgatgaaaattgggataggcatcctgttaacctggctgggactaaatagccggtcaacaagtctctccatgacatgtattgctgtgggcatggtgaccctgtaccttggggtcatggttcaggccgacagcggatgcgtgatcaactggaagggccgagaattgaagtgtggttctgggatctttgtgacaaacgaggtacacacttggaccgaacaatataaattccaggcagattcaccgaagcgcctgagtgccgctattggaaaagcctgggaggagggcgtctgcggtataagaagcgcaacgaggctcgaaaatatcatgtggaagcagatttccaacgagctgaatcatatcttactggaaaacgacatgaaatttacagtggttgtgggcgacgctaatgggattcttacccagggaaagaaaatgatccggcctcaacccatggagcacaagtactcttggaagtcgtggggcaaagccaagataatcggggcggatactcagaacaccacattcattatcgacggaccagatactcctgaatgtcccgacgatcagcgcgcctggaatatttgggaggtcgaggactatggctttggtgtgttcaccacaaacatctggttgaaactcagagatagctacacgcagatgtgcgaccacaggctgatgtccgctgcaataaaggattcaaaagccgttcatgctgacatggggtattggattgaaagtgagaagaatgaaacctggaagctagcccgtgcatcttttatcgaggtgaaaacttgtatttggccacggagccacacactgtggtccaacggagtactcgaatcagagatgatcatacccaagatctacggcggtcctattagccaacataattatcgaccaggctacttcacccagactgcggggccgtggcacctgggaaaacttgagttggatttcaacctgtgcgaaggcacaaccgtcgtggtggacgagcactgcgggaatagaggaccctctttaaggacgactaccgtcacaggcaagatcattcatgaatggtgttgccgctcctgtaccctccctccactgcggtttagaggtgaggatgggtgctggtacggaatggagatcaggcccgttaaagaaaaggaggaaaaccttgtgcgcagtatggtaagcgccggctctggtgaggtggactccttctcactgggcttgctctgtgtcagtataatgattgaagaggtgatgcgaagccggtggtcgcgtaagatgctgatgactgggacactagctgtatttttcctgctcatcatgggacagctgacctggaatgaccttatcagattgtgcattatggtgggcgccaacgtctccgataggatggggatgggaacaacttatctggcattaatggctacctttaaaatgcgccctatgttcgccgtgggcctcctgtttcggagacttacgtctagggaggttctgctactcacaatcggtctgagcttggtggcatcagtcgaactgccaaacagtttagaggaactcggggacggactggccatgggcattatgatgcttaagctgttgaccgatttccaatcccaccagctctggactaccctgctatctctgacatttataaaaactacccttagcctcgactacgcttggaagacgatggcgatggtactgtccatcgtgtcattgttccccctgtgtttaagcacaaccagtcagaaaactacatggctcccggttctgcttggctcttttgggtgcaagcctctgaccatgttcttgattactgagaataagatctggggacgaaaatcctggccactcaacgaaggtattatggccgtgggcatcgtcagcatactgctatcgtcactgcttaagaatgatgtgcccctcgcagggcctctgatcgctggaggcatgttgattgcctgttatgtaatctctggtagttccgccgacttaagcctggagcgcgctgcagaggtgtcttgggaagaggaagccgagcatagcggggcgtcccacaacattctcgtcgaagttcaggatgacggaacaatgaaaatcaaggatgaggagcgggacgataccctgacgatacttctgaaagctactttgctagccgtgtcaggcgtgtaccccatgagtattccagcaaccctgtttgtctggtatttctggcaaaagaaaaagcagagaagcggcgtgctctgggacacaccttctcccccagaagttgagagggccgtactggatgacgggatctaccgtatccttcagcgcggattactgggtcggtcccaggtgggcgtcggggtgttccaagacggagtttttcataccatgtggcacgtgacaagaggcgctgtcctcatgtatcagggtaagaggttggaaccgtcatgggcaagtgtgaaaaaggatctgattagctacgggggaggctggcgattccagggctcctggaatactggggaggaggtacaggtcatagccgtggaacctggcaaaaaccccaagaatgttcaaaccacgccaggtacatttaaaactcccgagggcgaagtgggggcgatcgctctcgacttcaagcctggaacctctggctcgccaattgtcaaccgggagggtaagatcgtggggctgtacggaaatggcgttgtgacaaccagcggcacttatgtctcagccattgcacaggccaaggcttcccaggaagggccccttcctgagatcgaggatgaagtgtttaagaaacgcaacctgaccataatggacttgcacccgggaagtggtaagacaagaaggtacctaccagccatcgtacgggaggcaattaaacgaaagctgagaacgctcatcttagctcccactcgcgtggttgcctctgaaatggcggaggccctgaagggcatgcctattaggtatcaaaccacagcagtcaaaagcgaacataccgggaaggagatcgtggatcttatgtgccacgctactttcacaatgcgtctgctctccccagtgcgggtccccaattacaacatgataattatggacgaggcccattttaccgatcctgcttcaatcgcagccagaggatatatctctacgagggtaggcatgggtgaagccgctgcgattttcatgactgcaacaccgcccgggagcgtggaggcctttccacagagtaatgctgttatccaggacgaagaacgcgatatacctgaacgatcctggaacagcggatacgactggattaccgatttccccggcaaaaccgtgtggtttgtcccatctatcaagtcaggcaatgacattgccaactgtttgaggaaaaacgggaagcgggtgatccagctgtccaggaagactttcgacacagagtatcagaaaaccaagaataacgattgggactacgttgtgacaactgatataagtgagatgggagcaaatttccgcgccgaccgtgtcattgatcctagacggtgcctcaaacccgtgatcctgaaggacggtccagaaagggtaatccttgctggcccgatgcctgtgacggcggccagcgcagctcagcgccgagggagaattggacggaaccagaataaagagggcgatcagtacatctatatgggtcaacccctaaacaatgacgaagatcacgcccattggaccgaggcaaagatgctgttggacaacattaatacaccagaggggataatccccgccttatttgaacctgagagggaaaagtcggctgccattgatggcgagtaccgcctgagaggagaagcgaggaaaactttcgttgagctcatgcggcgtggcgacctgccagtctggctttcttataaggtggcatccgaggggtttcagtacagcgatcgccgatggtgcttcgacggagaaagaaacaatcaggtgctggaggaaaacatggacgtcgagatctggaccaaagaaggtgagaggaagaaactccggccccgctggttggatgccagaacatattcagaccctctggctctaagggagtttaaggagttcgccgctggccggcgaagtgtttctggggatctgatcctcgagattggaaaacttccgcagcacctgaccttaagagcacaaaatgccttggacaacctggtgatgctccacaattccgaacagggcggtaaggcttaccgccatgccatggaggaactgccagatactatagagacgcttatgctgctcgcattgatcgcggtactgaccgggggcgtgacattatttttcctaagcggaaagggcctggggaaaacttcaattggactcctttgtgtcatggccagtagcgtgctgttgtggatggcttccgttgagccccactggatcgccgcatctattatcctggaatttttcctcatggtgctgcttatacctgagcccgacaggcagcggaccccacaggataaccaactcgcttatgtcgtaatcggtctgttgtttatgattctgacagtggccgcaaacgaaatgggcttactagagaccactaagaaagacctggggatcggacatgttgtggccgagaatcaccaccatgctacaatgctcgatattgaccttcaccctgcgagcgcctggacgctgtacgcagtcgctaccactatcataacacccatgatgcgtcataccattgaaaacaccacagccaatatctccttgactgccattgcaaaccaggctgccatcctgatgggcctcgataagggttggccaatatcaaaaatggacatcggggtgcctctgcttgcgttaggctgctactctcaggtcaatccgctgacgctcaccgctgccgtgttgatgctggttgcacactatgccattatcggacccggcctacaagctaaggcaacaagagaggcccagaagaggactgcggctgggattatgaaaaacccaaccgtggatggaatcgtagccatagacctggaccctgtggtctacgatgcaaagttcgaaaaacagctcggccagattatgcttctgatcttgtgtacaagtcaaatcctgctcatgcgcaccacttgggccctgtgcgagtcgattacgttagctacaggtccccttaccactctgtgggaagggagcccaggaaagttttggaataccacaatcgccgtttccatggcaaacatattccggggctcttatctcgctggtgccggcctagcgttctcactgatgaaaagcctagggggaggccgaagagggactggagcccagggcgagaccctgggtgagaagtggaagaggcagctcaatcagctttccaaaagtgaatttaacacatacaagcgctctgggattatggaggtggaccggagcgaagcaaaagagggactgaagagaggcgaaacgaccaaacatgctgtctcacgtggtactgccaagttgaggtggttcgtggagcggaatctggtaaagcctgagggcaaagtgatcgatctcgggtgtggacgcggcgggtggtcctattactgcgcaggattaaagaaagttacagaagtgaagggctataccaaaggtgggcccggacacgaggaaccgattccaatggctacttacggctggaacatcgtcaagctgcacagtggccgagacgtgtttttcacacctcccgagaaatgtgatacccttctgtgcgacataggggaaagctctccaaatcccacgatcgaggagggaagaaccctaagggtcctcaagatggtggaaccttggctgcggggtaaccaattttgtattaagatcttgaatccgtacatgccctccgttgtagagacactggaacagatgcagcgcaaacatggcgggatgctcgtgagaaacccactttcaaggaatagcactcacgagatgtattgggtctcgtgcggaaccggcaacattgtgtctgccgttaacatgacaagtcgaatgctgttaaatcggttcactatggcccatcgtaagcctacctacgagagagatgtggacctgggtgcggggacacgccacgtcgctgtggaacccgagatcgcaaacttggatattatcggacagaggatagaaaatattaaaaacgagcacaagtccacctggcattatgacgaagataatccttacaaaacttgggcctatcacggcagctacgaggtaaagccatcaggctccgcttctagcatggtgaacggggttgtccggctcctgacgaagccctgggacgtgatccctatggtgacacaaatcgccatgaccgacactaccccatttggacagcagagagtcttcaaagagaaggttgatacacgcacgcccaggccgaaacgaggtaccgcacaaattatggaagtgactgccaagtggctatggggctttcttagtcggaataaaaagcctagaatatgtacaagggaggagttcacccgcaaggtacgttccaacgctgcgatcggggccgtgtttgtcgacgagaatcagtggaacagcgcaaaagaagctgtggaggatgagcggttctgggacctggttcatagagaaagggagctccacaagcagggaaaatgcgccacttgcgtgtataatatgatgggcaagcgcgagaagaaactgggtgagtttgggaaggcaaaaggatctcgagccatttggtacatgtggttgggcgctcggttcctggagttcgaggccctcggctttatgaacgaggatcattggttctcaagagaaaatagtctttccggggtcgagggagaaggtctgcacaagttaggctacatcctgagggacattagcaaaatcccagggggaaacatgtatgcggatgacacagcaggctgggatacccgcataacagaggacgatttgcagaatgaggccaagatcactgacattatggaacccgagcacgctctcctggccacctctatctttaaactaacgtaccaaaacaaggtggtaagagttcagcggcctgcaaaatcgggtaccgtgatggatgtcatttcaaggcgtgaccagcgagggagcggacaggtgggcacatatggccttaacactttcaccaatatggaagtgcaactgatccgccagatggagtccgaagggatatttagtccatctgagctcgagaacagcaatctggctgaaagagtcttggactggttagagaagcatggagttgaacggctgaagaggatggccatttccggtgatgactgtgtggtaaaacccacagatgaccgcttcgctactgccctcaccgcacttaacgatatgggcaaggtgagaaaagacatcccgcagtgggagccttcaaaggggtggaatgattggcagcaagtccccttttgcagtcaccatttccaccagctgatcatgaaagacggacgggaaattgtggttccatgtaggaaccaggatgagctagtgggccgagcgcgtgtctctcagggtgccgggtggagcctgagagagacggcttgcctcggaaagtcctacgcccaaatgtggcagttgatgtattttcaccgccgggacctgaggcttgcagctaatgccatatgttcagcagtgcctgtaaactgggttcccacaagcagaaccacttggtctatccatgcccaccatcagtggatgacaaccgaagatatgctgtccgtgtggaatcgcgtctggattgaggaaaacccatggatggaggacaagactcacgtgagtagctgggaagacgttccctacctcggcaaacgggaggatcaatggtgcggctcgttaatcgggctgaccgcgagggctacatgggccacgaatattcaggtggcaatcaaccaggtccgaagattgataggaaatgagaactatctggactacatgacctccatgaagcggttcaaaaatgaatctgatcctgagggtgccctctggtga

SEQ ID NO: 14230 - RNA, 9879 nt, synthetic construct
  misc_feature 1..9879: note = derived and/or modified CDS sequence (opt3) from DENV-1__KR024706__SS-prME
  source 1..9879: mol_type = other RNA
agcgtgaccatgctgctcatgcttctgcccactgcattggctttccacttaactacgaggggcggggaacctcatatgatcgtctccaagcaagaaaggggaaaatctctgctatttaagacctcagccggtgttaacatgtgcaccctcattgccatggacctgggcgagctttgtgaagatactatgacctacaaatgcccacggataacaggggcggagccggacgatgtggactgttggtgcaatgctaccgatacttgggtaacatatggaacctgtagtcaaacgggcgaacaccgccgagacaagcgtagcgtggccctggcaccccatgtcggtttggggctcgagactagaaccgagacatggatgtcctctgaaggagcctggaggcagatccagaaagtggagacttgggctctgcggcaccctggcttcaccgttattgcatttttcctggcccatgctatcggcacatcgattacccagaaggggatcatatttatcctcttaatgctggtgacgccatcaatggccatgcgctgcgtcggaattggtaacagagatttcgtggaaggccttagcggggcgacttgggttgacgttgtgttggagcacggaagttgtgtcacaaccatggcaaagaataaacccactctggatatcgagctactcaagacagaagtgaccaaccctgccgtgctgaggaaactttgcattgaggctaagatctccaatacgaccacagactctcggtgtccaactcaaggcgaagccaccctggtcgaggaacaggatgcaaactttgtttgccgccgaacattggtggacagaggttgggggaatggatgtggcctcttcggcaaagggagcctgttaacttgcgctaagtttaagtgcgtaaccaaactggagggaaagatagtgcagtacgagaacctcaaatattccgtcattgtgacagttcacaccggtgatcagcatcaagtgggcaatgaaactacggagcacgggacaatcgccaccattactccccaggcgcctacctcagaaatccagcttacagactacggagccctgaccttggactgtagtccaaggactggcctagatttcaacgagatggtcctgctcacaatgaaggagaaaagctggctggtgcataagcagtggtttcttgacctgccgttgccctggacgtctggtgcatccacctcacaagagacttggaatcggcaggatctcctggtaacattcaaaaccgctcacgccaagaagcaggaggttgtggtcttagggagccaagaaggcgctatgcacacagccctgactggagcaaccgagatccagacgagtggcaccacaactatttttgccgggcatctaaaatgccgtctcaagatggacaaactgacccttaagggagtgtcttatgtcatgtgtacaggttccttcaaattggaaaaggaggtggctgaaactcagcacggcaccgttctggtgcaggtaaagtacgaggggacggatgcgccttgcaaaataccaatcagcacacaagacgagaagggagtcacccagaacggccgcctcattactgcaaatcccatcgtgacagataaagaaaagcctgttaacatagagaccgaaccacccttcggtgagtcgtatattgtgatcggggccggcgagaaagctctgaaactttcttggtttaagaaaggatcctcaatcggcaagatgttcgaagccactgcaagaggggccaggcggatggctattctgggagacaccgcctgggattttggtagtatcggcggggtcttcacaagcgtgggaaaattggtacatcaggtgtttggcacggcatacggtgttctcttctccggggtctcttggaccatgaagattggcataggaatcctgttaacttggctgggcctaaatagccgatcaacaagtctctccatgacctgtattgcggtggggatggtgacactgtaccttggagtcatggttcaggctgacagcggctgcgtgatcaactggaaaggtcgcgagttgaagtgtgggtctggaatctttgtgactaacgaagtacacacctggacggagcaatataagttccaggccgattcaccgaaaagactgagtgcagccattggcaaggcttgggaagagggtgtctgcggcataaggagcgccacacggctcgagaatatcatgtggaaacagatttccaacgaactgaatcatatcttactggagaacgacatgaagtttaccgtggttgtgggggacgcaaatggcattcttactcagggcaaaaagatgatccgccctcaacccatggaacacaaatactcttggaagtcgtgggggaaggctaaaataatcggagccgatacccagaacacaactttcattatcgacggcccagatacccctgagtgtcccgacgatcagagagcgtggaatatttgggaagtcgaggactatggttttggggtgttcacaacgaacatctggttgaagctcagggatagctacacccagatgtgcgaccaccgtctgatgtccgccgctataaaagattcaaaggcagttcatgccgacatgggatattggattgagagtgagaagaatgagacttggaagctagctcgggcctcttttatcgaagtgaagacatgtatttggccacgaagccacaccctgtggtccaacggcgtactcgagtcagaaatgatcatacccaaaatctacggtggccctattagccaacataattatagaccagggtacttcactcagacagcaggaccgtggcacctgggcaaacttgagttggatttcaacctgtgcgaggggaccacggtcgtggtggacgaacactgcggaaataggggcccctctttacgcactaccacagtcaccggtaaaatcattcatgagtggtgttgccggtcctgtactctccctccactgagatttagaggggaagatggatgctggtacggcatggagatccgccccgttaaggagaaagaagagaaccttgtgcgaagtatggtaagcgcgggttctggcgaagtggactccttctcactggggttgctctgtgtcagtataatgattgaggaagtgatgcggagccgttggtcgagaaagatgctgatgacaggaaccctagccgtatttttcctgctcatcatgggccagctgacatggaatgaccttatcaggttgtgcattatggtgggggctaacgtctccgatcgcatgggaatgggcactacctatctggccttaatggcaacgtttaagatgcggcctatgttcgctgtgggtctcctgtttagaaggcttacatctcgagaggttctgctactcaccatcgggctgagcttggtggcctcagtcgagctgccaaacagtttagaagaactcggagacggcctggcaatgggcattatgatgcttaaactgttgactgatttccaatcccaccagctctggaccacactgctatctctgacttttataaagaccacgcttagcctcgactacgcctggaaaacaatggctatggtactgtccatcgtgtcattgttccccctgtgtttaagcaccacaagtcagaagacaacctggctcccggttctgcttgggtcttttggatgcaaacctctgactatgttcttgattacagaaaataagatctggggtcgcaagtcctggccactcaacgagggcattatggcggtggggatcgtcagcatactgctatcgtcactgcttaaaaatgatgtgcccctcgccggacctctgatcgcaggcggtatgttgattgcttgttatgtaatctctgggagttccgccgacttaagcctggaacgggccgctgaggtgtcttgggaggaagaggcagaacatagcggagcctcccacaacattctcgtcgaggttcaggatgacggcaccatgaagatcaaagatgaagagagagacgatacgctgactatacttctgaaggcgaccttgctagctgtgtcaggcgtgtaccccatgagtattccagccacactgtttgtctggtatttctggcagaaaaagaaacagaggagcggggtgctctgggacaccccttctcccccagaggttgaacgtgcagtactggatgacggaatctaccgcatccttcagcggggtttactgggcagatcccaggtgggggtcggagtgttccaagacggcgtttttcatacaatgtggcacgtgactaggggtgccgtcctcatgtatcaggggaagcgattggagccgtcatgggctagtgtgaagaaagatctgattagctacggaggcggctggcggttccaggggtcctggaataccggagaagaggtacaggtcatagcagtggagcctggtaagaaccccaaaaatgttcaaacgacaccaggcacttttaagacccccgaaggggaggtgggagccatcgcgctcgacttcaaacctggcacatctggttcgccaattgtcaaccgcgaagggaagatcgtgggactgtacggcaatggcgttgtgaccactagcgggacctatgtctcagctattgcccaggcaaaggcctcccaggagggaccccttcctgaaatcgaggatgaggtgtttaaaaagagaaacctgacaataatggacttgcacccgggtagtggcaaaacgaggcggtacctaccagctatcgtacgagaagccattaagagaaaactgcgcactctcatcttagcacccaccagggtggttgcttctgagatggccgaagcgctgaaggggatgcctattcgttatcaaacaaccgccgtcaagagcgagcatactggaaaagaaatcgtggatcttatgtgccacgcaacattcaccatgcggctgctctccccagtgagagtccccaattacaacatgataattatggacgaggctcattttacggatcctgcctcaatcgctgcaaggggctatatctctactcgcgtaggtatgggggaggccgccgctattttcatgacagcgaccccgcccggaagcgtggaagcatttccacagagtaatgccgttatccaggacgaggaacgagatatacctgagagatcctggaacagcggctacgactggattaccgatttccccggcaagactgtgtggtttgtcccatctatcaaatcagggaatgacattgctaactgtttgcggaagaacggaaaaagggtgatccagctgtcccgcaagacattcgacaccgaatatcaaaagactaaaaataacgattgggactacgttgtgactacggatataagtgagatgggtgccaatttccgtgcagacagagtcattgatcctcggaggtgcctcaagcccgtgatcctgaaagacggcccagagcgcgtaatccttgccgggccgatgcctgtgaccgctgcgagcgccgcacagcgaagaggacggattggcaggaaccagaataaggaaggtgatcagtacatctatatggggcaacccctaaacaatgacgaggatcacgctcattggacagaagccaaaatgctgttggacaacattaatactccagagggcataatccccgcattatttgagcctgaacgcgagaagtcggccgctattgatggagaatacagactgggcggggaggccaggaagaccttcgttgaactcatgaaacggggagacctgccagtctggctttcttataaggtggcgtccgagggttttcagtacagcgatcgtcgctggtgcttcgacggcgagcgaaacaatcaggtgctggaagagaacatggacgtcgaaatctggacaaaagagggggaaagaaagaaactcaggccccggtggttggatgcacgcacctattcagaccctctggccctaagagagtttaaggagttcgctgccggaaggcggagtgtttctggcgatctgatcctcgaaattggtaaacttccgcagcacctgactttacgagctcaaaatgcattggacaacctggtgatgctccacaattccgagcaagggggaaaggcctacagacatgctatggaagaactgccagatacgatagaaacccttatgctgctcgccttgatcgcagtactgacaggaggcgtgactttatttttcctaagcgggaagggactgggtaaaacctcaattggcctcctttgtgtcatggcgagtagcgtgctgttgtggatggcctccgttgagccccactggatcgctgcctctattatcctggagtttttcctcatggtgctgcttatacctgaacccgaccgccagaggacaccacaggataaccagctcgcatatgtcgtaatcgggctgttgtttatgattctgaccgtggctgccaacgagatgggattactagaaactacaaagaaagacctgggcatcggtcatgttgtggcagagaatcaccaccatgccacgatgctcgatattgaccttcaccctgctagcgcgtggaccctgtacgccgtcgcaactacaatcataacccccatgatgcggcataccattgagaacacaactgctaatatctccttgacggccattgccaaccaggcagctatcctgatggggctcgataagggctggccaatatcaaaaatggacatcggagtgcctctgcttgccttaggctgctactctcaggtcaatccgctgaccctcacagcggctgtgttgatgctggttgcccactatgcaattatcgggcccggactacaagccaaggctactcgtgaagcacagaagagaaccgccgcgggcattatgaaaaacccaacagtggatggtatcgtagctatagacctggaccctgtggtctacgatgccaagttcgagaaacagctcgggcagattatgcttctgatcttgtgtaccagtcaaatcctgctcatgaggactacgtgggcactgtgcgaatcgattacattagccaccggaccccttactaccctgtgggagggcagcccaggtaagttttggaatacaactatcgctgtttccatggccaacatattccgcggctcttatctcgcaggggctggactagccttctcactgatgaagtccttgggcgggggacggcgaggcaccggtgcgcagggggaaacactgggagagaagtggaagagacagctcaatcagcttagcaaaagtgagtttaacacgtacaagaggtctggcattatggaagtggaccgcagcgaggccaaagaaggtctgaagcggggcgagaccactaaacatgcagtctcaagagggacagctaagttgcgttggttcgtggaaaggaatctggtaaagcctgagggaaaagtgatcgatctcggctgtgggcggggaggctggtcctattactgcgccggtttaaagaaagttaccgaggtgaaggggtatactaaaggaggccccggccacgaggagccgattccaatggcaacatacgggtggaacatcgtcaagctgcacagtggacgcgacgtgtttttcacccctcccgaaaaatgtgatacgcttctgtgcgacataggtgagagctctccaaatcccaccatcgaagagggccgaacactaagagtcctcaagatggtggagccttggctgagggggaaccaattttgtattaagatcttgaatccgtacatgccctccgttgtagaaactctggagcagatgcagcggaaacatggaggcatgctcgtgcgcaacccactttcaagaaatagcacccacgaaatgtattgggtctcgtgcggtacagggaacattgtgtctgctgttaacatgacaagtaggatgctgttaaatcgattcaccatggcccatcggaagcctacatacgagcgtgatgtggacctgggagccggcaccagacacgtcgcggtggagcccgaaatcgctaacttggatattatcggccagcgcatagagaatattaaaaacgaacacaagtccacttggcattatgacgaggataatccttacaaaacgtgggcatatcacgggagctacgaagtaaagccatcaggatccgcctctagcatggtgaacggtgttgtcaggctcctgacaaagccctgggacgtgatccctatggtgacccaaatcgctatgactgacaccacaccatttggccagcagcgggtcttcaaagagaaggttgatacgagaacaccccgcccgaaaagggggactgcccaaattatggaggtgacagcaaagtggctatggggatttcttagtcgaaataaaaagcctcggatatgtaccagagaagagttcactaggaaggtacgctccaacgccgctatcggcgcggtgtttgtcgacgaaaatcagtggaacagcgccaaagaggcagtggaagatgagcgtttctgggacctggttcatcgggagagagaactccacaagcagggtaaatgcgctacatgcgtgtataatatgatggggaagagggagaaaaagctgggagaatttggcaaggccaaaggctctcgcgcaatttggtacatgtggttgggggcccgattcctggagttcgaagctctcggatttatgaacgaggatcattggttctcacgggagaatagtctttccggtgtcgaaggcgaggggctgcacaagttaggatacatcctgagagacattagcaaaatcccaggcggtaacatgtatgccgatgacaccgcggggtgggatacaaggataactgaagacgatttgcagaatgaggcaaagatcaccgacattatggagcccgaacacgccctcctggctacgtctatctttaaactaacctaccaaaacaaggtggtacgcgttcagagacctgccaaatcgggaacagtgatggatgtcatttcacggagggaccagcgtggcagcggccaggtggggacttatggacttaacaccttcacaaatatggaggtgcaactgatccgacagatggaatccgagggtatatttagtccatctgaactcgagaacagcaatctggcagagcgcgtcttggactggttagaaaagcatggcgttgagagactgaagcggatggctatttccggggatgactgtgtggtaaaacccactgatgacaggttcgccaccgctctcacggcccttaacgatatgggaaaggtgcgcaaagacatcccgcagtgggaaccttcaaagggctggaatgattggcagctggtccccttttgcagtcaccatttccaccaactaatcatgaaagacggtagagagattgtggttccatgtcggaaccaggatgaactggtggggagggcacgagtctctcagggagcgggctggagcctccgtgagacagcctgcttgggcaagtcctacgctcagatgtggcaactgatgtattttcacagacgcgaccttcggctggccgcaaatgctatatgttcagccgtgcctgtaaactgggttcccaccagcaggactacatggtctatccatgcacaccatcagtggatgaccactgaggatatgctctccgtgtggaatagagtctggattgaagagaacccatggatggaagacaagacccacgtgagtagctgggaggacgttccctacttagggaaacgcgaagatcagtggtgcggatcgctgatcggtttgacagcccgggcgacgtgggctaccaatattcaagtggccatcaaccaggtcaggcgactgataggcaatgagaactatctcgactacatgacttccatgaagagattcaaaaatgagtctgatcctgaaggggcactttggtga

SEQ ID NO: 14231 - RNA, 9879 nt, synthetic construct
  misc_feature 1..9879: note = derived and/or modified CDS sequence (opt3) from DENV-1__KR024707__SS-prME
  source 1..9879: mol_type = other RNA
agcgtgaccatgctgctcatgcttctgcccacagcattggctttccacttaactacgagaggaggggaacctcatatgatcgtctccaagcaagaaaggggaaaatctctgttatttaagacctcagccggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggttgacgttgtgctggagcacgggagttgtgtcacaaccatggcaaagaataaacccactttggatatcgaactcctgaagacagaggtgaccaaccctgccgtgcttaggaaactgtgcattgaagctaagatctccaatacgaccacagactctcggtgtccaactcaaggagaggccaccttggtcgaagaacaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaagggggtgtcttatgtcatgtgtacaggatccttcaaattggagaaggaagtggctgagactcagcacggtaccgttctggtgcaggtaaagtacgagggcacggatgcgccttgcaaaataccaatcagcacacaagacgaaaagggggtcacccagaacggacgcctcattactgcaaatcccatcgtgacagataaagagaagcctgttaacatagaaaccgagccacccttcggcgagtcgtatattgtgatcggtgccggggaaaaagctctgaaactttcttggtttaagaaaggctcctcaatcggaaagatgttcgaggccactgcaagaggcgccaggcggatggctattctgggggacaccgcctgggattttggaagtatcggtggcgtcttcacaagcgtggggaaattggtacatcaggtgtttggaacggcatacggcgttctcttctccggtgtctcttggaccatgaagattgggataggcatcctgttaacttggctgggactaaatagccgatcaacaagtctctccatgacctgtattgcggtgggcatggtgacactgtaccttggggtcatggttcaggctgacagcggatgcgtgatcaactggaaaggccgcgaattgaagtgtggttctgggatctttgtgactaacgaggtacacacctggacggaacaatataagttccaggccgattcaccgaaaagactgagtgcagccattggaaaggcttgggaggagggcgtctgcggtataaggagcgccacacggctcgaaaatatcatgtggaaacagatttccaacgagctgaatcatatcttactggaaaacgacatgaagtttaccgtggttgtgggcgacgcaaatgggattcttactcagggcaagaagatgatccgccctcaacccatggagcacaaatactcttggaagtcgtggggcaaggctaaaataatcggggccgatacccagaacacaactttcattatcgacggaccagatacccctgaatgtcccgacgatcagagagcgtggaatatttgggaggtcgaggactatggctttggtgtgttcacaacgaacatctggttgaagctcagggatagctacacccagatgtgcgaccaccgtctgatgtccgccgctataaaagattcaaaggcagttcatgccgacatggggtattggattgaaagtgagaaaaatgaaacttggaagctagctcgggcctcttttatcgaggtgaagacatgtatttggccacgaagccacaccctgtggtccaacggagtactcgaatcagagatgatcatacccaaaatctacggcggtcctattagccaacataattatagaccaggctacttcactcagacagcagggccgtggcacctgggaaaacttgagttggatttcaacctgtgcgaaggcaccacggtcgtggtggacgagcactgcgggaataggggaccctctttacgcactaccacagtcaccggcaaaatcattcatgaatggtgttgccggtcctgtactctccctccactgagatttaggggtgaggatgggtgctggtacggaatggagatccgccccgttaaggaaaaagaggaaaaccttgtgcgaagtatggtaagcgcgggctctggtgaggtggactccttctcactgggcttgctctgtgtcagtataatgattgaagaggtgatgcggagccgttggtcgagaaagatgctgatgacagggaccctagccgtatttttcctgctcatcatgggacagctgacatggaatgaccttatcaggttgtgcattatggtgggcgctaacgtctccgatcgcatggggatgggaactacctatctggccttaatggcaacgtttaagatgcggcctatgttcgctgtgggcctcctgtttagaaggcttacatctcgagaggttctgctactcaccatcggtctgagcttggtggcctcagtcgaactgccaaacagtttagaggaactcggggacggactggcaatgggcattatgatgcttaaactgttgactgatttccaatcccaccagctctggaccacactgctatctctgacttttataaagaccacgcttagcctcgactacgcctggaaaacaatggctatggtactgtccatcgtgtcattgttccccctgtgtttaagcaccacaagtcagaagacaacctggctcccggttctgcttggctcttttgggtgcaaacctctgactatgttcttgattacagagaataagatctggggacgcaagtcctggccactcaacgaaggtattatggcggtgggcatcgtcagcatactgctatcgtcactgcttaaaaatgatgtgcccctcgccgggcctctgatcgcaggaggcatgttgattgcttgttatgtaatctctggtagttccgccgacttaagcctggagcgggccgctgaggtgtcttgggaagaggaagcagagcatagcggggcctcccacaacattctcgtcgaagttcaggatgacggaaccatgaagatcaaagatgaggagagagacgatacgctgactatacttctgaaggcgaccttgctagctgtgtcaggcgtgtaccccatgagtattccagccacactgtttgtctggtatttctggcagaagaagaaacagaggagcggcgtgctctgggacaccccttctcccccagaagttgagcgtgcagtactggatgacgggatctaccgcatccttcagcggggattactgggtagatcccaggtgggcgtcggggtgttccaagacggagtttttcatacaatgtggcacgtgactaggggcgccgtcctcatgtatcagggtaagcgattggaaccgtcatgggctagtgtgaagaaagatctgattagctacgggggaggctggcggttccagggctcctggaataccggggaggaggtacaggtcatagcagtggaacctggaaagaaccccaaaaatgttcaaacgacaccaggtacttttaagacccccgagggcgaagtgggggccatcgcgctcgacttcaaacctggaacatctggctcgccaattgtcaaccgcgagggtaagatcgtggggctgtacggaaatggcgttgtgaccactagcggcacctatgtctcagctattgcccaggcaaaggcctcccaggaagggccccttcctgagatcgaggatgaagtgtttaaaaagagaaacctgacaataatggacttgcacccgggaagtggtaaaacgaggcggtacctaccagctatcgtacgagaggccattaagagaaaactgcgcactctcatcttagcacccaccagggtggttgcttctgaaatggccgaggcgctgaagggcatgcctattcgttatcaaacaaccgccgtcaagagcgaacatactgggaaagagatcgtggatcttatgtgccacgcaacattcaccatgcggctgctctccccagtgagagtccccaattacaacatgataattatggacgaggctcattttacggatcctgcctcaatcgctgcaaggggatatatctctactcgcgtaggcatgggtgaagccgccgctattttcatgacagcgaccccgcccgggagcgtggaggcatttccacagagtaatgccgttatccaggacgaagaacgagatatacctgaaagatcctggaacagcggatacgactggattaccgatttccccggcaagactgtgtggtttgtcccatctatcaaatcaggcaatgacattgctaactgtttgcggaagaacgggaaaagggtgatccagctgtcccgcaagacattcgacaccgagtatcaaaagactaagaataacgattgggactacgttgtgactacggatataagtgagatgggagccaatttccgtgcagacagagtcattgatcctcggaggtgcctcaagcccgtgatcctgaaagacggtccagaacgcgtaatccttgccggcccgatgcctgtgaccgctgcgagcgccgcacagcgaagagggcggattggaaggaaccagaataaggagggcgatcagtacgtttatatgggtcaacccctaaacaatgacgaagatcacgctcattggacagaggccaaaatgctgttggacaacatcaatactccagaggggattatacccgcattatttgaacctgagcgcgaaaagtcggccgctatcgatggcgagtacagactgaggggagaagcccggaagaccttcgtcgagctcatgcgtcgcggcgacctgccagtgtggctttcttataaagtggcgtccgaggggtttcagtacagcgatcgaagatggtgcttcgacggagaaaggaacaatcaggtcctggaggaaaacatggacgttgagatttggacaaaggaaggtgagcggaaaaagctccgccccagatggttggatgcaaggacctattcagaccctctggccctacgggagtttaaagagttcgctgccggccgaagaagtgtgtctggggatctgatcctcgagatcggaaaacttccgcagcacctgactttacgcgctcaaaatgcattggacaacctggtaatgctccacaattccgaacagggcggtaaagcctacaggcatgctatggaggaactgccagatacgattgagacccttatgctgctcacattgatagccgtgctgactgggggcgtcaccttatttttcctaagcggaaagggcctggggaagacatcaatcggactcctttgtgtgatggcaagtagcgttctgttgtggatggcgtccgtggagccccactggattgccgcttctatcattctggaatttttcctcatggtcctgcttatccctgagcccgaccggcagcgtaccccacaggataaccaactcgcctatgtagtgataggtctgttgtttatgatcctgactgttgcagctaacgaaatgggcttactagagacaacgaaaaaggacctggggattggacatgtggtcgccgagaatcaccaccatgcaaccatgctcgatatcgaccttcaccctgccagcgcttggactctgtacgcggtggccacaaccattatcacccccatgatgagacatacaatagaaaacactacggcaaatatttccttgaccgctatcgccaaccaggccgcaattctgatgggcctcgataaaggttggccaatctcaaagatggacataggggtccctctgcttgctttaggctgctactctcaggtgaatccgctgacactcactgccgcggttttgatgctggtggctcactatgccatcattggacccggcctacaagcaaaagccaccagggaggctcagaagcgcacagcagccgggatcatgaagaacccaaccgtagatggaattgtggcgatcgacctggaccctgtcgtttacgatgctaaattcgaaaagcagctcggccagataatgcttctgattttgtgtacgagtcaaatcctgctcatgcggactacatgggccctgtgcgagtcgatcaccttagcaactggtccccttaccacactgtgggaagggagcccaggaaaattttggaatactaccattgccgtgtccatggctaacatcttccgaggctcttatctcgccggtgcaggcctagctttctcactgatgaaaagcctagggggaggcagaagggggacaggagcccagggcgagacgctgggtgagaaatggaagcgccagctcaatcagctttccaagagtgaatttaacacctacaaacggtctgggataatggaggtcgacagaagcgaagcgaaggagggactgaaacgtggcgaaactacaaagcatgccgtgtcaaggggtaccgcaaaattgcggtggttcgtagagcgcaatctggtgaagcctgagggcaaggttattgatctcgggtgtggacgaggcgggtggtcctattactgcgctggactaaagaaggtgactgaagtcaaaggctatacaaagggtgggcccggacacgaggaaccgatcccaatggccacctacggctggaacattgtgaaactgcacagtggcagagacgtctttttcacgcctcccgagaagtgtgatacccttctgtgcgacatcggggaaagctctccaaatcccacaatagaggagggaaggactctacgggtgctcaaaatggttgaaccttggctgcgcggtaaccaattttgtatcaagattttgaatccgtacatgccctccgtagtggagaccctggaacagatgcagagaaagcatggcgggatgctcgtcaggaacccactttcacgaaatagcacacacgagatgtattgggtgtcgtgcggaactggcaacatcgtttctgcagtgaacatgaccagtcggatgctgttaaatcgtttcacaatggctcatagaaaacctacctacgagcgcgatgtcgacctgggtgccgggactaggcacgtggccgtagaacccgagattgcgaacttggatatcattggacagcggatcgaaaatataaagaacgagcacaaatccacgtggcattatgacgaagataatccttacaagacatgggcttatcacggcagctacgaggtgaaaccatcaggctccgcatctagcatggttaacggggtcgtgagactcctgaccaagccctgggacgtgattcctatggtcactcaaatcgccatgaccgacacaacgccatttggacagcagcgcgttttcaaggagaaagtggataccaggactccccgaccgaagcggggtacagctcaaatcatggaagtaaccgccaaatggctatggggctttcttagtagaaataagaaacctaggatttgtactcgcgaggagttcacacgtaaggtgcggtccaacgcagccataggggctgtctttgtggacgagaatcagtggaacagcgcgaaggaagccgttgaggatgagagattctgggacctggtgcatagggaacgcgagctccacaaacagggaaagtgcgcaacctgcgtctataatatgatgggcaaacgagaaaagaaactgggtgagtttgggaaggctaagggatctcgggccatctggtacatgtggttgggcgcaagattcctggagttcgaggccctcggctttatgaacgaggatcattggttctcaagggaaaatagtctttccggggtggagggagaaggtctgcacaaattaggctacattctgcgcgacatcagcaagattccagggggaaacatgtatgctgatgacacagccggctgggatactagaatcaccgaggacgatttgcagaatgaggcgaaaataacggacatcatggaacccgagcacgcactcctggccacctctatttttaagctaacataccaaaacaaagtagttcgggtgcagaggcctgctaagtcgggtactgtcatggatgtgatctcacgtcgagaccagcgcgggagcggacaggtgggcacctatggccttaacacattcactaatatggaagtccaactgattagacagatggagtccgaagggatctttagtccatctgagctcgagaacagcaatctggccgaacgggttttggactggttagagaaacatggagtggaaaggctgaagcgcatggcaatatccggtgatgactgtgtagtgaagcccaccgatgacagattcgctacggccctcacagctcttaacgatatgggcaaagtccggaaggacattccgcagtgggagccttcaaaagggtggaatgattggcagcaagtgcccttttgcagtcaccatttccaccagctgatcatgaaggacggaagggaaatcgttgtgccatgtcgaaaccaggatgagctagtcggccgtgccagagtgtctcagggtgcagggtggagcctgcgcgagaccgcgtgcctcggaaaatcctacgcccaaatgtggcagttgatgtattttcaccggagggacctgagacttgctgccaatgcaatttgttcagctgtacctgttaactgggtgcccactagccgcacaacctggtctatacatgcccaccatcagtggatgactaccgaagatatgctgtccgtctggaatcgggtgtggatcgaggaaaacccatggatggaggacaagacacacgttagtagctgggaagacgtgccctacctcggcaagagggaggatcaatggtgcggctcgttaattgggctgacggcacgagccacctgggcgactaatatccaggtcgctattaaccaggtgagacggttgatcggaaatgagaactatctggactacatgacatccatgaaaaggttcaagaatgaatctgatcctgagggtgccctctggtga

SEQ ID NO: 14232 - RNA, 9879 nt, synthetic construct
  misc_feature 1..9879: note = derived and/or modified CDS sequence (opt3) from DENV-1__KC172829__SS-prME
  source 1..9879: mol_type = other RNA
agcgtgacaatgctgctcatgcttatgcccacagcactggctttccacttgactacgagaggaggggaacctcatatgatcgtctccaagcaggaaaggggaaaatctttactgtttaagacctcagccggtgttaacatgtgcacactaattgccatggacctcggcgaactgtgtgaagatactatgacctacaaatgcccacggattacagaagcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggaaccttcaaactggagaaggaagtcgctgagacgcagcacggtacagtgcttgttcagataaagtacgagggcaccgacgcgccttgcaaaatcccattcagcactcaagatgaaaagggggtgacacagaacggacgcttgattaccgcaaatcccatcgtaactgacaaagagaagcctgtcaacatagaagccgagccaccctttggcgagtcgtatattgtgatcggtgctggggaaaaagccctgaagctctcttggttcaagaaaggctcctcaatcggaaagatgtttgaggcaaccgccagaggcgctaggcggatggccattctgggggatacagcatgggacttcggaagtatcggtggcgtttttacgagcgtggggaaacttgtccatcagattttcggaaccgcgtacggcgtgctgttttccggtgtatcttggactatgaagatagggatcggcgtgttgctcacatggctgggattaaatagccgatcaaccagtctgtccatgacatgtattgctgttggcctagtcactctctacctgggggtgatggtgcaggccgatagcggatgcgtcgttaactggaaaggccgcgaacttaagtgtggttctgggatcttcgtgaccaatgaggtgcacacgtggacagaacaatataagtttcaggcagactcaccgaaaagattgagtgccgctatcggaaaggcctgggaggagggcgtatgcggtattaggagcgcaacccggctggaaaacataatgtggaaacagatctccaacgagctcaatcatattctgttagaaaacgacatgaagttcactgtcgtggttggcgatgtggctgggatcctggcccagggcaagaagatgattcgccctcaacccatggagtacaaatattcttggaagtcgtggggcaaggcgaaaatcataggggccgacgtccagaataccacatttatcattgatggaccaaacactcctgaatgtcccgacgatcagagagcttggaatatctgggaggtggaggactacggcttcggtatttttaccacaaacatctggcttaggttgcgtgatagctatacgcaggtttgcgaccaccggctcatgtccgcagccataaaggattcaaaagctgtgcacgccgacatggggtactggattgaaagtgagaagaatgaaacctggaaactggcacgagcgtctttcatcgaggtaaagacttgtatttggccaaagagccatacactatggtccaacggagtcctggaatcagagatgatcatacccaaaatctatggcggtcctattagccaacacaattacagaccaggctacttcacccagactgccgggccgtggcatctcggaaagctggagcttgattttgacttgtgcgaaggcacaaccgtggtggtcgatgagcactgcgggaacaggggaccctctctgcgcacgactaccgttacaggcaaaatcattcacgaatggtgttgccggtcctgtaccttacctccactcagattcaggggtgaggacgggtgctggtatggaatggagatccgccccgtgaaggaaaaagaggaaaatctggtaaagagtatggtgagcgctggctctggtgaggtcgactccttttcacttggcctgttgtgtataagtattatgatcgaagaggtgatgcgaagccggtggtcgcgtaagatgctcatgactgggacactggccgttttctttctactgatcattggacagctcacctggaacgatctgatcagactttccattatggtgggcgcaaatgcttctgacaaaatggggatgggaacaacttacttggccctgatggcaaccttcaagatgaggcctatgtttgccgtcggcttactcttccgccggctgacgagcagagaggtgcttctgctaacaataggtctctcactggttgctagtgtggaattgccaaactccctggaggaattaggggatggactcgcgatgggcatcatgattctgaaacttctgaccgactttcaatctcatcagttgtgggccactctcctgagcctaaccttcatcaagacaactttttccctgcactatgcatggaaaaccatggctatggtcctttcaattgtaagcctcttccccctgtgcttgagtacgacatctcagaagaccacttggctgccggtgttactcggctccctggggtgtaagcctcttacaatgtttctgatcaccgagaataaaatatggggaagaaagagctggccattgaacgaaggtatcatggccgttggcattgtgtcgatcctcctgtcatctctactgaaaaacgatgtcccccttgccgggcctctcattgctggaggcatgctgatcgcatgctacgtgataagtggttccagcgccgacttgtctttagagaaggcggctgaggtaagctgggaagaggaagccgagcattccggggcatcacacaatattctggtggaagtccaggatgacggaactatgaaaatcaaggatgaggagcgagacgatacactcaccatcctgcttaaagccacgctgttggctgttagtggcgtgtatcccctaagcattccagcaactctgttcgtgtggtacttctggcaaaagaagaaacagcgctctggcgtcctctgggacaccccttcacccccagaagtggagcgggccgttctggatgacgggatatatagaatcatgcagaggggacttttaggtcgtagccaggtaggcgtgggggtctttcaagaaaacgtgttccatacaatgtggcacgttacccgcggagcggtgctgatgtaccagggcaagcggctcgagccgagttgggctagcgtcaaaaaggacttgatttcctacggtgggggatggagactgcagggctcttggaatacaggcgaggaagtgcaggtaatcgccgtcgagcctgggaaaaaccccaagaatgtgcaaactgcaccaggaacctttaagacgacagaaggtgaggttggcgccattgctctcgatttcaaacccgggacttcgggaagccctatcgtgaacagggaaggcaagatagtcggtctgtatgggaatggagtggttaccacatcaggcacctacgtgtccgccatcgcacaggctaaagccagtcaggagggcccacttcccgagattgaagacgaggtctttcgaaagcggaacctgactatcatggatttgcaccctgggtctggaaaaacccgcagatatctaccggcgattgtgagggaagccatcaagcggaagctgcgaacactcatattagcaccaacgagagtagtggctagcgagatggccgaagctctgaaaggtatgcccattcgctaccaaactaccgcagttaagtccgagcatacaggcaaagagatcgtcgaccttatgtgtcacgccaccttcactatgaggctgctctcacctgtgcgtgtgccaaattataacatgatcattatggatgaagcccattttacagacccctctagcatcgctgcgcgggggtacataagtaccagagtcggaatgggcgaggcagccgctattttcatgacggccactcctccgggttccgtagaagcatttccccagagcaatgccgtgatccaggatgaggaaagggacattccagagcgctcttggaactcagggtatgagtggatcacagatttctccggaaagaccgtttggtttgtgcctagtataaaaagcggcaatgacattgctaactgcttgcgaaagaatggcaagagagtcatccagctgtcgcggaaaaccttcgatactgaataccaaaagaccaaaaacaacgactgggactacgtggttaccacagatatctctgagatgggggcgaatttcagggccgaccgcgtgattgatccccgtagatgtctcaagccagtcatcctgaaagacggacctgaacgggtgattcttgcaggtcccatgccagtaactgtggcttccgccgcacagaggcgcggccgaatagggagaaaccacaataaggagggagatcagtatatctacatgggccagccgctaaacaatgacgaggatcatgcccactggacggaagctaagatgctgttggacaacattaatacccctgagggtatcatccccgccttatttgaaccagagcgggagaaatccgcggcaattgatggggagtataggctgcgcggcgaggccagaaagacattcgttgaactcatgaggcggggagacctgcccgtctggctttcatacaaagtggctagtgagggctttcaatattctgatcgtcgctggtgcttcgacggggaacgaaacaatcaggtgctggaggaaaacatggatgtcgagatatggactaaggagggagaaaggaaaaagctcaggcctcggtggttggacgcccgcacctactccgacccactggctctaagagagtttaaagagttcgcagccggtaggcggagcgtttcaggcgatctgatcctcgagattgggaaacttccccagcacctgacacagcgagctcaaaatgccttagacaacttggtgatgctgcataatagtgaacagggaggcagagcatatcgccacgcgatggaggagctccctgataccatcgaaactctgatgcttctggccctcattgctgtattgacgggtggggtgaccctgtttttcttaagcggcaggggactaggcaagacatccatcgggctgctctgcgtcatggcctctagcgtgcttctgtggatggcatccgttgagccgcattggatagctgcctcaatcattttggaatttttcctgatggtgctcctgatcccagagcccgaccggcagcgtactcctcaggataaccaacttgcatacgtcgtaattggactcctgtttatgatcttgaccgtggccgctaatgagatgggtctgttagaaacaaccaaaaaggacctaggcatagggcacgttgcggatgagaaccaccatcacgccgcaatgctggacgtggatctccatcccgcttctgcctggactctttacgccgtcgcaacaacgattatcaccccaatgatgagacacactattgaaaacacaaccgctaatatcagtctgaccgccatagcgaaccaggctgccatcttgatgggactggacaaaggctggcctatttcgaagatggatatcggtgtgcccctcctggcacttgggtgttatagccaggtcaatccattaacactgactgccgctgtgctcatgttggttgcacattacgccattatcggccctggactgcaagcgaaagctacgagggaggcccagaagcgcaccgcagccggcataatgaagaacccgacagtggacgggattgtagctatcgatctagaccccgtggtctatgacgccaaattcgaaaagcagctgggacagatcatgctccttattctgtgcacttcccaaatcttgctgatgcggaccacatgggcactctgtgagtctataaccctggctactggcccattaacgacactttgggagggttcacctgggaaattttggaataccactattgccgttagcatggcgaacatcttccgaggatcctacctggccggcgcaggtctcgctttcagtctaatgaagtctctgggcgggggaagaaggggcaccggggcccagggagaaacattgggcgagaaatggaagcgccagctgaatcagctcagcaagtcagaatttaacacttataaacggtccggtattatggaggtggatagaagtgaagcaaaggaggggcttaaacgtggagagaccacaaagcacgctgtcagcaggggcacggccaaactgcggtggttcgtggaacgcaatttggtaaagcccgagggtaaggtgatcgacctgggctgcgggcgaggaggctggtcttactattgtgccgggctcaaaaaggttaccgaagtgaaaggatacactaagggcggtccagggcacgaggaacctatacccatggcgacatacggatggaacttagtcaaactgcattccggcaaggatgtgtttttcatcccgccagagaaatgcgacacccttctgtgtgatattggcgagtcaagccctaatcccactatcgaagaggggagaacactaagggtcctcaagatggtggaaccatggctgcggggaaaccaattttgcattaagatcttgaatccctatatgccttcggttgtagagaccctggagcagatgcagcgcaaacacggtggcatgctcgtgagaaacccgctttctaggaatagtacgcatgaaatgtactgggtctcctgtgggaccggaaacattgtgagcgctgttaatatgacatcacgaatgctgttaaaccggttcactatggtgcaccgtaagcccacctatgagagagacgtcgatctgggcgcaggtacacgccacgtggccgtagaaccagaggtggctaacttggacatcatagggcagaggattgaaaatatcaaacatgagcacaagtccacttggcattacgatgaggacaacccttataaaacctgggcctaccacggatcttatgaagttaagcccagcggcagtgcatccagcatggtcaatggcgtggtgaagctcctgacaaaaccttgggatgtcatcccaatggttacccaaattgccatgactgacacgacaccctttgggcagcagcgggtgttcaaggagaaagtagacaccagaactcctaaggctaaacgcggaaccgcgcaaataatggaagtgacagccaggtggctatggggttttctttctcgaaacaagaagccacggatctgcacgagagaggagttcaccaggaaagtccgctcaaatgcagctattggcgccgtgtttgttgatgagaaccagtggaatagtgcaaaggaggccgtggaagacgagcgtttctgggatctggtccatcgggaaagagagctccacaaacaggggaagtgtgctacttgcgtgtacaacatgatgggaaaaagggaaaagaagctgggcgagtttggtaaagccaaggggtcccgcgcgatctggtacatgtggttgggagcacgattcctggagttcgaagccctcggctttatgaatgaggaccactggttcagccgggaaaactctctttcgggcgtagagggggagggactgcataaattaggttatattctgagagatatctcaaagatacccggcgggaatatgtacgctgacgatacagccggatgggacaccaggatcactgaagatgacttgcagaacgaggcaaaaattacagatatcatggaaagcgagcacgctctcctggccaagtccatttttaaactaacctatcaaaataaggttgtgcgcgtccagagaccggctaagaacggcacagtgatggacgtgatcagtcggagggatcagcgtggttctgggcaggtcggaacttacggccttaataccttcacgaacatggaagcccaactgatacgacagatggagagcgagggcatattttccccttcagaactcgagaccccaaacctggcagaacgcgcgttggactggttagagaaacatggggttgaaagactgaagcggatggccatcagtggagacgattgcgtggtaaaacccatcgacgataggttcgctacagccctcactgcacttaatgacatgggtaaggtgcgcaaagatattcctcagtgggagccatctaagggctggaacgactggcagcaagtccccttttgtagccaccacttccatcagctgataatgaaggatgggagagagatcgtggttccgtgccggaatcaggacgagctagtgggaagggctcgagtctcccagggcgccggttggtcactgcgtgagaccgcatgtctcgggaaaagctatgcccaaatgtggcagttgatgtactttcacagacgcgatctgcggcttgcggctaacgccatttgctctgcagtgcctgtagactgggttcccacatccaggactacctggagtatccatgcccaccatcagtggatgacgacagaagatatgctgagcgtgtggaatagagtctggattgaggaaaacccatggatggaggacaagacccacatctcgtcctgggaggacgtgccttatctcggaaaacgcgaagatcaatggtgtggctctttaataggcctgactgctcgggccacatgggcaaccaatatccaggttgctatttcacaggtgaggcgattgatcgggaacgagaattacctggactacatgactagcatgaagagattcaaaaacgaaagtgatcccgagggagccctctggtga

SEQ ID NO: 14233 - RNA, 9879 nt, synthetic construct
  misc_feature 1..9879: note = derived and/or modified CDS sequence (opt3) from DENV-1__EU359008__SS-prME
  source 1..9879: mol_type = other RNA
agcgtgaccatgctgctcatgcttatgcccacggcactggctttccacttgactacgagaggcggggaacctcatatgatcgtctccaagcaggaaagagggaaatctttactgtttaagacctcagccggtgttaacatgtgcacattaattgccatggacctcggcgagctgtgtgaagatactcttacctacaaatgcccacggataacagaggcggaaccggacgatgtggactgttggtgcaatgctaccgatacttgggtaacatatgggacctgtagccaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaagcagagattttgtggagggtttgagtggcgcgacttgggtagacgttgtgctggagcacgggtcctgtgtcacaaccatggcaaaggataaacccactctagacatcgaactcctgaagacagaggtgaccaaccctgccgtgcttaggaaactgtgcattgaagctaagatctctaatacgaccacagatagccggtgtccaactcaaggagaggccaccttggtcgaagaacaggacgcaaacttcgtttgccgccgaacatttgtggatagaggctggggtaatgggtgtggactcttcggcaaaggctccctgataacttgcgctaagtttaagtgcgtaaccaaattagaggggaagattgtgcagtacgaaaacctgaaatattcagtcatcgtgacagttcacaccggagaccagcatcaagtgggtaatgagagtactgaacacggcacgacagccaccattactccccaggcgcctaccacagagatccagctcaccgactacggggcccttactctggattgtagcccaaggacaggattggacttcaacgaaatggtcctactgacgatgaaggagaaatcttggctcgtgcataagcagtggtttctggatcttccgctgccctggacctccggcgcatcaactacacaagagacctggaatcggcaggacttgctcgtaacattcaaaactgctcacgccaagaagcaggaagttgtggtcctgggtagccaagagggggctatgcacaccgccttaacgggcgcaaccgaaatccagacaagtggaactaccacaatttttgccggccatctgaaatgccgtctaaagatggataaactcactctgaaggggatgtcttatgtgatgtgtaccggatccttcaaacttgagaaggaagtcgctgagacgcagcacggtacagtgttggttcagataaagtacgagggcaccgacgcgccttgcaaaatcccattcctgactcaagatgaaaagggggtgacacagaacggacgcctcattaccgcaaatcccatcgtaactgacaaagagaagcctgtcaacatagaagccgagccaccctttggcgagagctatattgtgatcggtgctggggaaaaagccctgaaactttcgtggttcaagaaaggatcttccatcggaaagatgtttgaggcaaccgccagaggcgctaggcggatggccattctgggggatacagcatgggacttcggatcaatcggtggcgtttttacgagtgtggggaaattggtccatcagattttcggaaccgcgtacggcgtgctctttagcggtgtatcctggactatgaagatagggatcggcgctctgttaacatggctgggactaaattctcgaagcacctcactcagtatgacatgtattgccgtgggcctggttactctttacttgggggtcatggtgcaggcagattccggatgcgtgatcaactggaaaggccgcgaactgaagtgtggtagcgggatcttcgtcaccaatgaggttcacacgtggacagaacaatataagtttcaggccgactctccgaaaagactctcagctgccattggaaaggcatgggaggagggcgtgtgcggtataaggagtgctacccggctggaaaacatcatgtggaaacagattagcaacgagttaaatcatatcctgcttgaaaacgacatgaagttcactgtggtagtcggcgatgtggccgggattttggcgcagggcaagaagatgatccgccctcaacccatggagcacaaatactcctggaagtcttggggcaaggccaaaataatcggggctgacgttcagaataccacatttattatcgatggaccaaacactcctgaatgtcccgacgatcagagagcatggaatatttgggaggtggaggactatggcttcggtatctttaccacaaacatatggctcaagctgagggattcgtacacgcaggtctgcgaccaccgtctaatgagcgccgctattaaagattccaaggccgtgcatgcagacatggggtattggatcgaatcagagaaaaatgaaacctggaagctggcgcgggccagtttcattgaggttaagacttgtatctggccaaaatctcacacactctggagcaacggagtgctggaatccgagatgataatccccaagatttacggcggtcctatctcacaacataattatcgaccaggctacttcacccagactgctgggccgtggcaccttggaaaattggagctggattttgacttatgcgaaggcacaaccgtagtcgtggatgagcactgcgggaacagaggacccagcctcaggacgactaccgtgacaggcaagattatccatgaatggtgttgccgctcttgtaccctgcctccacttcggttcagaggtgaggacgggtgctggtacggaatggagataaggcccgtcaaagaaaaggaggaaaatctggttaagtccatggtgagtgccggcagcggtgaggtagactctttttccttgggcctcctgtgtatttcaatcatgatcgaagaggtgatgcgcagtcgatggagccggaaaatgctaatgactgggacactggcagtcttctttctcctgattatgggacaggtgacctggaacgatcttatccgtttgtgcattatggttggcgctaatgcctcggacagaatggggatgggaacaacttatctggcattaatggccaccttcaagatgaggcctatgtttgctgtgggcctcctgttccgccggcttacgtccagagaggtcctgctactcacaataggtctgtctttggtggcgagcgttgaactgccaaactcattagaggaactcggggatggactggccatgggcatcatgattcttaaactgttgaccgactttcaaagtcaccagctctgggcaactctgctatccctgaccttcatcaagacaactttttctcttcattacgcttggaaaaccatggccatggtgctcagcattgtctccctgttccccttgtgtctgtcaacgacaagccagaagaccacttggttaccggtactcctgggcagtcttgggtgcaagcctctgacaatgtttttgatcgccgagaataaaatatggggaaggaagtcttggccactcaacgaaggtatcatggctgtgggcattgtttccatcctgctaagctcgctgcttaaaaacgatgtgcccctcgcagggcctctgattgccggaggcatgttgatcgcgtgttatgtcatatcaggttctagtgctgacttatccctggagaaggccgcagaggtgagctgggaagaggaagccgagcactctggggctagccataatattctcgtagaagtgcaggatgacggaaccatgaaaatcaaggatgaggagcgagacgatactctgacaatccttctgaaagcaaccttgctagccgtctccggcgtttaccccctgtcaattccagcgacactcttcgtgtggtatttctggcaaaagaagaaacagcgcagtggcgtgctgtgggacactcctagtcccccagaagtcgagcgggctgtgcttgatgacgggatatacagaatcatgcagaggggattactgggtcgttctcaggttggcgtaggggtgtttcaagaaaacgtcttccacaccatgtggcacgtgacacgcggagccgttctcatgtatcagggcaagcggttggagccgtcctgggcatcagtgaaaaaggacctgattagttacggtgggggatggagactccagggcagctggaataccggcgaggaagtccaggtgatcgccgtagagcctgggaaaaaccccaagaatgtccaaacagctccaggaacttttaagacccccgaaggtgaggtgggcgccattgcactggatttcaaacctgggacgtccggatctccaatcgttaacagggaaggcaagatagtgggtctttacgggaatggagtcgtgacaacttcgggcacctatgttagcgctatcgcccaggcgaaagcctcacaggagggccccctgcctgagattgaagacgaggtgtttcgaaagcggaacttgacaatcatggatctacatccggggtccggaaaaacccgcagatacctgccagcaattgtcagggaagctatcaagcggaagctccgaactttaatactggcccccaccagagtggtagctagtgagatggcagaagcccttaaaggtatgcctattcgctatcaaacaacggccgtgaagtctgagcacactggcaaagagatcgttgacctgatgtgccatgctaccttcacaatgaggctcttgagcccagtccgtgtgcccaattacaacatgatcattatggatgaagcgcactttaccgacccttcctcaatcgcagcccgggggtatatatctactagagtgggaatgggcgaggctgccgcaattttcatgacagccaccccgcccggtagcgtcgaggcttttccacagagtaatgcggccatccaggatgaagaaagggacattcctgagcgctcctggaacagcgggtacgagtggatcacggatttccccggaaagactgtatggtttgtgccatctataaaatcaggcaatgacattgcaaactgtctgcgaaagaatggcaagagagttatccagctctcccggaaaacattcgataccgaatatcaaaagaccaaaaacaacgactgggactacgtggtcactacagatatcagtgagatgggggctaatttcagggccgaccgcgtgattgatcctcgtagatgcctgaagcccgttatccttaaagacggaccagaacgggtgattctagcaggtccgatgcctgtcaccgtggccagcgctgcccagaggcgcggccgaatagggagaaaccataataaggagggagatcagtacatctatatgggccagcccctgaacaatgacgaggatcacgcgcactggacagaagcaaagatgttgttagacaacattaatactccagagggtatcatccccgccctgtttgaacctgagcgggaaaaatcggctgccattgatggggagtacaggctccgcggcgaggctagaaagacgttcgtagaactgatgaggcggggagaccttccagtgtggctgtcttataaagttgcatccgagggctttcaatacagcgatcgtcgctggtgcttcgacggggaacgaaacaatcaggtcctcgaggaaaacatggatgtggagatatggaccaaggagggagaaaggaagaagttgaggccccggtggctggacgcccgcacatattcagaccctctagctctgagagagtttaaagagttcgccgcaggtaggcggagtgtgtctggcgatctcatccttgagattgggaagctgccgcagcatttaactcagcgagcgcaaaatgccttggacaacctggtcatgctccacaattccgaacagggaggcagagcttaccgccatgccatggaggagctgccagataccatcgaaacacttatgctgctcgcattgattgctgttctgaccggtggggtgactttatttttcctaagcggcaggggactgggcaagacgtcaatcgggctcctttgtgtaatggccagtagcgtgctgttgtggatggcatccgtcgagccccactggatagccgcttctatcattctggaatttttcctcatggtgctgcttatccctgagcccgaccggcagcgtaccccacaggataaccaactcgcgtatgttgtgattggactgttgtttatgatcctgacagtcgccgcaaatgagatgggtttactagaaactaccaaaaaggacctgggcatagggcacgtagctgtggagaaccatcaccatgccgccatgctcgatgttgaccttcaccctgcaagcgcttggacactgtacgccgtggcgaccactattatcacacccatgatgagacatacgattgaaaacaccactgctaatatctccttgacagccatagcaaaccaggccgctatcctgatgggactcgataaaggctggccaatttcaaagatggacatcggtgtccctctgcttgcattagggtgctactctcaggtgaatccgctgaccctcaccgccgcggtcttgatgctggtggctcactatgccattatcggccccggactacaagcaaaagccacaagggaggctcagaagcgcactgccgcaggcataatgaagaacccaacggttgatgggattgtggctatcgacctggatcctgtagtgtacgacgccaaattcgaaaagcagctcggacagatcatgcttctgattttgtgtaccagtcaaatcctgctcatgcggacaacttgggcgctgtgcgagtcgataaccttagccacaggcccccttaccactctgtgggagggtagcccagggaaattttggaatacgacaattgcagtctccatggctaacatcttccgaggatcttatctcgccggcgcaggtctagctttctcactgatgaaaagcctaggcgggggaagaaggggcaccggggcccagggagaaactctgggcgagaaatggaagcgccagctcaatcagctttccaagagtgaatttaacacctacaaacggtctggtattatggaggttgacagaagcgaagccaaggaggggctgaaacgtggagagacaactaagcacgcggtgtcaaggggcaccgctaaattgcggtggttcgtcgaacgcaatctggtgaagcctgagggtaaggtaatcgatctcggctgtgggcgaggaggctggtcctattactgcgcagggttgaaaaaggtgacagaagttaaaggatatacgaagggcggtcccgggcatgaggaaccgataccaatggccacctacggatggaacctggtgaaacttcacagtggcaaggacgtctttttcatccctcccgagaaatgtgatactctgctatgcgacattggcgagagctctccaaatcccacaatcgaagaggggagaaccctcagggtgctgaagatggtcgaaccttggttgcggggaaaccaattttgtattaagatcctgaatccgtacatgccctccgtggttgagactctcgagcagatgcagcgcaaacatggtggcatgcttgtaagaaacccactgtcaaggaatagcacacacgaaatgtattgggtgtcgtgcgggaccggaaacattgtctctgctgtgaatatgacgagtcgaatgttactgaaccggttcaccatggcccaccgtaagcctacatacgagagagatgttgacttgggcgcaggtactcgccatgtggccgtcgaacccgaggtggctaacctcgatatcatagggcagaggattgaaaatatcaaacacgagcataagtccacctggcactatgacgaggataacccttacaaaacatgggcgtatcatggaagctacgaagtaaagccatcaggctccgcctctagcatggtgaatggcgttgtcaagctgctaactaaaccctgggacgtgatccctatggtgacccaaattgcaatgacagataccactccatttgggcagcagcgggtcttcaaggagaaagttgacacgagaacacccaaggctaaacgcggaaccgcccaaataatggaagtgactgcaaggtggctttggggttttctgagtcgaaacaagaagccgcggatctgtaccagagaggagttcacaaggaaagtacgctccaatgccgctattggcgccgtgtttgtcgacgagaaccagtggaatagcgcgaaggaggcagtggaagatgagcgtttctgggacctcgttcaccgggaaagagagctgcacaaacaggggaagtgcgccacgtgcgtgtataacatgatgggaaaaagggaaaagaagttgggcgagtttggtaaagctaaggggtctcgcgccatctggtacatgtggctgggagcacgattcctcgagttcgaagctcttggctttatgaatgaggatcattggttctcacgggaaaacagtctgtccggcgtcgagggggagggattacacaaactgggttacattttgagagacatcagcaagatacctggcgggaatatgtatgccgatgacaccgctggatgggatactaggatcacagaagacgatctccagaacgaggccaaaattaccgacatcatggaaccagagcatgcactgctagcgaaggccatttttaaacttacttaccaaaataaggtggtacgcgttcagagacccgctaagaacggcacagtgatggatgtcatctctcggagggaccagcgtggttcgggacaggtgggaacctatggcctgaatacattcactaacatggaagcccaactcatacgacagatggagtcagagggcatttttagcccttccgaactggagaccccaaacttggcagaacgcgtgttagattggctggagaaatacggggtcgaaagactcaagcggatggctatcagtggagacgactgtgttgtgaaacccatcgatgacaggttcgccacggcacttaccgccctgaatgatatgggtaaggtacgcaaagacattccgcagtgggagccttctaagggctggaacgattggcagcaagtgcccttttgcagccaccacttccatcagctaataatgaaggacgggagagagatcgtcgtgccatgtcggaatcaggatgaactggttggaagggcgcgagtgtcccagggcgctggttggtcactccgtgagacagcctgcttggggaaaagttatgcacaaatgtggcagctgatgtactttcacagacgcgaccttcggctggccgctaacgccatttgttctgcagtccctgtggattgggtacccactagcaggaccacatggtccatccatgctcaccatcagtggatgactaccgaagacatgctctcagtttggaatagagtgtggattgaggaaaacccatggatggaggataagacgcacatcagctcttgggaggacgtcccctatttaggaaaacgcgaagaccaatggtgcggctccctgataggcttgacagcccgggcgacctgggctactaatatccaggtggccattaaccaggttaggcgactgatcgggaatgagaactacctcgattacatgacaagtatgaagagattcaaaaatgaaagcgaccctgagggagcactttggtga

SEQ ID NO: 14234 - RNA, 9879 nt, synthetic construct
  misc_feature 1..9879: note = derived and/or modified CDS sequence (opt3) from DENV-1__AY835999__SS-prME
  source 1..9879: mol_type = other RNA
agcgtgaccatgctgctcatgcttatgcccacagccctggctttccacttgactacgagaggaggggagcctcatatgatcgtctccaagcaggaaaggggaaaatctttactgtttaagacctcagccggtgttaacatgtgcacactaattgccatggacctcggcgagctgtgtgaagatactatgacctacaaatgcccacggataacagaggcggaaccggacgatgtggactgttggtgcaatgctaccgatacttgggtgacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcctgacttgcgctaagtttaagtgcgtaaccaaattagaggggaagatagtgcagtacgaaaacctgaaatattcagtcattgtgacagttcacaccggagaccagcatcaagtgggtaatgagagtactgaacacggcacgacagccaccatcactccccaggcgcctaccacagagattcagctcaccgactacggggcccttactctggattgtagcccaaggacaggattggacttcaacgaaatggtcctactgacgatgaaggagaaatcttggctcgtgcataagcagtggtttctggatcttccgctgccctggacctccggcgcatcaactagccaagagacatggaatcggcaggacttgctcgtaaccttcaaaacagctcacgccaagaagcaggaagttgtggtcctgggtagtcaagagggggctatgcacactgccttaaccggcgcaacggaaatccagacctctggaacaactaccatctttgccggccatctgaaatgccgtctaaagatggataaactcacactgaaggggatgtcctatgtgatgtgtactggtagcttcaaacttgagaaggaagtcgctgagacccagcacggtacggtgttggttcagattaagtacgagggcacagacgcgccttgcaaaataccattcctgacccaagatgaaaagggggtgactcagaacggacgcctcatcacagcaaatcccattgtaaccgacaaagagaagcctgtcaacatcgaagccgagccaccctttggcgagtcgtatatagtgattggtgctggggaaaaagccctgaaactttcttggttcaagaaaggctcctcaatcggaaagatgtttgaggcaactgccagaggcgctaggcggatggccatcctgggggataccgcatgggacttcggaagtgttggtggcgtgtttacaagcgtcgggaaattggtgcatcagattttcggaacggcgtacggcgtactcttttccggtgtgtcttggaccatgaagctggggatcggcgttttactgacttggctaggactcaatagccgatcaacaagtctgtccatgacctgtattgctgtcggccttgtgacattgtacctgggggtgatggtccaggccgatagcggatgcgttataaactggaaaggccgcgaactcaagtgtggttctgggatcttcgtgactaatgaggtgcacacctggacggaacaatataagtttcaggcagactcaccgaaaagactgagtgccgctattggaaaggcctgggaggagggcgtatgcggtatcaggagcgcaacacggttagaaaacatcatgtggaaacagatttccaacgagctgaatcatatacttttggaaaacgacatgaagttcaccgtcgtggttggcgatgtggctgggatcctcgtccagggcaagaagatgattcgccctcaacccatggagtacaaatattcttggaagtcgtggggcaaggccaaaatcattggggcggacgtgcagaatagcacttttatcatagatggaccaaacacccctgaatgtcccgacgatcagagagcctggaatatctgggaggttgaggactacggcttcggtatttttacaactaacatctggctgaagctaagggattcctatacccaggtgtgcgaccaccgtctgatgtcagctgcaattaaagatagtaaggccgtacacgctgacatggggtactggatcgaatctgagaaaaatgaaacatggaagctcgcccgggcatccttcatagaggtcaagacgtgtatttggccaaaatcccataccctgtggtcaaacggagtgcttgaaagcgagatgatcattcccaagatctatggcggtcctatatctcaacacaattaccgaccaggctacttcactcagacagcggggccgtggcatttgggaaaactggagttagattttgacctctgcgaaggcaccactgtggtcgttgatgagcactgcgggaacagaggaccctccctgaggacaaccacggtgactggcaagatcattcacgaatggtgttgccgcagttgtacccttcctccactgcggttcagaggtgagaatgggtgctggtatggaatggagatcaggcccgtaaaagaaaaggaggaaaacttggtaaagagcatggtctctgccggctccggtgaggtggactcatttagtctcggcctgctatgtattagcatcatgatagaagaggttatgcgctcgcgatggtcccggaaaatgctgatgacagggattctcgctgtgttctttctgcttatcatgggacagttgacctggaatgacctgatccgtttatgcattatggtcggcgccaacgcatctgatagaatggggatgggaactacatacctcgctctgatggccaccttcaagatgaggcctatgtttgcagtgggccttctgttccgccggctaacaagcagagaggttctcctgttgactatcggtctgtcattagtggccagtgtcgaactcccaaattccctggaggaacttggggacggactggctatgggcattatgatattgaaactcctgaccgattttcaatctcatcagctatgggcgacgctgcttagcctcacattcatcaagaccactttttccctgcactatgcctggaaaaccatggcaatggtattgtcaattgtgagcctgttccccttatgtctcagtacaacttctcagaagaccacgtggctgccggttcttctgggctccttggggtgcaagcctctcacaatgtttctgatcgctgagaacaaaatttggggaagaaagagctggccactaaacgaaggtatcatggccgtgggcatagtctcgatcctgctttcatctctcctgaaaaatgacgtgcccttggccgggcctttaattgctggaggcatgctgatcgcatgttacgtaattagtggttccagcgccgatctctctctggagaaggcggctgaggtgagctgggaagaggaagccgagcattccggggcatcacacaacatccttgtcgaagttcaggacgatggaaccatgaaaataaaggacgaggagcgagatgacactctgacaattttgctaaaagccaccctgctcgctgtgagtggcgtgtatcccctgagcatcccagcaactcttttcgtctggtacttctggcaaaagaagaaacagcgctctggcgtgttatgggatacaccttcacccccagaagttgagcgggccgtactggacgatgggatctatagaattatgcagaggggactcttgggtcgtagccaggtgggcgtcggggtgtttcaagaaaatgttttccataccatgtggcacgtgacgcgcggagcggtcctgatgtaccagggcaagcggctcgagccgagttgggctagcgtgaaaaaggacctgatatcctacggtgggggatggagacttcagggctcttggaacactggcgaggaagtacaggtcatcgccgtggagcctgggaaaaatcccaagaacgttcaaaccgcaccaggaacatttaagacccccgaaggtgaggtgggcgccattgctctggacttcaaacctgggacatcgggaagcccaatcgtcaatagggaaggcaagattgtgggtttgtatgggaacggagttgtgactacctcaggcacgtacgtctccgccatcgcacagacaaaagctagtcaggagggccccctacctgagatagaagatgaggtgtttcgaaagcggaatctgactatcatggacctccacccggggtctggaaaaacccgcagatatttaccagccattgtaagggaagcgatcaagcggaagctgcgaacacttattctggcccccaccagagtggttgcaagcgagatggctgaagccctcaaaggtatgcctatccgctaccaaactaccgctgtcaagtccgagcatacaggcaaagagatagtggatttgatgtgccacgcaacgttcactatgaggctgctctcaccagtgcgtgtccccaactataatatgattatcatggacgaagcccattttaccgatccttctagcatcgccgctcgggggtacattagtacaagagtaggaatgggcgaggcggcagccatcttcatgaccgctactccgcccggttccatggaagcctttccacagagcaacgcagtgatacaggacgaggaaagggatattcctgagcgctcttggaactcagggtatgagtggatcacagacttccccggaaagaccgtttggtttgtgccatccattaaagccggcaacgatatcgctaattgtctgcgaaagaacggcaagagagtcatacagcttagtcggaaaacgttcgacactgaataccaaaagaccaaaaataatgattgggactacgtggttaccaccgacattagcgagatgggggcgaacttcagggccgatcgcgtgatcgaccctcgtagatgcctaaagcccgtcatcctgaaagatggaccagaacgggtgattttggcaggtccgatgcctgtaactgtggcttcggccgcacagaggcgcggccgaatcgggagaaatcacaacaaggagggagaccagtatatttacatgggccagcccttaaataacgatgaggaccatgcccactggacagaagctaagatgctgctcgataatataaacaccccagagggtatcattcccgccctgtttgaacctgagcgggaaaaatctgcggcaatcgacggggagtataggcttcgcggcgaggccagaaagacattcgttgaactgatgaggcggggagatctcccagtctggttgtcctacaaagtggctagcgagggctttcaatattcagaccgtcgctggtgcttcgatggggaacgaaataaccaggtgctggaggaaaatatggacgtcgagatctggactaaggagggagaaaggaaaaagctaaggccccggtggctggatgcccgcacgtacagtgaccctctcgctcttagagagtttaaagagttcgcagccggtaggcggtctgtttccggcgacctgattttagagatagggaagttgccgcagcacctgacccagcgagctcaaaacgccctcgataatctggtgatgcttcataacagcgaacagggaggcagagcatatcgccacgcgatggaggagctgccagacacaatcgaaactctcatgttgctggccttaattgctgtactaaccggtggggtgacactgtttttcctctcaggcaagggacttggcaaaaccagtatcgggctgttgtgtgtcatggccagctccgtgctgctctggatggcatctgttgagccccattggattgctgccagcatcatactggaatttttccttatggtgctcctgatccctgagcccgataggcagcggactccacaggacaatcaattggcatacgtcgtaattggactgttatttatgatcctaacggtggccgctaacgagatgggtctgctcgaaaccacaaagaaagatcttggcattgggcacgttgcggtggagaaccaccatcacgccgcaatgctggacgtcgatttgcatcctgcttccgcctggactctgtacgccgtggcaaccacaatcataacccccatgatgcgtcacactattgaaaatacaacggctaacatctcactcaccgccattgcgaatcaggctgccatcctgatgggacttgacaagggctggccaatatctaaaatggatatcggtgtccctttactggcactcgggtgctatagtcaggtgaacccgttgactctgacagccgctctactgatgctcgttgcacattacgccattatcggccccggacttcaagcgaaggctaccagagaggcccagaagaggaccgcagccggcattatgaaaaatccaacaatcgacgggatagtggctattgatctggaccctgtagtgtatgatgccaagttcgaaaaacagttgggacagatcatgctgctcatcctgtgtacttcgcaaattttacttatgcgcacgacctgggcactgtgcgagagcatcacactcgctactggccccctaaccacactgtgggagggttccccagggaagttttggaacaccactatagccgtctctatggcgaatattttccggggatcatacttggccggcgcaggtctggctttcagcctcatgaaatcccttggcgggggacgaagaggcacgggggcccagggagaaacactgggcgagaagtggaagaggcagttgaaccagctgagtaaatctgaatttaatacctataagcgcagcggtatcatggaggttgaccggtcagaagcaaaagaggggctcaagagaggagagactaccaaacacgctgtgtcccgtggcacagccaagttaaggtggttcgtcgaacggaacctggtgaagcctgagggtaaagtaattgaccttggctgtgggcgcggaggctggagttactattgcgccgggctgaagaaagtgactgaagttaagggatacaccaaaggcggtcccgggcacgaggaaccgatcccaatggcgacatacggatggaatctagtgaagctccatagcggcaaagatgtctttttcatacctcccgagaagtgtgacacgctgttgtgcgatatcggcgagtcttccccaaaccccaccattgaagaggggcgaactctgagagtgctcaagatggtcgaaccttggcttaggggaaatcaattttgtatcaaaattctgaacccgtatatgccctcagtggttgagacattagagcagatgcagcggaagcacggtggcatgctggtacgcaatccattgagcagaaactcgacccatgaaatgtactgggtgtcttgcgggactggaaatatcgtcagtgctgtgaacatgacatccaggatgctcctgaaccgattcaccatggcacaccggaaacctacgtatgagcgtgacgttgatctaggcgccggtaccagacacgtggctgtcgaacccgaggtggccaatcttgacattatcgggcagcgcatagaaaacattaagcatgagcacaaaagcacatggcattacgatgaggacaatccttataagacttgggcataccacggatcatatgaagtaaagccatccggctctgccagcagtatggtgaacggcgttgtcaaactgctcaccaagccctgggatgtgatccctatggtgacacaaatcgctatgactgacaccacaccatttgggcagcagagggtcttcaaagagaaggttgatacccggactcccaaagcgaagagaggaacggcccaaattatggaagtgacagcacgctggctgtggggatttttgtccaggaataagaaaccgcgaatatgtacccgggaggagttcactagaaaggtaaggagcaacgctgccatcggcgcagtgtttgtcgacgagaatcagtggaactctgccaaagaggctgtggaagacgatcgcttctgggacctggttcatcgtgagcgggaactccacaagcaggggaaatgcgcaacatgcgtgtacaatatgatgggaaagagagagaagaaacttggcgaatttggtaaggcgaaagggtcaagggcaatttggtacatgtggctgggagcccgcttcttagagttcgaggctctgggctttatgaacgaagatcactggttcagtcgagaaaattccttgagcggcgtcgaaggggagggactccataagctgggttatatcctacgggacatttctaaaatccctggcgggaacatgtacgccgatgacacagcaggatgggatacgagaataaccgaggacgatcttcagaatgaagctaagatcactgacattatggagccagaacacgcccaactggctaaatcgatctttaagctcacatatcagaacaaggtggtaagggttcagcgccccgccaaaaatggcaccgtgatggatgtcatttcaagacgggaccagaggggtagcgggcaagtgggaacttacggcctgaacacattcaccaacatggaggcacagttgatccgtcagatggaatccgagggcatatttagtcctaatgagttagaaacaccaaacctggcggagcgagtgctcgattggcttgaaaagtatggggtcgagcgcctgaaaagaatggccatttctggagacgactgtgttgtgaagcccatcgatgaccggttcgctactgccctaaccgcactgaatgatatgggtaaagtaaggaaggacatcccgcagtgggaacctagcaagggctggaacgattggcaacaggtgcccttttgctcccatcacttccaccagctcattatgaaagacgggcgcgagatagtcgtgccatgtagaaatcaggatgagttggttggacgggctagggtgtcacaaggcgccggttggagtctgcgagaaacggcatgccttgggaagtcttacgcccagatgtggcagctgatgtattttcatcgtagagacctccgcttagcggctaacgccatctgtagcgcagtccctgtggattgggtacccacctcccggacaacttggtcaattcacgcccatcaccaatggatgaccacagaggacatgctgagcgtttggaatagggtgtggatcgaagagaacccatggatggaagataaaactagaatttcttcctgggaggacgtcccctacttgggaaagcgcgaggaccagtggtgcggcagtctgatcggcctcaccgctcgggccacgtgggcaacaaatatacaggtggctatcaaccaggttaggcgacttattgggaatgaaaactacagcgattatatgacctcgatgaaaagattcaagaatgagtccgaacctgagggagccctgtggtga

SEQ ID NO: 14235 - RNA, 9879 nt, synthetic construct
  misc_feature 1..9879: note = derived and/or modified CDS sequence (opt3) from DENV-1__KP686070__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaagggggtgtcttatgtcatgtgtacaggatccttcaaattggagaaggaagtggctgagactcagcacggtaccgttctggtgcaggtaaagtacgagggcacggatgcgccttgcaaaataccaatcagcacacaagacgaaaagggggtcacccagaacggacgcctcattactgcaaatcccatcgtgacagataaagagaagcctgttaacatagaaaccgagccacccttcggcgagtcgtatattgtgatcggtgccggggaaaaagctctgaagctttcttggtttaagaaaggctcctcaatcggaaagatgttcgaggccactgcaagaggcgccaggcggatggctattctgggggacaccgcctgggattttggaagtatcggtggcgtcttcacaagcgtggggaaattggtacatcaggtgtttggaacggcatacggcgttctcttctccggtgtctcttggaccatgaagattgggataggcatcctgttaacttggctgggactaaatagccgatcaacaagtctctccatgacctgtattgcggtgggcatggtgacactgtaccttggggtcatggttcaggctgacagcggatgcgtgatcaactggaaaggccgcgaattgaagtgtggttctgggatctttgtgactaacgaggtacacacctggacggaacaatataagttccaggccgattcaccgaaaagactgagtgcagccattggaaaggcttgggaggagggcgtctgcggtataaggagcgccacacggctcgaaaatatcatgtggaaacagatttccaacgagctgaatcatatcttactggaaaacgacatgaagtttaccgtggttgtgggcgacgcaaatgggattcttactcagggaaaaaagatgatccgccctcaacccatggagcacaaatactcttggaagtcgtggggcaaggctaaaataatcggggccgatacccagaacacaactttcattatcgacggaccagatacccctgaatgtcccgacgatcagagagcgtggaatatttgggaggtcgaggactatggctttggtgtgttcacaacgaacatctggttgaagctcagggatagctacacccagatgtgcgaccaccgtctgatgtccgccgctataaaagattcaaaggcagttcatgccgacatggggtattggattgaaagtgagaaaaatgaaacttggaagctagctcgggcctcttttatcgaggtgaagacatgtatttggccacgaagccacaccctgtggtccaacggagtactcgaatcagagatgatcatacccaaaatctacggcggtcctattagccaacataattatagaccaggctacttcactcagacagcagggccgtggcacctgggaaagcttgagttggatttcaacctgtgcgaaggcaccacggtcgtggtggacgagcactgcgggaataggggaccctctttacgcactaccacagtcaccggcaaaatcattcatgaatggtgttgccggtcctgtactctccctccactgagatttaggggtgaggatgggtgctggtacggaatggagatccgccccgttaaggaaaaagaggaaaaccttgtgcgaagtatggtaagcgcgggctctggtgaggtggactccttctcactgggcttgctctgtgtcagtataatgattgaagaggtgatgcggagccgttggtcgagaaagatgctgatgacagggaccctagccgtttttttcctgctcatcatgggacagctgacatggaatgaccttatcaggttgtgcattatggtgggcgctaacgtctccgatcgcatggggatgggaactacctatctggccttaatggcaacgtttaagatgcggcctatgttcgctgtgggcctcctgtttagaaggcttacatctcgagaggttctgctactcaccatcggtctgagcttggtggcctcagtcgaactgccaaacagtttagaggaactcggggacggactggcaatgggcattatgatgcttaaactgttgactgatttccaatcccaccagctctggaccacactgctatctctgacttttataaagaccacgcttagcctcgactacgcctggaaaacaatggctatggtactgtccatcgtgtcattgttccccctgtgtttaagcaccactagtcagaagacaacctggctcccggttctgcttggctcttttgggtgcaaacctctgactatgttcttgattacagagaataagatctggggacgcaagtcctggccactcaacgaaggtattatggcggtgggcatcgtcagcatactgctatcgtcactgcttaaaaatgatgtgcccctcgccgggcctctgatcgcaggaggcatgttgattgcttgttatgtaatctctggtagttccgccgacttaagcctggagcgggccgctgaggtgtcttgggaagaggaagcagagcatagcggggcctcccacaacattctcgtcgaagttcaggatgacggaaccatgaagatcaaagatgaggagagagacgatacgctgactatacttctgaaggcgaccttgctagctgtgtcaggcgtgtaccccatgagtattccagccacactgtttgtctggtatttctggcaaaaaaagaaacagaggagcggcgtgctctgggacaccccttctcccccagaagttgagcgtgcagtactggatgacgggatctaccgcatccttcagcggggattactgggtagatcccaggtgggcgtcggggtgttccaagacggagtttttcatacaatgtggcacgtgactaggggcgccgtcctcatgtatcagggtaagcgattggaaccgtcatgggctagtgtgaagaaagatctgattagctacgggggaggctggcggttccagggctcctggaataccggggaggaggtacaggtcatagcagtggaacctggaaagaaccccaaaaatgttcaaacgacaccaggtacttttaagacccccgagggcgaagtgggggccatcgcgctcgacttcaaacctggaacatctggctcgccaattgtcaaccgcgagggtaagatcgtggggctgtacggaaatggcgttgtgaccactagcggcacctatgtctcagctattgcccaggcaaaggcctcccaggaagggccccttcctgagatcgaggatgaagtgtttaaaaagagaaacctgacaataatggacttgcacccgggaagtggtaaaacgaggcggtacctaccagctatcgtacgagaggccattaagagaaaactgcgcactctcatcttagcacccaccagggtggttgcttctgaaatggccgaggcgctgaagggcatgcctattcgttatcaaacaaccgccgtcaagagcgaacatactgggaaagagatcgtggatcttatgtgccacgcaacattcaccatgcggctgctctccccagtgagagtccccaattacaacatgataattatggacgaggctcattttacggatcctgcctcaatcgctgcaaggggatatatctctactcgcgtaggcatgggtgaagccgccgctattttcatgacagcgaccccgcccgggagcgtggaggcatttccacagagtaatgccgttatccaggacgaagagcgagatatacctgaaagatcctggaacagcggatacgactggattaccgatttccccggcaagactgtgtggtttgtcccatctatcaaatcaggcaatgacattgctaactgtttgcggaagaacgggaaaagggtgatccagctgtcccgcaagacattcgacaccgagtatcaaaagacaaaaaataacgattgggactacgttgtgactacggatataagtgagatgggagccaatttccgtgcagacagagtcattgatcctcggaggtgcctcaagcccgtgatcctgaaagacggtccagaacgcgtaatccttgccggcccgatgcctgtgaccgctgcgagcgccgcacagcgaagagggcggattggaaggaaccagaataaggagggcgatcagtacatctatatgggtcaacccctaaacaatgacgaagatcacgctcattggacagaggccaaaatgctgttggacaacattaatactccagaggggataatccccgcattatttgaacctgagcgcgaaaagtcggccgctattgatggcgagtacagactgaggggagaagcccggaagaccttcgttgagctcatgcgtcgcggcgacctgccagtctggctttcttataaagtggcgtccgaggggtttcagtacagcgatcgaagatggtgcttcgacggagaaaggaacaatcaggtgctggaggaaaacatggacgtcgagatctggacaaaggaaggtgagcggaaaaagctccgccccagatggttggatgcaaggacctattcagaccctctggccctacgggagtttaaagaattcgctgccggccgaagaagtgtttctggggatctgatcctcgagattggaaagcttccgcagcacctgactttacgcgctcaaaatgcattggacaacctggtgatgctccacaattccgaacagggcggtaaagcctacaggcatgctatggaggaactgccagatacgatagagacccttatgctgctcgccttgatcgcagtactgacagggggcgtgactttatttttcctaagcggaaagggcctggggaagacctcaattggactcctttgtgtcatggcgagtagcgtgctgttgtggatggcctccgttgagccccactggatcgctgcctctattatcctggaatttttcctcatggtgctgcttatacctgagcccgaccggcagcgtacaccacaggataaccaactcgcatatgtcgtaatcggtctgttgtttatgattctgaccgtggctgccaacgaaatgggcttactagagactacaaaaaaggacctggggatcggacatgttgtggcagagaatcaccaccatgccacgatgctcgatattgaccttcaccctgctagcgcgtggaccctgtacgccgtcgcaactacaatcataacccccatgatgagacataccattgaaaacacaactgctaatatctccttgacggccattgccaaccaggcagctatcctgatgggcctcgataaaggttggccaatatcaaagatggacatcggggtgcctctgcttgccttaggctgctactctcaggtcaatccgctgaccctcacagcggctgtgagtatgttggttgcccactatgcaattatcggacccggcctgcaagccaaagctactagggaggcacagaagcgcaccgccgcggggattatgaagaacccaacagtggatggaatcgtagctatagacctagaccctgtggtctacgatgccaaattcgaaaagcagctgggccagattatgctccttatcctgtgtacctcgcaaatcttgctgatgcggactacgtgggcactctgcgagagcattacactggccaccggtcccttaactaccctttgggaagggtccccaggaaaattttggaatacaactatcgctgtttctatggccaacatattccgaggctcatatctggcaggtgctggcctcgccttcagcctaatgaagtccctggggggaggcagaagggggaccggagcgcagggcgagacattgggtgagaaatggaagcgccagctgaatcagctcagtaagtctgaatttaacacgtacaaacggagcgggattatggaggtggacagatcagaagccaaggagggacttaaacgtggcgaaaccactaagcatgcagtctccaggggtacagctaaactgcggtggttcgtggagcgcaatttggtaaagcctgagggcaaggtgatcgatctggggtgtggacgaggcgggtggagttattactgcgccggactcaaaaaggttaccgaagtgaaaggctatactaagggtgggcccggacacgaggaaccgattccaatggcaacatacggctggaacatcgtcaaattacacagcggcagagacgtgtttttcacccctcccgagaagtgtgatacgctgctttgcgacataggggaatcttccccaaatcccaccatcgaggagggaaggacactgcgggtcctaaaaatggtggaaccttggctccgcggtaaccaattttgtattaagatcctgaatccgtacatgccctcagttgtagagactttggaacagatgcagagaaagcatggcgggatgctggtgaggaacccactcagccgaaattcgacccacgagatgtattgggtctcttgcggaacaggcaacattgtgagtgctgttaacatgacttcccggatgcttctgaatcgtttcaccatggcccatagaaaacctacatacgagcgcgatgtggacttaggtgccgggaccaggcacgtcgcggtggaacccgagatcgctaacctggatattatcggacagcggatagaaaatattaagaacgagcacaaaagcacttggcattatgacgaagataatccttacaagacgtgggcatatcacggctcatacgaggtaaaaccatccggctctgccagcagtatggtgaacggggttgtcagattgctcacaaagccctgggacgtgatccctatggtgacccaaatcgctatgactgacaccacaccatttggacagcagcgcgtcttcaaggagaaagttgatacgaggaccccccgaccgaagcggggtactgcccaaattatggaagtgacagcaaaatggctgtggggctttctatccagaaataagaaacctaggatatgtacccgcgaggaattcactcgtaaggtacggagcaacgccgctatcggggcggtgtttgtcgacgagaatcagtggaactctgccaaggaagcagtggaggatgagagattctgggaccttgttcatagggaacgcgagctgcacaaacagggaaagtgcgctacatgcgtgtataatatgatgggcaaacgagaaaagaaactcggtgagtttgggaaggccaagggatcacgggcaatttggtacatgtggctgggcgccagattcttggaattcgaggctctgggctttatgaacgaggatcattggttcagtagggaaaattccctcagcggggtcgagggagaaggtcttcacaaactgggctacatcttacgcgacatttctaagatcccagggggaaacatgtatgccgatgacaccgcgggctgggatacaagaataactgaggacgatctgcagaatgaggcaaaaatcaccgacattatggaacccgagcacgccttgctcgctacgtcgatctttaagctgacctaccaaaacaaagtggtacgggttcagaggcctgccaagtcaggtacagtgatggatgtcattagccgtcgagaccagcgcgggtccggacaggtgggcacttatggcctaaacaccttcacaaatatggaagtgcaacttatcagacagatggagagtgaagggatattttctccaagcgagctggagaactccaatctcgcagaacgggtcctggactggttggagaaacatggagttgaaaggttaaagcgcatggctatttcaggtgatgactgtgtggtaaagcccactgatgacagattcgccaccgctctgacggccctcaacgatatgggcaaagtgcggaaggacatcccgcagtgggagcctagtaaagggtggaatgattggcagcaagtccccttttgctctcaccatttccaccagcttatcatgaaggacggaagggaaattgtggttccatgtcgaaaccaggatgagctggtgggccgtgcaagagtcagccagggtgcggggtggtccctacgcgagacagcctgcctgggaaaatcatacgctcaaatgtggcagctcatgtattttcaccggagggacttgagactggccgcaaatgctatatgtagcgccgtgcctgtaaactgggttcccacctctcgcactacatggtccatccatgcacaccatcagtggatgaccactgaagatatgcttagtgtgtggaatcgggtctggattgaggaaaacccatggatggaggacaagacccacgtgagctcgtgggaagacgttccctacctgggcaagagggaggatcaatggtgcggctccctcatcgggttaacagcccgagcgacgtgggctaccaatattcaggtggccatcaaccaggtcagacggctgataggaaatgagaactatttggactacatgacttctatgaaaaggttcaagaatgaatcagatcctgagggtgcactgtggtga

SEQ ID NO: 14236 - RNA, 9876 nt, synthetic construct
  misc_feature 1..9876: note = derived and/or modified CDS sequence (opt3) from DENV-1__KF672760__SS-prME
  source 1..9876: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagagaagcgtagcgtggccctggcaccccatgtcggcttgggtctcgaaactagaaccgagacatggatgtcctctgaaggggcctggaaacagatccagagggtggagacttgggctctgcggcaccctggattcaccgttattgcatttttcctggcccatgctatcggcacatcgattacccagaagggcatcatatttatcctcttaatgctggtgacgccatcaatggccatgcgctgcgtcgggattggaaacagagacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgaagtacgaaggcacggacgcgccttgcaaaataccatttagcacacaagatgagaagggggtaacccagaacggacgcctgatcactgcaaatcccattgtcacagacaaagaaaagcctgtgaacatcgagaccgagccacccttcggcgaatcgtatatagttgtgggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtcttcacaagcgtggggaagctggtacatcaggtgtttggaacggcatacggcgttttgttctccggtgtctcttggaccatgaaaattgggatcggcattctcctgacttggttaggactgaatagccgctcaacaagtctatccatgacctgtatagcggtgggcatggtgacactctacctgggggtcatggttcaggctgatagcggatgcgtgatcaactggaagggcagagagcttaaatgtggttctgggatttttgtgactaacgaagtacacacctggacggagcaatataagttccaggccgactcaccgaagaggttgagtgcagccatcggaaaagcttgggaggaaggcgtctgcggtatccggagcgccacacgcctggagaatattatgtggaagcagatatccaacgaactcaatcatatcctgttagagaacgatatgaaatttaccgtggttgtgggcgacgcaaatgggattctggctcagggaaagaaaatgatcagacctcaacccatggaacacaagtactcttggaaatcgtggggcaaggccaagattatcggggcggacatacagaacactaccttcatcattgatggaccagacacacctgagtgtcccgatggccagagggcctggaatatctgggaggtcgaagactatggttttggggtgttcactaccaacatttggcttaaattgcgtgatagctacacacagatgtgcgaccaccggctcatgtccgctgcaatcaaggattcaaaagccgttcatgctgacatgggatattggatagagagtgaaaagaatgagacgtggaaactggcccgagcatctttcattgaagtgaagacctgtacttggccaaagagccacacactatggtccaacggcgtactggagtcagagatgatcattcccaaaatctttggtggccctataagccaacataattacagaccagggtatttcacccagactgcgggaccgtggcacctcggcaagctggaacttgattttgacttgtgcgaggggacaaccgtcgtggtggatgaacactgcggaaacaggggcccctctctgcgcacgactaccgtcacaggtaaaatcattcatgagtggtgttgccggtcctgtaccttacctccactcagattcaggggggaggacggatgctggtacggcatggaaatccgccccgttaaggagaaagaagagaatctggtgcgaagtatggtaagcgccggttctggcgaagtggattccttttcacttgggattctgtgtgtcagtatgatgatcgaggaggtgatgcggagccgttggtcgagaaagatgttgatgactggaacactcgctgttttcctgctactgataatgggccagctcacctggaacgacctgattaggctttgcatcatggtgggggccaatgcatccgaccgcatgggaatgggcacaacttacttggctctgatggccacctttaagatgcggcctatgttcgcagtcggtttactctttagaaggctgacgtctcgagaagtgcttctgctaacaatcgggctcagcctggttgcctgtgtggagttgccaaactcactggaagagttaggagatggcctcgctatgggcattatgatgctgaaacttctgaccgaattccaaccccaccagttgtggactaccctcctgagtctaacatttgtcaagactaccctgtcccttgactatgcgtggaaaacgacagccatggtactctctatcgtgagcctgttcccgttgtgcctgtccaccacttcacagaagacaacctggttacctgttctcctggggagctttggatgtaaaccacttactatgttcctgattacagagaacaagatatggggtcgcaagagttggcccttgaatgagggcatcatggcaattgggatcgtgtctattctcctgtccagcctactgaaaaacgatgtccctcttgctggacccctcatcgccggcggtatgctgatagcctgctacgtgatctcggggtcatctgctgacttgagtttagaaaaggcagccgaggtatcctgggaacaggaggcggaacatagcggagcttctcacaatattctggtggaggtccaagatgacggcaccatgaaaatcaaggatgaggaacgggacgatacgctcactattctgcttaaagccaccctgttggcagttagcggcgtgtatccaatgtccatccctgccacactattcgtgtggtacttttggcagaagaaaaagcagagatcaggggtcctgtgggacacccccagtccaccggaggtggaaagggctgttctcgatgacggaatatatcgtattctgcagcgcggtcttttaggccggagccaagtaggggtgggagtcttccaggatggcgtgtttcatacaatgtggcacgttactagaggtgcagtgctgatgtaccaggggaagaggctcgagccttcttgggcctccgtcaaaaaggacttgatctcatatggaggcggctggcgattccaggggagttggaacaccggagaggaagtgcaagtaatcgcggtcgagcccggtaaaaatccaaagaacgtgcagacgacacccggcacttttaaaacccctgaaggggaggttggagctattgccctggacttcaagccaggcacaagcggttcccccatagtgaatcgggaagggaagatcgtcggactctacggcaacggcgtggttaccacttctgggacctacgtgtcggcaattgcccaggctaaagccagccaagagggacctctgccggagatcgaagatgaggtctttaagaaacgcaatcttacaattatggacctgcacccaggttcaggcaagacgagaaggtatttgcccgcaatcgtgcgggaagctataaaacgaaagctaagaactctgatcctcgcccctacccgcgtagtggcgtccgagatggccgaagcattaaaggggatgccaattaggtaccagacaaccgctgttaaaagtgagcatactggacgtgagatcgtcgatctgatgtgtcacgccacattcaccatgcggcttctgtctcccgtgagagtgcctaactataatatgattatcatggacgaagctcattttacggatccggcaagcatagccgccaggggctacatttccactcgcgtcggtatgggggaggctgcggcaatcttcatgacagccacccccccaggatcagtagaagcttttcctcagtctaacgccgtgatccaggacgaggaacgagatattcccgagagaagctggaatagtggctatgactggatcaccgatttcccaggcaagactgtttggttcgtgccttccataaaaagcgggaacgacattgcaaattgcctccggaagaacggaaaaagggtcatccaattgtctcgcaagacatttgataccgagtaccagaagacaaaaaacaatgactgggactatgtggttactacggatatttcagaaatgggtgccaacttccgtgctgacagagtgatcgatccccggaggtgcctgaagccagtcatactcaaagacggcccggagcgcgtgattctggcggggcctatgcccgtaaccgtggcctccgcagctcagcgaagaggacggatcggcaggaatcagaacaaggaaggtgatcaatacgtttacatggggcagccacttaataacgacgaggatcacgcccattggacagaggcaaaaatgctactggacaatatcaacactcccgaaggcattatccctgccttgtttgagccagaacgcgagaagagtgctgccattgatggagaatatagattaaggggcgaggcgcggaagaccttcgtcgagctgatgcgtcgcggggacctccccgtgtggctgagctacaaagtggcatcggaaggatttcagtattctgatcgaagatggtgtttcgacggtgagaggaataaccaggtccttgaagagaatatggatgttgaaatatggacaaaggagggcgagcggaaaaagctgcgccctagatggctcgacgccaggacctactccgacccgttggctctgcgggaatttaaagagttcgccgctgggcgaagaagcgtgtcaggagatctaatcctggaaattggcaagctcccacaacaccttactctgcgcgcacagaacgccttagacaatttggtaatgctgcacaacagtgagcagggtgggaaagcttataggcatgccatggaagagctccccgatacgatcgagaccctgatgcttctggcactcatcgcggtgttgacaggcggagtcactctgtttttcttatctggcaaggggctaggaaagacctccattggtctgctctgcgtgacagccagctcagctcttctgtggatggccagtgttgaacctcactggatagcagctagcatcattttggagtttttcctgatggtgctcctgatccccgaaccagaccggcagcgtacccctcaagataatcagcttgcctacgtcgtaattggcctcctgtttatgatcttgactgtggcagccaacgagatggggctgttagagacaacgaaaaaggacctaggaataggctatgttgctgcggaaaaccatcagcacgccaccatgctggatgtggacctccaccccgcatccgcttggactctttacgccgtcgccacaaccgtgatcaccccaatgatgagacatacaattgagaatactacggcaaacatctctctgaccgctattgccaatcaagcggctatcttgatgggtctggataaagggtggcctataagcaagatggacattggcgtcccgctcctggcccttggatgttactcccaggtgaaccccttaacactgactgcagccgttctcatgttggtggctcactatgcaatcattggcccagggctgcaggccaaagcgaccagggaagctcagaagcgcacagccgcaggaatcatgaagaatcctaccgtagatggcatagtggccatcgacctagatcccgtcgtttacgacgctaaattcgagaagcaactgggtcagattatgctccttatcctgtgcacttcacagattttgctgatgcggacgacatgggccctctgtgaatctatcaccctggcaactgggccattaaccacactttgggagggaagtcctggcaaattctggaacactaccatagctgtgtcgatggccaatatttttcgaggtagctatctggcgggcgccgggctcgcattctccctaatgaagtctctgggaggcgggagaaggggaacaggcgctcagggtgagacgttgggggaaaaatggaagcgccaactgaaccagctctcaaagagcgagtttaatacctacaaacggtccggaatcatggaagtcgacagaagtgaggccaaggaaggccttaaacgtggtgagactacaaagcatgcagtgtctaggggcaccgctaaactgcggtggttcgtagagcgcaacttggtgaagcccgaagggaaggttatcgatctgggatgcggccgagggggatggagctattactgtgccggcctcaaaaaggtgactgaggtcaaaggttatacaaaggggggaccgggccacgaagagccaattcctatggccacctacggctggaatttagtgaaactgcattcagggaaggacgtctttttcatgcccccagaaaaatgcgatacgcttctgtgtgacatcggagagtccagtcccaaccctaccatagaggaaggtagaacactaagggtgctcaagatggttgagccgtggctgcggggcaatcagttttgcattaagatcttgaacccctacatgccaagcgtagtggaaactctggagcgcatgcagagaaaacacgggggaatgctcgtcaggaatcctctttctcgaaactccacccacgagatgtattgggtgtcatgtggcacaggtaatattgttagcgcggtgaacatgacttcgcggatgctgttaaaccgtttcaccatggctcatagaaagcccacatacgaacgcgatgtcgacctgggggcaggaaccaggcacgtggccgtagagcctgaagtggctaatttggatatcataggccaacggatcgagaacattaaaaatgaacataagtctacttggcactatgacgaggataacccatacaaaacgtgggcctatcacggcagttacgaggttaagccctccgggagcgcatcatccatggtcaatggagtggtgagactcctgacaaagccttgggacgtcatcccaatggttacccagattgccatgactgataccacaccctttggtcagcaacgcgtgttcaaagaaaaggtagacacgaggaccccgcgagctaaacggggcactacacagatcatggaggtgaccgcgaagtggctatgggggtttctttctagaaacaaaaagcctaggatttgcactcgcgaagagttcacacgtaaggtccggagcaatgccgcaatcggagctgtgtttgttgacgaaaaccagtggaatagtgccaaagaggcagtggaggatgaaagattctgggacctggtccatagggagcgcgaactccacaagcagggcaaatgcgccacctgtgtgtataacatgatgggtaagcgagagaaaaagctgggggaattcggaaaggctaaaggctcccgggccatatggtacatgtggttgggcgcgagatttctggagttcgaggcactcgggtttatgaatgaagatcattggttcagcagggagaactctctttcaggagtagaaggtgagggcctgcacaagttagggtacattctgcgcgacatcagtaaaatcccaggaggcaatatgtatgccgatgacacagctggttgggatactagaattaccgaggacgatttgcaaaacgaagccaagataacggacatcatggagcccgaacatgcactcctggctacctccatttttaaactaacataccagaataaggttgtgcgggtccagaggcctgccaaaaacgggactgtgatggatgtgatcagccgtcgagaccagcgcggatctggccaagtcggcacctatgggcttaacacattcactaatatggaggttcagctgattagacagatggaatcggagggaatctttctcccatcagagctggaaacccccaacttggctgagcgggccttagattggctggaaaagcacggtgcagagaggctcaagcgcatggcgataagcggcgacgactgcgtggtaaaaccgatcgatgacagattcgccacggctcttacagccctgaatgatatggggaaggtgcggaaagacattcctcagtgggaaccctccaagggatggaacgattggcaacaggtcccattttgtagtcaccatttccaccagctaatcatgaaagacggcagggagattgtggttccttgccgaaatcaggatgagctggtgggtcgtgcaagagtctctcaaggggctggatggagcctccgcgaaaccgcctgtttgggcaagtcctacgcacagatgtggcagctgatgtattttcatcggagggaccttagactggccgcgaacgctatctgctcagccgtgcccgtagattgggttccagcaagtcgcactacatggtctatacacgcccaccatcaatggatgaccactgaggacatgctcagcgtgtggaatcgggtctggattgaagagaacccctggatggaagataagacccacgtgtcctcatgggaggaggttccttacttaggcaaaagggaagaccagtggtgtgggagcctgatcggattgacagctcgagccacgtgggcaaccaatatccaggtggctattaaccaggtcagacggctgataggtaatgagaactatctcgactacatgacttctatgaagaggttcaaaaatgaatccgatccagagggcgccctttgg

SEQ ID NO: 14237 - RNA, 9876 nt, synthetic construct
  misc_feature 1..9876: note = derived and/or modified CDS sequence (opt3) from DENV-1__KF672759__SS-prME
  source 1..9876: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagttggtgtgaacatgtgcacactcattgcaatggacctgggcgagctttgtgaagatactatgacctacaaatgcccacggataacagaggccgaaccggacgatgtagactgttggtgcaatgcgaccgatacttgggtgacatatgggacctgtagtcaaacgggagagcaccgccgagacaagcgtagcgtcgctctggccccccatgtgggcttgggtctcgagactagaaccgaaacatggatgtcctctgagggggcatggaaacagatccagaaggttgaaacttgggccctgaggcaccctggattcaccgtgattgctctgtttctcgcacatgccatcggcacatcgattacccagaagggcatcatattcatcttactgatgcttgtcacgccatcaatggctatgcggtgcgtggggattggaaaccgcgattttgtagagggtttgagcggcgccacttgggttgacgtggtcctggagcacgggagttgtgtgacaaccatggcgaaaaataagcccactctagatatcgaactcctgaaaacagaggtgaccaaccctgcagtccttagaaagctgtgcattgaagccaaaatctccaatacgaccacagactctaggtgtccaactcaaggagaggctaccttggttgaagagcaggatgccaacttcgtgtgccggcgcacatttgtagaccgaggctggggtaatgggtgtggactcttcggcaagggcagcctgttaacttgcgcaaagtttaaatgcgtgaccaagctggaggggaaaatagtccagtacgaaaacctcaagtattccgtgattgttacagtgcacaccggagatcagcatcaagtcggtaatgagactacggaacacggcacaatcgctaccattactccccaggcccctacctcagagatccagcttacagactacggggcgctgaccttggactgtagtccaagaactggactagatttcaacgaaatggtgctgctcacaatgaaagagaagagctggctggtacataaacagtggtttcttgacctgccgttgccctggacgtctggcgcctccacctcacaagagacttggaataggcaggatctcctggttacattcaagaccgcacacgctaagaaacaggaagtggtcgtgttaggtagccaagagggggccatgcacacagctctgactggcgccaccgaaatccagacgagtggaaccacaactatttttgcaggccatctaaagtgccggctcaaaatggacaagctgacccttaaagggatgtcttatgtcatgtgtacaggatccttcaagttggagaaggaagtggccgagactcagcacggtaccgttctggtgcaggtaaaatacgagggcacggatgctccttgcaagataccattcctcacacaagacgaaaaaggggtcacccagaacggacgtctgatcactgcgaatcccattgtgacagataaggagaaacctgttaacatcgaaaccgagccaccctttggcgagagctatatagtggtcggtgcaggggaaaaggcccttaagctgtcgtggttcaaaaagggctcttccattggaaaaatgtttgaggctactgcccgcggcgcaagaaggatggccatcttgggggacaccgcttgggatttcggatcaatcggtggcctctttacaagtgtggggaagctgattcatcaggtattcggaacggcctacggcgtgttatttagcggtgtttcctggaccatgaaaatcgggattggcatactgctaacttggctcggactgaattctcggagcacatcacttagtatgacctgtatcgcagtcggcatggtgacattgtacctgggggtgatggtccaggcggactccggatgcgttattaactggaagggccgagaactcaagtgtggtagcgggatcttcgtgactaacgaggtgcacacctggacggaacaatataaatttcaggctgattctccgaagcgcctgtcagccgcaatcggaaaagcctgggaggagggcgtatgcggtattagaagtgctacaaggttagaaaatataatgtggaagcagatcagcaacgagctgaattacattcttttggaaaacgacatgaaattcaccgtcgtggttggcgacgtgaatgggatcctcgcccagggaaagaaaatgattcggcctcaacccatggagcataagtattcctggaagtcttggggcaaagcaaagatcataggggctgatatccagaacactacctttattatcgacggaccagatacacctgaatgtcccgacgatcagcgcgcctggaatatttgggaggtcgaggactacggcttcggtatctttactaccaacatatggctgaaactaagagattcgcacacacagatgtgcgaccacaggctgatgagcgcggccattaaggattccaaagctgtgcatgcagacatggggtattggatcgaatcagagaagaatgaaacgtggaagctcgcccgtgctagtttcattgaggttaaaacctgtatctggccaaagtctcacactctgtggagcaacggagtgcttgaatccgagatggtaatacccaaaatctacggcggtcctatttcacaacataattatcggccaggctacttcacacagaccgccgggccgtggcacttgggaaagctggagttagattttgacctctgcgaaggcactacagtcgtggtggatgagcactgcgggtaccgaggacccagcctgagaaccacgactgtcaccggcaaaatcattcatgaatggtgttgcaggtcttgtacacttcctccactgcgcttccggggtgaggacgggtgctggtatggaatggagatcagacccgttaaggaaaaggaggaaaacttggtgaggtccatggtaagtgcaggcagcggtgaggtggactctttttccctcggcatactgtgtgtctcaattctaatcgaagaggtgatgcgcagtcgatggagccggaaaatgctgatgaccgggactctcgcggttttcctgcttttgatcatgggacagctgacatggaatgatttaattcgtctctgcatcatggtgggcgccaacgcttcggacagaatggggatgggaaccacatacctggcccttatggcaacttttaagatgaggcctatgttcgctgtcggcctgctatttcgccggctcacctgtagagaggtgctgttgctgacggttggtttatccctcgtggcctctgtcgaactgccaaatagccttgaggaactgggggatggattggcaatgggcattatgatgctcaaactgctaacagacttccaaccccaccagctgtggaccactcttctctcactgacctttataaggacaagtttgtccctggattatgcctggaagactatggctatggcgttatctatcgtaagcctcttcccgctgtgcctttccaccacgtcacagaaaacaacctggctgcctgtgttgctcggcagctttgggtgtaagccactgactatgttcctaattacagagaacaagatctggggacgaaaaagttggcccattaacgaaggtatcatggccgttggcatagtgtctatcctgctttccagcctcctgaagaatgacgtccctttggcagggcccttaattgctggaggcatgctgatcgcctgctacgtgatttcgggttcatctgccgatctcagtctggagaaagctgcagaggtatcctgggaagaggaagccgagcatagcgggacctctcacaacatccttgtggaagtccaggacgatggaactatgaagataaaagacgaggagcgcgatgacacactgaccattttgctaaaggcgacgctgctcgctgttagcggcgtgtatccaatgtccatccctgccactctgtttgtgtggtacttctggcaaaaaaagaagcagcggtcaggcgtcctttgggatacccccagtccaccgaaagtggaaagagcagttttagacgacgggatctataggattctgcagcgtggactcttgggtcgcagccaggtaggcgtgggggtcttccaagatggagtgtttcatacaatgtggcacgttacccggggcgccgtgctgatgtaccagggtaagagactcgagccttcttgggcttccgtcaaaaaggacctgatatcatacgggggaggctggaggttccagggcagttggaatacaggggaagaggtgcaggtaatcgcagtcgagcccggaaaaaacccaaagaatgtgcaaactacccccggtacgtttaagacacctgaaggcgaggttggggccattgcgcttgatttcaaaccaggaactagcggctcccccatcgtgaaccgagaaggtaagattgtcgggctgtatggaaatggcgtggttaccacatctggcacctacgtgtcggctatcgcccaggcaaaagccactcaggaggggcctttgccggaaatagaggacgaggtctttaagaaacggaacctaaccatcatggatctgcacccaggaagcggtaagacacgcagatatctccccgctattgtgagggaagccatcaagcggaaattacgaacgctgattcttgcacctactagagtagtggcttcagagatggccgaagcgctgaagggcatgccaatccgctaccaaaccacagccgttaaatccgagcataccgggagggaaatagtcgacctcatgtgtcacgcaactttcacaatgcgtttgctgagtcccgtgcgggtgcctaattataacatgattatcatggatgaggctcattttaccgacccggcctctatcgctgcaagaggatacattagcacgagggtcggcatgggtgaggccgccgctatcttcatgactgcgacacccccagggtccgtagaagcatttcctcagtcaaatgccgtgatacaggatgaggaacgcgacattcccgagcgatcttggaacagcggatatgattggatcaccgacttcccaggcaagaccgtttggtttgtgcctagtattaaatccggcaatgacatcgctaactgcctcagaaagaatgggaagcgggtcatacagctgagcaggaaaactttcgatacagaataccaaaagaccaaaaacaacgactgggattacgtggttacaactgacatttctgagatgggagccaatttccgcgcagatcgtgtgatcgaccccagacggtgccttaagccagtcatcctaaaagagggtccggaaagggtgattctggccggccctatgcccgtaacggtggcttcagcggcccagcgccgagggagaatcggacggaaccagaataaggagggcgatcagtatatttacatgggtcaaccattgaacaatgacgaagatcacgcacattggaccgaggctaagatgttactggacaacataaatacacccgaggggatcattcctgccctctttgaaccagagagggaaaaatccgcagccatcgatggcgagtatcgcctgagaggagaagctaggaagactttcgttgagcttatgcggcgtggcgacctgcccgtctggctcagttacaaagtggccagcgaggggtttcagtattcggatcgccgatggtgtttcgacggagaaagaaacaatcaggtgttggaggaaaacatggacgtcgagatctggaccaaggaaggtgagaggaaaaagctgcggcctcgctggctagatgcgagaacatactctgacccgctggcactcagggagtttaaagaattcgccgctggccggcgatccgttagcggggatcttattctggagataggaaagttaccacagcacttgaccctgagagcccaaaatgctctcgacaacctggtgatgcttcacaattcagaacagggcggtaaggcatatcgccatgccatggaggaactgcccgatactatcgagacgctcatgttgctggctttaattgccgtactaaccgggggcgtgacactgtttttcctcagtggaaaaggccttgggaagacttctatcggactgttgtgcgtcatggcatccagcgcgctgctctggatggcctcagtggagcctcactggattgctgccagtatcatactggaatttttccttatggttctcctgatccccgagccagacaggcagcggacccctcaggataaccaattggcatacgtggtcattggtctgttatttatgatcctaacagtagctgccaatgaaatgggcctgctcgagaccactaaaaaggaccttgggattggacatgtggcagttgagaaccaccaccatgccacaatgctggatgtggacttgcgtcccgctagcgcgtggacgctgtacgccgtcgcaaccactgtgatcacaccaatgatgagacacaccatagaaaacaccacagctaatatttccctcactgccatcgccaaccaggcagctattctgatgggccttgataaaggttggcctatctctaagatggacataggggtcccgttactggccctcggctgttatagccaggtgaatcccttgacgctgaccgcggctgttctaatgctggtggcccattacgcaatcattggaccaggcctccaagccaaggctacaagggaggcacagaaacgcactgccgcggggatcatgaagaaccctaccgtagatggaattgtgacaatcgaccttgaccccgtcgtttatgatgctaaattcgaaaagcagctgggccagataatgttgctgattctctgcacctcccaaatcctgttaatgcggactacgtgggccctttgtgagtcaatcacactggcaaccggtccactcactaccctatgggaagggtctcctggaaaattttggaatacaactattgccgtgagtatggctaacatcttccgaggctcgtacctggccggtgcaggcttggctttcagcctgatgaagtccctcgggggaggcagaagggggaccggagcccagggcgagacacttggtgagaagtggaaacgccagctgaatcagttgtctaagtcagaatttaacacgtataaaaagagcgggataatggaggtcgaccggtccgaagcgaaagagggactgaagagaggcgaaaccactaagcacgccgtgagtcgtggtacagcaaaactcaggtggttcgtagagcggaatttagtgaagcccgagggcaaagttattgatctggggtgcggacgcggcgggtggtcttactattgtgctggacttaagaaagtgaccgaagtcaagggctacactaaaggtgggccgggacatgaggaaccaatccctatggccacatacggctggaacctggtgaagctacacagcggcaaggacgtctttttcacccccccagagaaatgcgatacgctcctgtgtgacattggggaatcatcccccaatcctaccatcgaggagggacgaacattgagagtgctgaagatggttgaaccgtggctcaggggtaaccaattttgcataaaaatccttaatccctatatgccaagtgtagtggagactctggaacagatgcagcggaagcacggcgggatgttagtccgcaaccctctgagcagaaattctacccatgagatgtactgggtgtcctgtggaacaggcaacattgtttcagcagtgaatatgactagcaggatgttgctcaaccgattcaccatggctcaccggaaacccacatatgagcgtgatgtcgacctgggtgccgggaccagacatgtggccgtagaacctgaggtggcgaacctagatatcattggacagcgcatcgaaaatattaagaacgagcacaagtcgacttggcactacgacgaagataatccatataaaacgtgggcttaccatggctcttatgaggttaagcccagtggctccgcaagctcaatggtcaacggggtggtgaggcttctgacaaaaccttgggacgtcatcccaatggttacccaaatagccatgactgacaccacaccctttggacagcagcgggtgttcaaggagaaagtagatacgagaaccccgcgcgctaagaggggtactgcccaaattatggaagtgacagcaaagtggctctggggctttctgtcccgaaataaaaagcctcggatctgcaccagagaggaattcactaggaaagtccgctctaacgccgctatcggggcggtgtttgttgacgagaatcagtggaacagcgccaaggaagcagtggaggatgagcgtttctgggacttggtccaccgggaaagagagctgcataaacagggaaagtgcgctacatgtgtgtacaatatgatgggcaagagggaaaaaaagctcggtgagtttgggaaagccaagggaagtcgcgcaatttggtacatgtggcttggcgcccgattcctggaattcgaggctttaggctttatgaacgaggatcactggttctcccgggaaaatagcctgtctggggtagagggagaaggtttgcataaactcggctatatactgagagacatctcaaagattccagggggaaacatgtacgccgatgacaccgcgggctgggatacaaggatcactgaggacgatctacagaatgaggcaaaaattaccgacatcatggaacccgagcacgcccttctggctacgagtatatttaagctcacctatcaaaacaaggttgtgcgcgtccagagacctgccaaatccggtacagtgatggatgtgatcagccggagggaccagcgtgggtctggacaggtcggcacttacggcctgaataccttcacaaacatggaagttcaattgattcgacagatggagtcggaagggatcttttcaccaagcgagttagagactcccaacctggcaaagaaagtgctcgactggcttgaaaagcacggagctgagcgcctgaaaagaatggccatttccggtgatgactgcgtagtgaagccgatcgatgaccggttcgctaccgccctaacggcactgaatgatatgggcaaggtcaggaaagacatacctcagtgggaacccagtaaggggtggaacgattggcagcaagtgccattttgttctcatcacttccatcagctcattatgaaagacggacgcgagatcgttgtgccttgcagaaatcaggatgaattggtcggccgggcgagggtgagccagggtgccgggtggtccctgcgagagacagcttgtcttggaaagtcatatgcccaaatgtggcagctgatgtactttcaccgtagagacctccgcttagcagctaacgccatctgcagtgcagtacccgttgattgggtgccaacctctcggactacatggagcattcacgcccatcaccagtggatgaccactgaggacatgctgtccgtctggaatagggtgtggatagaagagaacccctggatggaagacaaaacccatgtttcaagctgggaggaagtgccttatttgggcaagagagaggatcaatggtgtggctctctgatcgggctcacagcgcgcgctacgtgggccaccaatattcaggtcgcaatcaaccaggtgcggaggcttattggaaatgagaactacctggactacatgacttccatgaagcgattcaaaaatgaaagtgatccagagggtgccctatgg

SEQ ID NO: 14238 - RNA, 9876 nt, synthetic construct
  misc_feature 1..9876: note = derived and/or modified CDS sequence (opt3) from DENV-1__KF672761__SS-prME
  source 1..9876: mol_type = other RNA
agcgtgaccatgctgttcatgctccttcccacagcactggcttttcacttgactacgcggggaggggagcctcatatgatcgtctccaagcaagaaaggggaaaatctttactgttcaagacctcagccggtgttaatatgtgcaccctaattgccatggacctcggcgagctgtgtgaagatactatgacctacaaatgcccacggataacagaggcggaaccggacgatgtggactgttggtgcaatgctaccgatacttgggtaacatatgggacctgtagtcaaacgggaggccaccgccgagacaagcgtagcgtggcccttgcaccccatgtcggtctggggttggagactagaaccgagacatggatgtcctctgaaggagcctggaaacagatccagaaggtggagacttgggctctcaggcaccctggctttaccgttattgcactgttcctggcccatgctatcggcacatcgattacccagaaggggatcatatttatcctcttaatgctggtgacgccatcaatggccatgcggtgcgtcggaattggtaatcgcgatttcgtggaaggccttagcggggcgacttgggtagacgttgtgttggagcacggaagttgtgtcacaaccatggccaagaataagcccactctggatatcgagctactcaaaacagaagtgaccaaccctgccgtgctgagaaaactttgcattgaggctaaaatctccaatacgaccacagactctaggtgtccaactcaaggcgaagccaccctggtcgaggaacaggatgcaaactttgtttgccggcgcacattcgtggaccgaggttgggggaatggatgtggcttgtttggcaaggggagcctcctgacttgcgctaagttcaaatgcgtaaccaagttagagggaaaaatagtgcagtacgagaacctgaagtattccgtcattgtgacagttcacaccggtgatcagcatcaagtgggcaatgaaactacggagcacgggacaatcgccaccattactccccaggcgcctacctcagaaatccagctcacagactacggagcccttaccctggactgtagtccacggactggcttggattttaacgagatggtcctactgacaatgaaagaaaagagctggctcgtgcataaacagtggttcctggaccttccgctgccctggacgtctggtgcatccacctcacaagagacttggaataggcaggatttgctcgtaacatttaagaccgctcacgccaagaaacaggaggttgtggtcctggggagccaagaaggcgctatgcacacagccttaactggagcaaccgagatccagacgagtggcaccacaactattttcgccgggcatctgaagtgccggctaaaaatggacaagctcaccctgaaaggaacatcttatgtgatgtgtactggttccttcaaacttgaaaaggaggtcgctgaaacccagcacggcacggtgttggttcaggtgaaatacgaggggacagatgcgccttgcaagataccatttagcacccaagacgagaaaggagtaactcagaacggccgtctgatcacagcaaatcccattgtcaccgataaggaaaaacctgtgaacatcgagactgaaccacccttcggtgagtcgtatatagttgtgggggccggcgagaaggctctcaagctgtcttggtttaaaaagggatcctcaattggcaaaatgttcgaagccaccgcacgcggggccagaaggatggctatccttggagacacagcctgggattttggtagtatcggcggggtcttcacgagcgtgggaaagctggtacatcaggtgtttggcaccgcatacggtgttttgttctccggggtctcttggactatgaaaattggcatcgggattctcctgacatggttaggcctgaatagccggtcaaccagtctatccatgacatgtatagcggtggggatggtgactctctacctgggagtcatggttcaggctgacagcggctgcgtgatcaactggaagggtcgagagcttaagtgtgggtctggaatttttgtgaccaacgaagtacacacgtggacagagcaatataaattccaggccgattcaccgaagcgcttgagtgcagccatcggcaaggcttgggaagagggtgtctgcggcatcagaagcgccaccaggctggagaatattatgtggaagcagatatccaacgaactcaatcatatcctgttagagaacgacatgaaatttactgtggttgtgggggacgcaaatggcattctggctcagggcaagaaaatgatccggcctcaacccatggaacacaagtactcttggaagtcgtgggggaaagccaagattatcggagcggatatacagaacaccacattcatcattgacggcccagatactcctgagtgtcccgacgaacagcgcgcctggaatatctgggaggtcgaggattatggttttgggattttcaccacaaacatctggcttaaattgagagacagctacacgcagatgtgcgatcacaggctcatgtccgctgcaataaaggactcaaaagccgtgcatgctgatatgggatattggattgaaagtgagaagaatgaaacctggaagctggcccgtgcatctttcatcgaggttaaaacttgtatttggccaaagagccacacactatggtccaacggcgtgctggaatcagagatgatcatacccaaaatctacggtggccctattagccaacataattatcggccagggtactttacccagactgcgggaccgtggcacctcggcaagctggagcttgacttcgatttgtgcgaagggacaaccgtagtcgtggacgagcactgcggaaaccgaggcccctctctgagaacgactaccgtgacaggtaaaatcattcatgaatggtgttgcaggtcctgtaccttacctccactccgctttagaggggaagatggatgctggtacggcatggagatcagacccgtcaaggaaaaggaggaaaatctggttaggagtatggtgagcgccggttctggcgaggtagactccttctcacttgggatactgtgtgtgagtattatgatcgaagaggtcatgcgcagccgatggtcgcggaaaatgttgatgactggaacactcgctgtgtttctgctactgatcatgggccagctcacctggaacgacctgattcgtctttgcatcatggttggggccaatgcatccgataagatgggaatgggcacaacttatttggctctgatggccaccttcaaaatgagacctatgtttgcagtgggtttactcttcaggcgcctgacgtctcgggaggtccttctgctaacaattgggctcagcctggtggcctcagttgaattgccaaacagtctggaggaattaggagacggcctcgctatgggcataatgatgctgaaacttctgaccgagtttcaaccccaccagttgtggactaccctcctgtccctaacattcatcaaaactaccctgtctcttgattacgcgtggaagacgacagccatggtgctcagcattgtctccctgtttccgttgtgtctgtcaaccactagccagaagacaacctggttacctgtactcctggggagtttcggatgcaaaccacttactatgtttctgatcacagaaaacaagatttggggtagaaaatcttggcccttgaatgagggcatcatggcaatagggatcgtgtccattctcctgagctcgctactgaagaacgacgttcctcttgctggacccctcatcgccggcggtatgctgattgcctgttatgtgatctcagggtctagtgctgatttgtccttagagaaagcagccgaagtcagctgggaggaagaggcggaacattctggaaccagccacaatatactggtggaggtacaggacgatggcacgatgaagattaaagacgaggaaagggatgacactctcaccatcctgcttaaggctacactgttggccgtgtccggcgtctacccaatgtcaatccctgcaaccctattcgtttggtatttctggcaaaagaaaaagcagcgaagtggggtgctgtgggatacacccagcccaccggaggtggaacgcgccgtcctcgacgatggaatttaccggatactgcagagaggtcttttaggcaggtctcaggtgggggttggagtatttcaagacggcgtgttccatactatgtggcacgtcacccgtggtgctgtgctgatgtatcaggggaaacgcctcgagccttcctgggcatcagttaagaaagacttgatcagttacggaggcggctggcggtttcaggggagctggaacacgggagaggaagtgcaggtcattgccgtggagcccggtaagaatccaaagaacgtacaaacaactcccggcaccttcaaaacacctgaaggggaggtcggagcgatcgctctggattttaagccaggcacctccggttctcccattgtgaatagagaagggaaaatcgttggactctacggcaacggcgtggtcactacctcggggacatatgtgagcgccatagcacaggccaaggcttcacaggagggacctctgccggagatcgaagacgaggttttcaaaaagaggaatcttacgattatggatctgcacccaggttccggcaagactcgacggtacttgcccgccatcgtgcgcgaagcaattaaaagaaagctaaggaccctgatcctcgctcctacacgggtcgtggccagtgagatggcggaagccttaaaagggatgccaatacgatatcaaaccactgcagtaaagtctgagcatacaggaagagagattgtggacctgatgtgccacgctacctttacgatgcgccttctgagccccgttagggtccctaactacaatatgatcatcatggatgaagcccatttcactgacccggcttccattgcagcccgtggctatatctcaacacgggtgggtatgggggaggccgctgcgatatttatgaccgcaacacccccaggatctgtggaagccttccctcagagcaacgctgtcattcaggatgaggaaagagacatccccgagaggagttggaactccggctacgattggattactgactttccaggcaaaacagtatggttcgtgcctagcatcaagtctgggaacgatatagccaattgtctccgcaagaacggaaaacgagttattcagttgtcaagaaagaccttcgacacagagtatcagaagactaagaacaatgactgggattacgtggtcacgaccgacatctccgaaatgggtgcaaactttcgggccgatagggtgatcgacccccgccgttgcctgaaaccagttattctcaaggatggcccggagagagtgatcctggctgggcctatgcccgtcacagtggcgagtgccgcacagcggaggggacgcattggccgaaatcagaacaaggaaggtgaccagtacgtatatatggggcaaccacttaataacgatgaggaccacgctcattggactgaggccaaaatgctactggataatataaacacccccgaaggcatcattcctgcattgttcgagccagaaagagaaaagagcgccgctatcgacggagaataccggttaaggggcgaggcccgcaaaacatttgtggagctgatgagaaggggagatctccccgtttggctgtcgtataaggtcgcgtctgaaggattccagtactccgaccggcgttggtgctttgatggtgagcgcaataaccaggtgcttgaagagaatatggacgtggaaatctggaccaaagagggcgagcgaaagaaactgagacctaggtggctcgacgcacggacttatagcgatccgttggccctgcgcgagttcaaggagtttgctgccgggagaaggtcagtcagtggagacctaattctggaaataggcaagctcccacagcaccttacgctgcgggctcaaaacgcattagataatttggttatgctgcacaactctgagcagggtgggaaagcctaccgacatgctatggaggaactccccgacaccatcgagacactgatgcttctggccctcattgcagtgttgactggcggagtaaccctgttctttttatccggcaaggggctaggaaaaacaagcatcggtctgctctgtgtgaccgcgtcaagtgcccttctgtggatggctagcgtcgaacctcactggattgccgcatccatcatattggagttctttctgatggtgctcctgatccccgaaccagatagacagcgcactcctcaggacaatcaacttgcttatgttgtgattggcctcctgttcatgatcttgacagtcgccgcaaacgagatggggctgttagagacgaccaagaaagatctaggaattggccatgtagccgctgaaaaccaccagcacgcgactatgctggacgtggatctcaggcccgcctctgcatggacactttacgctgttgccaccaccgtgatcacaccaatgatgcggcatactatagagaatacgaccgccaacattagcctgacagcaatcgctaatcaggccgcgattttgatgggtctggacaaggggtggcctatctccaagatggatataggcgtcccgctcctggctcttggatgctactcacaagtgaaccccttaactctgaccgccgcagtcctcatgttggtggcccactatgctatcattggcccagggctgcaggcaaaagccacacgtgaagcgcagaagagaaccgctgccggaatcatgaaaaatcctactgttgacggcattgtggcaatcgatctagaccccgtagtgtacgacgccaagtttgagaaacagctgggtcaaataatgctccttattctgtgtacgtctcagatcttgctgatgaggacaacctgggctctctgcgaaagtatcactctggccaccgggccattaacaactctttgggagggatcgcctggcaagttctggaacaccacaattgcagtcagcatggctaatatcttccgcggttcctatctggccggcgcggggctcgccttttctctaatgaagtcactgggaggcgggcggcgaggaacgggcgcacagggtgagaccttgggggaaaaatggaagagacagctgaaccaactcagcaaatccgagttcaatacttacaagaggagtggaataatggaagttgatcgctctgaggctaaagaaggccttaagcggggtgagacaaccaagcatgccgtgagcagaggcactgcaaaactgcgttggtttgtcgagaggaacttggtgaagcccgaagggaaagtaattgacctgggatgtggcagagggggatggtcatattactgcgctggcctcaagaaagtgacagaggttaagggttataccaaagggggaccgggccacgaggaaccaatccctatggccacgtacggctggaatttagtgaagctgcattccgggaaggatgtcttctttatgcccccagaaaaatgtgacacccttctgtgcgatattggagagagtagccccaaccctacaatcgaggaaggtcgcactctacgagtgctcaagatggtcgagccgtggctgagaggcaatcagttctgtataaaaatcttgaacccctacatgccatctgtggttgaaaccctggagcagatgcagaggaagcacgggggaatgctcgtacggaatcctctttcccgcaactcaacacacgagatgtattgggtgagctgcggcactggtaatattgtctcggccgtgaacatgacctctagaatgctgttaaacaggtttacaatggcgcatcgaaaacccacctacgaacgggacgttgatctgggggctggaactcgtcacgtggcagtcgagcctgaagtggccaatttggacatcattggccaaagaatcgagaacattaagaatgaacataagagtacgtggcactatgatgaggacaacccatacaaaacatgggcttatcacggctcctacgaggtaaagcccagcgggtcagcctcctctatggtgaatggagttgtccgcctcctgaccaaaccttgggatgtgatcccaatggtgactcagatagcaatgaccgacacaacgcccttcggtcagcaaagggtctttaaggaaaaagttgacacccggactccgagagccaagcgcggcacagctcagattatggaggtgaccgcgaagtggctatgggggttccttagcaggaacaaaaagcctcgaatctgtactcgggaagagtttacaagaaaagtaaggagtaatgccgcaatcggagctgtgttcgtcgatgaaaaccagtggaactccgccaaggaggcagtggaggacgaacgcttttgggatctggttcatcgtgagcgggaactccacaaacagggcaagtgcgcaacctgcgtgtataacatgatgggtaagagagagaaaaagctgggggagttcggaaaagctaagggcagcagggccatttggtacatgtggttgggcgcgcgcttcctggagtttgaggcactcgggttcatgaatgaagaccattggttttctcgagagaactcacttagtggagtcgaaggtgagggcctgcacaaattagggtacatactgcgggatatctccaagattccaggaggcaatatgtatgccgacgatacagctggttgggacactagaatcaccgaggatgacttgcaaaacgaagccaaaattacggatatcatggagcccgaacatgcactcctggctaccagcatattcaagctaacataccagaataaggtggtaagggttcagcgccctgccaaaaacgggactgtgatggacgtcatctctagacgggatcagaggggatcgggccaagtgggcacctatgggcttaacacatttactaatatggaggtgcagctgattcgtcagatggaatcagagggaatcttcctcccaagcgagctggaaacccccaacttggctgagcgagtcttagactggctggaaaagcacggtgccgagcgcctcaaaagaatggcaatttccggcgacgattgtgttgtgaagccgatcgacgatcggtttgcgacggcccttatagctctgaatgacatggggaaagtaaggaaggatattcctcagtgggaacccagtaagggatggaacgactggcaacaggtgccattctgctctcaccattttcaccagctaatcatgaaagatggccgcgagatcgtcgtgccttgtagaaatcaggacgagctggttggtcgggccagggtgagccaaggggcaggatggtccctccgagaaacagcttgcttgggcaagtcatacgcccagatgtggcagctgatgtatttccatcgtagagatcttcgcctggcagccaacgcgatttgtagtgctgtccccgtggactgggtaccaacctctcggactacatggagcatacacgcccaccatcaatggatgaccactgaggatatgctctccgtttggaatagggtgtggatcgaagagaacccctggatggaagacaaaacccacgtctcaagctgggaggaggtgccttacttaggcaagagagaagaccagtggtgcgggtctctgattggattgacagcacgcgccacgtgggctaccaatatccaggttgccattaaccaggtgcggaggctgatcggtaatgagaactatctcgattacatgacttccatgaaacgatttaagaatgaaagtgacccagagggcgcactttgg

SEQ ID NO: 14239 - RNA, 9876 nt, synthetic construct
  misc_feature 1..9876: note = derived and/or modified CDS sequence (opt3) from DENV-1__KF672762__SS-prME
  source 1..9876: mol_type = other RNA
agcgtgaccatgctgctcatgcttctgcccaccgcattggctttccacttaactacgagaggcggggaacctcatatgatcgtctccaagcaggaaagaggaaaatctctgctgtttaagacctcagccggtgttaatatgtgcacactcattgcaatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagaaggtggaaacttgggctctgaggcaccctggattcaccgttattgcactgtttctcgcccatgctatcggcacatcgattacccagaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggccaagaataagcccactctagatatcgaactcctgaaaacagaggtgaccaaccctgccgtgcttagaaagctgtgcattgaagctaaaatctccaatacgaccacagactctaggtgtccaactcaaggagaggccaccttggtcgaagaacaggatgcaaacttcgtttgccggcgcacatttgtggaccgaggctggggtaatgggtgtggactcttcggcaagggcagcctgttaacttgcgctaagtttaaatgcgtaaccaagctggaggggaaaatagtgcagtacgaaaacctcaagtattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaagaactggactagatttcaacgaaatggtcctgctcacaatgaaagagaaaagctggctggtgcataaacagtggtttcttgacctgccgttgccctggacgtctggcgcatccacctcacaagagacttggaataggcaggatctcctggtaacattcaagaccgctcacgccaagaaacaggaagttgtggtcttaggtagccaagagggggctatgcacacagccctgactggcgcaaccgaaatccagacgagtggaaccacaactatttttgccggccatctaaagtgccggctcaaaatggacaagctgacccttaaagggacatcttatgtgatgtgtactggatccttcaagttggagaaggaagtcgctgagacccagcacggtacggtgctggttcaggtgaaatacgagggcatagatgcgccttgcaagatcccattcagcacacaagacgaaaaaggggtaacccagaacggacgtctcattactgcaaatcccatcgtcacagataaggagaaacctgtgaacatagaaaccgagccaccctttggcgagtcgtatattgttgtgggtgccggggaaaaggctctgaaactttcttggttcaaaaagggctcctcaatcggaaaaatgtttgaggccactgcacgcggcgccagaaggatggctatcctgggggacaccgcctgggatttcggaagtattggtggcgtctttacaagcgtggggaagttggtacatcaggtgctcggaacggcatacggcgttctgttctccggtgtctcttggaccatgaaaatcgggattggcatattactgacttggctaggactcaatagccggtcaacaagtctgtccatgacctgtatcgcggtgggcatggtgacactttacttgggggtcatggttcaggctgacagcggatgcgtgattaactggaagggccgagaactgaagtgtggttctgggatctttgtgactaacgaggtacacacctggacggaacaatataaattccaggccgattcaccgaagcgcctcagtgcagccatcggaaaggcttgggaggagggcgtctgcggtattagaagcgccacaaggctggaaaatataatgtggaagcagatctccaacgagttaaatcatattctgcttgaaaacgacatgaaatttaccgtggttgtgggcgacgcaaatgggatcttggctcagggaaagaaaatgattcggcctcaacccatggagcacaagtactcttggaagtcgtggggcaaagccaagatcataggggcggatatccagaacactaccttcattatcgacggaccagatacacctgaatgtcccgacgagcagcgcgcctggaatatttgggaggtcgaagattatggctttggtatcttcactaccaacatatggctcaaactgagagacagctacacacagatgtgcgatcacaggctaatgtccgctgcaattaaggactcaaaagccgtgcatgctgatatggggtattggatcgagagtgaaaagaatgagacgtggaagctggcccgtgcatcttttattgaagttaaaacctgtatctggccaaagagccacactctctggtccaacggagtgctggagtcagagatgataatccccaaaatttacggcggtcctatcagccaacataattatcggccaggctacttcacacagaccgcggggccgtggcaccttggaaagttggaactggacttcgatttatgcgagggcactacagtagtcgtggacgaacactgcgggaaccgaggaccctctctcagaaccacgactgtgaccggcaaaattatccatgagtggtgttgcaggtcctgtacactgcctccacttcgctttcggggtgaggatgggtgctggtacggaatggaaataagacccgtcaaggagaaggaagagaatctggttaggagtatggtgagcgccggctctggtgaagtagactccttctcattgggcattctctgtgtgagtatcatgatcgaggaggtcatgcgcagccgatggtcgcggaaaatgctgatgaccgggactctagctgtgtttctgctcctgattatgggacagcttacatggaacgacttgatccgtctgtgcattatggttggcgccaatgcatccgataagatggggatgggaaccacatatttagctctcatggccactttcaaaatgagacctatgtttgcagtgggcctgcttttcaggcgcctgacctctcgggaagtcctactcctgacgataggtttgagcctggtggcctcagttgagttaccaaacagtctcgaagaactgggggacggacttgctatgggcatcatgatgctgaagttgctcacagaatttcaaccccaccagctgtggaccactctactgtcccttaccttcattaaaacaactctctctctggattacgcgtggaagaccacggccatggtgttgagcatcgtctccctgtttccgttatgtctctcaacaaccagccagaagactacatggctgcctgtacttctgggcagtttcgggtgcaaaccattgaccatgtttctcattactgagaacaagatctggggaagaaaatcttggcccctgaatgagggtataatggcaatcggcattgtgtccatcctactgagctcgcttctcaagaacgacgttcctctggctgggcccttgattgccggaggcatgttaatcgcctgttatgtgatatcaggttctagtgctgatctgtccctcgaaaaagcagccgaggtcagctgggaagaggaagcggagcattctgggacaagccacaatattctggtggaggtacaggacgatggaaccatgaagatcaaagacgaagagagggatgacacgcttactatcctgttgaaggctaccctactggccgtgtccggcgtctacccaatgtcaattcctgcaacactcttcgtttggtatttttggcaaaagaaaaagcagcgaagtggcgtgctgtgggatacccccagcccaccggaagtggagcgcgccgtccttgacgatgggatataccggatcttacagagaggactgctcggtaggtctcaggtgggcgttggggtattccaagacggagtgttccatacaatgtggcacgtcactcgtggcgctgtgttgatgtatcagggtaaacgcctggagccttcctgggcatcagttaagaaagacctcattagttacgggggaggctggcggtttcagggcagctggaacaccggggaagaggtgcaggtcatcgccgtggaacccggaaagaatccaaagaacgtacaaacgacacccggtactttcaaaacccctgagggcgaagtcggggcgattgctctggattttaagccaggaacatccggctctcccatcgtgaatagagagggtaaaatagttgggctttacggaaacggcgtggtcaccacttcgggcacctatgtgagcgccatcgcacaggccaaggcttcacaggaggggcctctgccggaaattgaggacgaagttttcaaaaagaggaatttgacaatcatggatctacacccaggatccggtaagacgcgacggtacctgcccgccattgtgcgcgaggcaatcaaaagaaagctcaggactttaatactggctcctacccgggtcgtggccagtgaaatggcggaggcccttaaaggcatgccaattcgatatcaaacaaccgcagtaaagtctgagcatactgggagagaaatcgtggacctgatgtgccacgctacatttaccatgcgcctcttgagccccgttagggtccctaactacaatatgatcattatggatgaggcccatttcacggacccggcttccatcgcagcccgtggatatatatcaactcgggtgggcatgggtgaagccgctgcgatttttatgacagcaacacccccagggtctgtggaggccttccctcagagcaacgctgtcatccaggatgaagagagagacattcccgagaggagttggaactccggatacgattggatcaccgactttccaggccgcactgtatggttcgtgcctagcataaaatctggcaacgatattgccaattgtctgcgaaagaacgggaagagagttatccagctctcacggaaaacatttgacaccgaatatcaaaagaccaaaaataatgactgggattacgtggtcactacggacatctccgagatgggagcaaacttcagggccgatcgcgtgattgacccccgtagatgcctgaagccagttatccttaaagatggtccggaacgggtgattctagctggccctatgcccgtcaccgtggcgagtgccgcacagaggcgcgggcgaataggaagaaatcagaacaaggagggcgaccagtacgtatatatgggtcaaccactgaataacgatgaggaccacgctcattggacagaagccaagatgttgttagataatatcaacactcccgaggggattatccctgcactgttcgaaccagagcgggagaaaagcgccgctatcgacggcgagtacaggctccgcggagaggccagaaagacctttgtggaactgatgaggcggggcgatcttcccgtttggctgtcgtataaagtcgcgtctgaggggttccagtactccgaccgtcgctggtgctttgatggagaacgaaataaccaggtgctcgaggaaaatatggacgtggagatttggacaaaggagggtgaaaggaaaaagttgaggcctcggtggctggacgcacgcacctatagcgatccgctagccctgagagagttcaaagaatttgctgccggcaggcggtcagtcagtggggacctcatacttgagatcggaaagctgccacagcacttaactttgcgagctcaaaacgcactggataatctcgttatgctgcacaactctgaacagggcggtaaggcctacagacatgctatggaggagcttcccgacacgattgaaaccctgatgctcttggccctgatcgcagtgttaacagggggcgtaactctattctttctgtccggaaaaggcctcgggaagaccagcattggacttctgtgtgtgacagcgtcaagtgccttgctgtggatggctagcgtcgagcctcactggatcgccgcatccataatcctcgagttctttctgatggtgcttctcattcccgagccagatcgccagaggacccctcaggacaatcaactggcttatgttgtgatcggtttgctgttcatgattttaactgtcgccgcaaacgagatgggcctactggaaacaacgaaaaaggatctcgggatcggacatgtagccgctgagaaccaccagcacgcgaccatgcttgacgtggatctgcggcccgcctctgcatggactttgtacgctgttgccacaaccgtgataaccccaatgatgcgtcatacaattgaaaatactacggccaacatcagcctgaccgcaattgctaatcaggccgcgatcctcatgggcctggacaaaggttggcctatatccaagatggatatcggggtcccgcttttagctctgggctgctactcacaagtgaaccccctcacattgactgccgcagtcctgatgctagtggcccactatgctattatcggaccaggcctgcaggcaaaggccaccagagaggcgcagaaaaggacagctgccgggattatgaagaatcctaccgttgacggaatcgtggcaatagatctcgaccccgtagtgtacgacgccaaatttgaaaagcagcttggccaaattatgctgttgatcctgtgtacttctcagatcctcctgatgcgcacgacatgggctttatgcgagagtattacccttgccactggtccactgaccacactctgggaggggtcgcctggaaaattctggaacactaccatcgcagtcagcatggctaatatatttcggggctcctatctagccggtgcgggcctggccttctctttgatgaagtcactagggggaggccgaagagggacaggagcacagggcgaaacgctcggtgagaagtggaaaaggcagcttaaccaactgagcaagtccgagttcaatacctacaaacgcagtgggattatggaggttgatcggtctgaagctaaggagggattgaaaagaggcgagactacaaagcatgccgtgagccgtggtaccgcaaagctgaggtggtttgtcgaacggaacctcgtgaaacccgagggcaaggtaatcgacttagggtgtggacgcggcgggtggtcatattactgcgctggactgaaaaaggtgactgaagttaaaggctatacaaagggtgggccgggacacgaggaaccaattcctatggccacctacggctggaatcttgtgaaactgcattccggcaaggatgtcttctttatgcccccagagaagtgtgacacgctactctgcgatatcggggagagtagccccaaccctaccatagaagagggacgaacactgagagtgttgaaaatggtcgaaccgtggctgaggggtaatcagttctgtatcaagattctcaacccctacatgccatctgtggttgagactcttgagcagatgcagcggaaacacggcgggatgctggtacgcaatcctttatccagaaactcaacccacgaaatgtattgggtgagctgcggaacaggcaatatcgtctcggccgtgaacatgacttctaggatgctgttgaaccgatttaccatggcgcatcggaagcccacatacgagcgtgacgttgatctcggtgctgggaccagacacgtggcagtcgaacctgaggtggccaatctggacattatcggacaacgcattgaaaacatcaaaaatgagcataagagtacttggcactatgatgaggacaacccatacaagacgtgggcttatcacggctcctacgaagtaaaacccagcggctcagcctcctctatggtgaatggggttgtcaggctacttacaaagccttgggatgtgataccaatggtgacccagattgcaatgactgacaccacacccttcggacagcaacgggtctttaaagagaaggttgacacgagaaccccgcgcgccaaaaggggtactgctcagatcatggaagtgacagcgaagtggctgtggggcttcctcagccgaaacaagaaacctcggatctgtaccagagaggaatttactaggaaggtacgcagtaatgccgcaattggggctgtgttcgtcgatgagaaccagtggaactccgccaaagaggcagtggaagacgagcgtttttgggatctggttcatcgggaaagagagttgcacaagcagggaaaatgcgccacatgcgtgtataacatgatgggcaagagggaaaagaaactgggtgagttcgggaaggctaaaggaagccgcgccatatggtacatgtggctcggcgcgcgatttcttgagttcgaagcactgggcttcatgaatgaggaccattggttttctcgggaaaactcattaagtggggtcgagggagagggtctgcacaagttgggctacatcctcagagatatttccaaaatcccagggggaaatatgtatgccgacgataccgctggctgggacacaaggattactgaagatgacctgcaaaacgaggccaagatcaccgatataatggaacccgagcatgcactacttgctacgagcatcttcaaactgacctaccagaataaggtggtacgcgttcagagacctgccaagaacggtacagtgatggacgtcatttctcggagggatcagcgtgggtcgggacaagtgggcacttatggcctcaacacctttacaaatatggaagtgcagctgatccgacagatggagtcagaggggattttcttgccaagcgaattagagactcccaacctggctgaacgcgtcctcgactggcttgagaaacacggagccgaaagactgaagcggatggcaatctccggtgacgattgtgttgtgaaaccgatagacgataggtttgcgaccgccctaattgctctgaatgacatgggcaaggtacgcaaagatatccctcagtgggagcccagtaaggggtggaacgactggcaacaggtgccattctgctctcaccattttcaccagctcatcatgaaggatggaagagagattgtcgtgccttgtcggaatcaggacgaattggttggcagggcccgagtgagccaaggtgcagggtggtccctgcgtgagacggcttgccttggaaaatcatacgcccagatgtggcagctgatgtatttccatagacgcgatctccggttagcagccaacgcgatatgtagtgctgtccccatcgactgggtgccaacatctaggaccacttggagcattcacgcccaccatcaatggatgacaaccgaagatatgctgtccgtatggaatagagtttggatcgaggaaaacccctggatggaggacaaggcacacgtgtcaagctgggaggaagtcccttacttgggcaaacgcgaggaccagtggtgcggctctctgattgggctcactgcccgggctacctgggccacaaatatccaggtggcaataaaccaggttaggcgacttatcggaaatgaaaactatctggattacatgacgtccatgaagagatttaaaaatgagagtgacccagagggtgctctatgg

SEQ ID NO: 14240 - RNA, 9879 nt, synthetic construct
  misc_feature 1..9879: note = derived and/or modified CDS sequence (opt3) from DENV-1__JF459993__SS-prME
  source 1..9879: mol_type = other RNA
agcgtgaccatgctgttcatgctccttcccacctccctggcctttcacttgactacgagaggaggggagcctcatatgatcgtctctaagcaggaaaggggaaagtcattactgttcaagaccagtgctggtgttaatatgtgcacactaattgcaatggacctcggcgagctgtgtgaagatactatgacctacaaatgcccacggataacagagaccgaaccggacgatgtggactgttggtgcaatgccactgagacatgggtaacctatgggacgtgtagccaaactggagagcaccgccgagataagcgttccgtggcgcttgctccccatgtcggcctgggtttggaaaccagaacagagacttggatgtcttcggaaggggcctggaaacagatccagaaggtggagacctgggcactcggacaccctggctttacagttattgccctgttcctggctcatgcaatcggcacctcaattacgcagaaggggatcatatttatcctcttaatgctggtgactccaagcatggccatgaggtgcgtcggaattggtaaccgggacttcgtggagggccttagtggggctacatgggtagatgttgtgttggaacacggatcctgtgtcaccactatggccaaagacaagcccacactggatatcgagctactcaaaaccgaagtgacgaatcctgcgattctgcgcaaactttgcatcgaggcaaaaatatctaacaccacaactgacagcagatgtccaacccaaggcgaagccacactggtggaggagcaggatactaattttgtctgcaggcggaccttcgttgaccgcggttgggggaacggatgtggcttgtttggcaaggggtccctcattacatgcgctaagttcaaatgcgtgaccaagctggaaggaaaaatcgtacagtacgagaatttaaagtattcagtgattgtcactgtgcacacgggtgatcagcatcaagttggcaacgaaacaaccgagcacgggactaccgccacaatcacaccccaggcacctacaagtgaaatccagctgacagactacggagctctcacgcttgactgtagcccacgaaccggcctggattttaatgagatggtgttgctaactatgaaagagaagtcttggctggtccataaacagtggttcctcgacctgccgcttccctggacatccggtgcctcaaccagccaagaaacatggaacagacaggatctgttggtgacttttaagaccgcgcacgccaagaaacaggaggtagttgtgctcgggagtcaagaaggcgcaatgcacacggctctgaccggagccacagagattcagacttctggcaccacaactatattcgctgggcatttaaagtgcaggctgaaaatggacaagctaaccctcaaaggagtctcctatgtgatgtgtacgggtagcttcaagctggaaaaggaggtcgccgagacacagcacggcaccgtgcttgttcaggtgaaatacgaagggactgatgcaccttgcaagatcccattttcgtctcaagacgagaaaggagtaattcagaatggccggttgatcacagccaaccccatagtcaccgataaggaaaaacctgtgaatattgaggctgagccacccttcggtgaatcctatatcgttgtgggggcgggcgagaaggcactgaagctctcatggtttaaaaagggaagtagcatcggcaaaatgttcgaagccactgctcgtggggcccgcagaatggcaattctgggagacaccgcctgggattttggttccatcggcggggtcttcacatctgtgggaaaacttgtacatcagatttttggcacggcttacggtgtgctgttcagcggggtttcatggaccatgaaaataggcatcggaattttgctcacttggctgggcttaaacagtaggtccacaagcctgtctatgacctgtatcgccgtcgggatggtgacactatacctcggagtgatggtccaggcagactcaggctgcgttatcaattggaagggtcgggagctgaagtgtgggagtggaatttttgtgactaacgaagtgcacacctggacggagcaatataaattccaggcggatagcccgaagcgactttccgctgccataggcaaagcatgggaggaaggtgtatgcggcatccgctctgccacaagattggagaacattatgtggaagcagatctcgaatgaactgaaccatattctcctggagaatgacatgaaatttaccgtcgtggttggggacgtggctggaatcttagcccagggcaagaaaatgataaggcctcaacccatggaatacaagtatagctggaagtcctgggggaaagcaaagatcattggagctgatgtccagaacgccactttcatcattgacggcccaaatacccctgagtgtcccgatgaccagcgggcgtggaacatctgggaggtggaagattacggttttgggatattcacaactaatatttggctgaaacttcgcgactcatatacccaggtttgcgatcacagattgatgagtgccgctatcaaggactctaaagcagtgcacgccgatatgggatactggattgagagcgaaaagaacgagacatggaagctcgctagggcctccttcatcgaagtaaaaacgtgtgtctggccaaagtcacataccctgtggagcaatggcgtgctagagtctgagatgataatccccaaaatttatggtggccctatctcccaacacaaccatcgtccagggtactttactcagacagcaggaccgtggcacctgggcaagctcgaactggacttcgatctttgcgaggggaccactgtggtcgttgacgaacactgcggaaatcggggccccagtttgcgaacaaccacggtgactggtaaaattatccatgagtggtgttgcagaagctgtaccctgcctccattaaggtttcgcggggaggatggatgctggtacggcatggaaatacggcccgtaaaggagaaggaagagaacctcgtgaaatctatggtctccgcgggttcaggcgaagtggacagtttcagcctggggcttctgtgtatttcgatcatgatcgaggaggttatgagatccaggtggtctcgcaagatgttgatgacaggaaccctcgccgtgtttttcctgctaattatgggccagctgacttggaatgacctcatccgactgtgcattatggtcggggctaacgccagcgatcggatgggaatgggcacaacctatcttgcattgatggctacatttaaaatgcgtcctatgttcgccgtgggtctgttatttagaaggctcacttcacgcgaagttctgcttctgaccatagggctaagtctcgtggcatccgtcgagctgccaaattctttggaggaactgggagacggcttagccatgggcatcatgattctcaagctgcttacggatttccaaagccaccagctgtgggctacattgctctccctgacctttatcaaaactaccttctcactacattacgcgtggaagacaatggccatggtactgagcattgtgagtctttttcccctctgtctgtctactacctcccagaagacgacatggttgccggttctgttagggagcctcggatgcaaacctctgaccatgttccttatcgcagaaaacaagatatggggtcggaaatcgtggccactgaacgagggcatcatggctgtggggattgtctcaatcttgctctctagtctgctaaagaatgacgtgcccctggccggacctcttattgccggcggtatgctcatcgcttgttatgtaatatccgggagctctgcagatctgagcttggagaaagccgcggaagtgtcctgggaggaagaggctgaacactcaggagccagtcataacattttagtcgaggttcaggacgatggcactatgaagatcaaagacgaggaaagagatgacacactgaccatcctcctgaaggcaactcttctggccgtgagcggcgtgtaccccttgtctattccagctacactattcgtctggtatttttggcaaaagaaaaagcagaggtccggggtgctgtgggataccccttcacccccagaggttgaacgagcagtactcgacgatggaatataccgcatcatgcagcggggtctgcttggcagaagtcaggtgggggtcggagtgttccaagagaatgtttttcacacgatgtggcacgtgactaggggcgccgtcttaatgtatcagggtaaacgtctggagccgagctgggcgtccgtgaagaaagacctcatttcttacgggggaggctggcgcttgcagggctcgtggaacaccggggaagaggtacaggtcatcgctgtggaacctggaaagaatcccaagaacgttcaaacagccccaggtaccttcaaaacacccgagggcgaagtgggggcaattgccctggactttaagcctggaactagcggctcaccaatcgtcaatcgggagggtaaaatagtggggctctacggaaacggcgttgtgaccacgtccggcacatatgtcagtgctatcgcccaggcaaaggcttctcaggaggggcccctgcctgaaattgaggatgaagtgttcagaaaaaggaatcttactatcatggacctgcatccgggaagcggtaagacccgacggtacttgccagccattgtacgcgaggcgatcaagagaaaactaaggacactgatactcgcccccacccgggtggttgcatccgaaatggctgaggccttaaagggcatgcctattcgatatcaaactaccgctgtcaaatcagagcacacagggaaggaaatcgtggatctgatgtgccatgcaacgtttactatgagacttctgtctccagtgcgcgtccccaactacaatatgatcattatggacgaggcccacttcaccgatcctagcagtatcgccgctaggggatatatatccacacgtgtaggcatgggtgaagcggcagccatttttatgaccgctactccgcccgggagcgtggaggccttcccacagtctaacgcagttatccaggacgaggaacgggatattcctgagagatcatggaactccggatacgaatggatcacagactttcccggcaaaaccgtgtggttcgtcccaagtataaagagcggcaacgatattgccaattgtctcaggaagaacgggaaacgcgtgatccagttgtcgcgaaagacgttcgacactgagtatcaaaagactaagaacaatgattgggactacgttgtgaccaccgacatctctgaaatgggagctaactttagagcggatcgggtcattgaccctaggcgctgcctgaaacccgtgatcctcaaggatggtccagagcgtgtaattctggccggcccgatgcctgtgactgttgcatccgctgcccagagacgggggaggataggacgcaatcataacaaggagggcgaccagtacatctatatgggtcagccccttaataacgatgaagaccacgcacactggacagaggccaaaatgctactggataatattaacaccccagaagggatcatccccgctttgttcgagcctgaacgagaaaagagcgccgcgattgacggcgagtacagattacggggagaagcaaggaaaacatttgtcgagctgatgcgcagaggcgatctcccagtgtggctgtcatataaggtggccagtgaagggttccaatactctgacaggcggtggtgctttgatggagagcgtaataaccaggtccttgaagagaatatggacgttgagatatggactaaagaaggtgagcgcaagaaactgcgacccagatggctcgatgctaggacgtattccgaccctttggccctgcgggagttcaaggagtttgctgcaggccgcagaagcgtgtcaggggacctaatcctggaaattggaaagctcccgcagcatcttacccagagggcccaaaacgctctggataatttagtaatgttgcacaacagtgagcagggcggtcgggcctaccgacatgcactggaggaactcccagacacaatcgagactctgatgcttctggcgctcattgccgtgttgaccgggggcgtcacactgttctttttaagcggaagaggcctagggaaaacctccatcggactgctctgtgtgatggcttctagcgcccttctgtggatggcatccgttgaaccccactggatagctgcctcaatcattttggagttctttctgatggtgctcctgatccctgagcccgatcgccagaggactccacaggacaatcaacttgcatatgtcgtaattggtctcctgttcatgatcttgacggtggccgctaacgaaatgggcctgttagagaccacaaagaaagatctagggataggacacgttgcggtggaaaaccatcaccatgcctctatgctggacgtcgatctccaccctgcaagtgcttggactctttacgccgtggccaccacaattatcacccccatgatgcggcatactattgagaatacaacggcaaacatctcgctgaccgctatagccaatcaggcggctatcttgatgggcctggacaagggttggccaattagcaaaatggatatcggggtccctctcctggcccttggctgctactcccaggtgaacccgttaactctgacagcagccgttctcatgttggtggctcactatgcaattatcggacccggcctgcaagccaaggcgacccgtgaagctcagaagagaaccgccgcagggataatgaaaaatccaacagtagacggaattgtggccatcgatctagaccctgtcgtttacgatgctaagtttgagaaacagctgggccagatcatgctccttattctgtgtacttctcaaatcttgctgatgaggacgacctgggccctctgcgagtcaataacactggcaactggtcccttaaccacactttgggaagggagcccaggaaagttctggaacaccactattgctgtgtccatggccaatatcttccgcggcagttatctggcgggtgccggcctcgcattttctctaatgaaaagcctagggggcgggcggcgagggacgggagctcagggcgagacattgggtgaaaagtggaagagacagctgaaccagctctcaaaatccgagttcaatacctacaagaggagtgggattatggaagtcgaccgcagcgaggccaaagagggacttaagcggggcgaaactaccaaacacgcagtgtctagaggtacagctaagctgcgttggtttgtagagaggaacttggtgaagcctgaaggcaaagttatcgacctggggtgtggacggggcgggtggtcctattactgcgccggactcaagaaagtgactgaggtcaagggctataccaaaggtgggcccggacatgaggaaccgataccaatggccacatacggctggaatttagtgaagctgcactcaggcaaagatgtcttctttatccctcccgagaagtgtgacacgcttctgtgcgatattggggaaagctcgccaaaccccaccatcgaggaaggacgcactctacgagtgctcaagatggttgagccttggctgagaggtaatcaattctgtattaaaatcttgaacccgtacatgccctctgtagtggagacactggaacagatgcagaggaagcatggcgggatgctcgtccggaatccacttagtcgcaactccacccacgagatgtattgggtgagctgcggaactggcaatattgtttcagcggtgaacatgacatccagaatgctgttaaacaggtttaccatggctcaccgaaaacctacgtacgaacgggacgtcgatctgggtgcagggacccgtcatgtggccgtagagcccgaagtggctaatttggacatcataggacagagaattgagaacatcaagcacgagcataaatctacatggcactatgatgaagacaatccttacaagacttgggcctatcatggcagctacgaggttaagccaagtggctccgcaagctctatggtcaacggggtggtgaaactcctgaccaagccctgggatgtcatccctatggttacacaaattgccatgactgacaccacaccattcggacagcagcgcgtgtttaaagaaaaggtagataccaggactcccaaagctaagcggggtacggcgcaaataatggaggtgacagccagatggctatggggcttcctttcacgcaataagaaaccgaggatctgtacccgagaagagtttactcggaaggtcagaagtaacgcagctattggggccgtgttcgttgacgagaatcagtggaactccgcaaaagaagccgtggaggacgaaaggttttgggatctggtccaccgcgagcgtgaactccacaagcagggaaaatgcgctacctgcgtgtataatatgatgggcaagcgggagaagaaactgggtgagttcgggaaggccaaaggaagcagagcgatctggtacatgtggttgggcgcaaggttcctggaatttgaggccctcggcttcatgaacgaagaccattggttttctcgcgaaaattcgctttcaggggtagagggagaaggtctgcacaagttaggctacattctgcgagatatcagcaaaatacctgggggaaacatgtatgctgacgatacagccggctgggacacgcggatcaccgaggatgacttgcagaatgaagcaaagattactgatatcatggagccagaacatgctctcctggccaaatccattttcaagctaacataccaaaacaaggttgtgagagtccagaggcccgctaaaaatggtaccgtgatggacgtgatcagtcgcagagatcagcgggggtctggacaggtcggcacttatggccttaacacatttaccaacatggaggcccaactgataaggcagatggagagcgaagagattttctccccttcagaactcgagacaccaaatctggcagaacgtgttttggactggttagagaagtacggggtggagcgactgaaacgcatggcgatcagtggagatgactgtgtagtgaagcccatcgacgatagatttgccactgctctcaccgcccttaacgacatgggtaaagtccggaaggatattccgcagtgggaaccttctaagggctggaatgactggcagcaagtgcccttctgcagccaccactttcatcagctgataatgaaagatgggagggaggttgtggtcccatgtcgcaaccaggacgagctggtgggcagagcacgggtatcccagggcgctggttggtcactgagggagacggcctgcctcggaaagagctatgcacaaatgtggcagttgatgtacttccaccgacgtgatctgagacttgccgcgaatgctatctgttctgccgttcctgtggactgggtccccacctcccgcacaacttggagtattcatgcacaccatcagtggatgaccacagaagatatgctgagcgtgtggaaccgggtttggatcgaggagaatccatggatggaagacaaaactcacgtgtcgtcctgggaggatgtcccctatctcggaaagagggaagaccaatggtgcggctctttaattggcctgaccgccagagctacgtgggccacaaacatccaggtggcaataaatcaggtacgccggttgatcgggaacgagaattacctggactacatgacctcaatgaaaaggtttaagaacgagagcgatcctgaaggagctctctggtga

SEQ ID NO: 14241 - RNA, 9876 nt, synthetic construct
  misc_feature 1..9876: note = derived and/or modified CDS sequence (opt3) from DENV-1__KF672763__SS-prME
  source 1..9876: mol_type = other RNA
agcgtgaccatgctgctcatgcttctgccaactgcattggctttccacttaactacgagaggaggggagcctcatatgatcgtctccaagcaagaaaggggaaaatctctgctgtttaagacctcagccggtgttaacatgtgcacactcattgccatggacctgggcgagctttgtgaagatactatgacctacaaatgcccacggataaccgaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagaaggtggaaacttgggctctgaggcaccctggattcaccgttattgcactgtttctcgcccatgctatcggcacatcgattacccagaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggccaagaataagcccactctagatatcgaactcctgaaaacagaggtgaccaaccctgccgtgcttagaaagctgtgcattgaagctaaaatctccaatacgaccacagactctaggtgtccaactcaaggagaggccaccttggtcgaagaacaagatgcaaacttcgtttgccggcgcacatttgtggaccgaggctggggtaatgggtgtggactcttcggcaagggcagcctgttaacttgcgctaagtttaaatgcgtaaccaagctggaggggaaaatagtgcagtacgaaaacctcaagtattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaagaactggactagatttcaacgaaatggtcctgctcacaatgaaagaaaagagctggctggtgcataaacagtggtttcttgacctgccgttgccctggacgtctggcgcatccacctcacaagagacttggaataggcaggatctcctggtaacattcaagaccgctcacgccaagaaacaggaagttgtggtcttaggtagccaagagggggctatgcacacagccctgactggcgcaaccgaaatccagacgagtggaaccacaactatttttgccggccatctaaagtgccggctcaaaatggacaagctgacccttaaagggacatcttatgtgatgtgtactggatccttcaagttggagaaggaagtcgctgagacccagcacggtacggtgctggttcaggtgaaatacgagggcacagatgcgccttgcaagataccattcagcacccaagacgaaaaaggggtaactcagaacggacgtctcatcacagcaaatcccattgtcaccgataaggagaaacctgtgaacatcgaaactgagccaccctttggcgagtcgtatatagttgtgggtgtcggggaaaaggccctgaaactttcttggttcaaaaagggctcctcaattggaaaaatgtttgaggctaccgcccgcggcgcaagaaggatggccatcctgggggacacagcttgggatttcggaagtatcggtggcgtgtttacgagcgtagggaagttggtgcatcaggttttcggaaccgcctacggcgtcctcttttccggtgtgtcttggactatgaaaattgggatcggcattctgttaacatggctgggactaaatagccggtcaaccagtctctccatgacatgtatagcagtgggcatggtcactctgtaccttggggttatggtgcaggcggacagcggatgcgtgatcaactggaagggccgagaattgaagtgtggttctgggattttcgtaaccaacgaggtccacacgtggacagaacaatataaatttcaggctgattcaccgaagcgcctgagtgccgcaatcggacgagcatgggaggagggcgtgtgcggtatcaggagcgctacccggctcgaaaatattatgtggaaacagatatccaacgagctgaatcatatcttactggaaaacgacattaagttcactgttgtggtcggcaatgccgacgggatccttgcacagggcaaaaagatgattcgccctcaacccatggagcacaaatactcttggaagtcgtggggcaaggctaaaatcataggggccgatatccagaacaccacatttattatcgacggaccagatactcctgaatgtcccgacgagcagagagcgtggaatatttgggaggtggaagattatggcttcggtatctttaccacaaacatatggttgaagctcagggacagctacacgcagatgtgcgatcaccgtctgatgtccgccgctattaaagactcaaaggcagttcatgccgatatggggtattggatcgagagtgagaaaaatgagacctggaagctagctcgggcctctttcattgaagtgaagacttgtatctggccaaaaagccacacactgtggtccaacggagtactcgagtcagagatgataatccccaagatgtacggcggtcctattagccaacataattatcgaccaggctacttcacccagactgcagggccgtggcacctgggaaaacttgaattggactttgatctgtgcgagggcacaaccgtcgtggtggacgaacactgcgggtctagaggaccctccttaaggacgactaccgtcacaggcaagatcattcatgagtggtgttgccgcagttgtaccctccctccactgcggttcagaggtgaggatgggtgctggtacggaatggaaatcaggcccgttaaagagaaggaagagaaccttgtgcgcagcatggtatctgcgggctccggtgaagtggactcatttagtctgggcatattgtgtgtcagcattatgatcgaggaggtgatgcgatcgcggtggtcccgtaagatgctcatgactgggacactggccgttttcctactgctcatcatgggacagctgacctggaatgaccttattagattgtgcatcatggtgggcgctaacgcctctgataaaatggggatgggaacaacttatctggcattaatggctacctttaagatgaggcctatgttcgccgtcggcctcctgtttcgccggcttacgagcagagaagtgctgctactcacaattggtctgtcattgatggcaagtgttgagctgccaaattccttagaggaactcggggacggactggccatgggcataatgatgcttaaactgttgaccgagttccaaccccaccagctctggactaccctgctatctctgacatttatcaagactacccttagcctcgattacgcttggaaaacgacagcgatggtgctgtccattgtctcattgttcccgctgtgtttaagcaccacaagtcagaagacaacctggctccctgtactgcttggctcttttgggtgcaagccactgactatgttcttgatcacagagaacgagatttggggaaggaaatcctggcccctcaacgaaggtatcatggccataggcatcgtgagcattctgctatcgtcactgcttaagaatgacgttcctctcgcagggcccctgatcgctggaggcatgttgattgcctgttatgtgatctctggtagttccgccgatttaagcctggagaaagctgcagaagtctcttgggaggaagaggccgagcatagcgggacctcccacaacatactcgtggaagtacaggacgatggaacgatgaagattaaagacgaggaacgagatgacactctgaccatccttctgaaggcgacattgctagctgtgtcaggcgtctacccaatgagtatccctgccaccctgtttgtttggtatttctggcagaaaaagaagcagcgcagcggcgtgctctgggatacaccctctccaccggaggtggagcgggcagtcctggacgatgggatttacagaatacttcagaggggattactgggtcgttcccaggtgggcgttggggtattccaagacggagtgtttcatactatgtggcacgtcacccgcggcgccgtgctcatgtatcagggtaaacggttggaaccttcatgggctagtgttaagaaagacctgatcagctacgggggaggctggagattccagggctcctggaatacgggggaggaagtgcaggtcattgcagtggagcccggaaagaaccccaaaaatgtacaaacaactcccggtacctttaagacacctgaaggcgaggtcggggccatcgcgctcgatttcaagccaggaacctctggctcgcccattgtgaacagggagggtaaaatcgttgggctgtacggaaatggcgtggtcactaccagcggcacatatgtgtcagctatagcccaggcaaaggcctcccaggaagggcctcttccggagatcgaagacgaggtttttaaaaagcgaaacctgacgattatggatttgcacccaggaagtggtaaaactcggcgctacctacccgctatcgtgagagaagccattaagaggaagctgcggaccctcatcttagcacctacacgagtcgtggcttctgagatggccgaggcgctgaaaggcatgccaataagatatcaaaccactgccgtaaagagcgaacatacagggcgcgagattgtggaccttatgtgccacgcaaccttcacgatgaggctgctctcccccgttcgtgtccctaattacaacatgatcatcatggatgaagctcattttactgacccggcctcaattgctgcacggggatatatctctacaagagtgggcatgggtgaggccgccgctatattcatgaccgcgacacccccagggagcgtggaagcatttcctcagagtaatgccgtcattcaggatgaggagagggacatccccgaacgctcctggaacagcggatacgattggattactgacttcccaggcaaaacagtatggtttgtgccttctatcaagtcaggcaatgatatagctaactgtttgcggaaaaatgggaagagagttattcagctgtccagaaagaccttcgacacagagtatcagaaaactaagaacaacgactgggattacgtggtcacgaccgacatcagtgaaatgggagccaatttcagggcagatcgcgtgatcgacccccgtagatgcctcaaaccagttattctgaaggatggtccggagcgggtgatccttgccggccctatgcccgtcacagtggctagcgcggcccagaggcgcgggcgaattggaagaaaccagaataaagagggcgaccagtacgtatatatgggtcaaccactaaacaatgatgaagaccacgcacattggactgaggctaagatgctgttggataacataaatacccccgaagggatcattcctgccttatttgagccagaacgggagaagtcggcagccatcgacggcgagtacaggctgcgcggagaagctagaaaaacattcgtggagctcatgaggcggggcgatctgcccgtttggctttcttataaggtcgcctccgaagggtttcagtacagcgaccgtcgctggtgcttcgatggagagcgaaacaatcaggtgctggaagagaacatggacgtggagatctggaccaaagaaggtgagagaaagaaactcaggcctcggtggttggacgcgcgcacttattcagatccgctggcactaagagaatttaaggagttcgccgctggcaggcggagtgtctctggggacctgattctcgaaataggaaaacttccacagcacctgacgttacgagcccaaaatgctttggataacctggttatgctccacaattccgagcagggcggtaaggcatacagacatgccatggaggaactgcccgacaccatcgagacacttatgctgctcgctttgattgccgtgctgactgggggcgtaaccttatttttcctaagcggaaagggcctggggaaaacatcaatcggactcctttgtgtgaccgcaagtagcgcgctgttgtggatggcctccgtcgaacctcactggattgctgcctctatcatactggagtttttcctcatggtgctgcttatccccgagccagatcgccagaggactcctcaggacaaccaactcgcatatgttgtgattggtctgttgtttatgatcctgacagtcgctgccaatgaaatgggcttactagagacgaccaagaaagatctggggattggacatgtagcagccgaaaaccaccagcacgctactatgctcgacgtggatcttcatcccgcgagcgcctggacactgtacgcagttgctaccaccgtgatcacaccaatgatgcggcacactatagagaacacgaccgccaatatttccttgacagccatcgcaaaccaggctgccattctgatgggcctcgacaagggttggcctatctcaaaaatggatctgggggtcccgcttttagcgctgggctgctactctcaagtgaatcccctcactttgaccgctgccgtcctgatgctagtggcacattatgccataatcggaccaggcctgcaggctaaggcaacacgtgaagcccagaagagaaccgcggctgggattatgaaaaaccctactatcgacggaattgttgccatcgatctcgaccccgtggtatacgacgcaaagttcgagaaacagcttggccaaataatgctgttgattctgtgtacgagtcagatcctcctgatgaggacaacctgggccttatgcgagtcgatcactcttgctaccggtccactgacaactctctgggaagggagccctggaaagttttggaataccacaattgccgtgtccatggcaaacatcttccgcggctcttatctagctggtgccggcctggcgttctcattgatgaaaagcctagggggaggccggcgagggacgggagcccagggcgagaccctcggtgaaaagtggaagagacagcttaatcaactgtccaaaagtgagtttaacacttacaagaggtctgggataatggaagtcgatcgcagcgaggcaaaagagggattgaagcggggcgaaacaaccaaacacgctgtttcaagaggtactgccaagctgcgttggttcgtggagaggaatctcgtcaagcccgaaggcaaagtgattgacttagggtgtggacggggcgggtggtcctattactgcgcaggactgaagaaagtaacagaggtgaagggctataccaaaggtgggccgggacatgaagaaccaatccctatggctacgtacggctggaaccttgttaagctgcacagtggcaaagatgtgtttttcatgcccccagagaagtgtgacaccctactctgcgatattggggaaagctctcccaatcctacaatcgaggaaggacgcactctgcgagtcttgaagatggtggagccgtggctgagaggtaaccagttttgtataaaaatcctcaatccctacatgccatccgtcgtggagacccttgaacagatgcagaggaagcacggcgggatgctggttcggaaccctttatcacgcaatagcacacatgagatgtattgggtatcgtgcggaactggcaacattgtgtctgccgtcaatatgaccagtagaatgctgttgaacaggttcacaatggcccaccgaaaacccacctacgaacgggacgtggatctcggtgcggggactcgtcatgttgctgtggagcctgaagtcgcaaacctggacatcattggacaaagaatcgagaatattaagaacgagcacaaatccacgtggcactatgatgaagacaatccatacaagacatgggcctatcatggcagctacgaggtgaagccctcaggctccgcttctagcatggtaaacggggtggttcgcctacttaccaaaccttgggatgtcatcccaatggtgactcagatagccatgaccgacacaacgccctttggacagcaaagggtgttcaaggaaaaagtcgacacccggactccgagagcaaagcgcggtacagcccagattatggaggttaccgctaaatggctgtggggctttctcagtaggaataagaagcctcgaatctgtactcgggaagagttcacaagaaaagtgaggtccaacgcggccatcggggcagtatttgtggatgagaatcagtggaacagcgctaaggaagccgtcgaggacgaacgcttctgggatctggtgcaccgtgagcgggaattgcataaacagggaaagtgcgcaacctgcgtttataatatgatgggcaaaagagagaagaagctgggtgagtttgggaaagccaagggatctagggctatttggtacatgtggctcggcgcccgcttccttgagttcgaggcgctgggctttatgaacgaagaccactggttctcacgagagaatagtttatccggggtggagggagaaggtctgcataaattgggctacatactccgggatatcagcaagattccagggggaaacatgtatgcagacgatacagccggctgggacactagaatcaccgaggatgacctgaggaatgaagctaaaattacggatatcatggagcccgaacacgccctacttgcaacctctatatttaagctgacataccaaaacaaagtcgtgcgcgtacagagacctgctaagaatggtactgttatggacgtgatctcgcggagggatcagcgtgggtcaggacaggtcggcacctatggcctcaacacattcactaacatggaggtgcaactgattcgacagatggagagcgaagggatctttttcccatccgagttggaaagtcccaatttagccgagcgcgtgctggactggctcgaaaagcacggagctgagagacttaaacggatggccatttctggtgacgattgtgtcgttaagccgatcgacgataggtttgcaaccgcgctgatagccctaaacgacatgggcaaagtgcgcaaggatattcctcagtgggagcccagcaaagggtggaatgactggcagcaagtaccattctgctcccatcactttcatcagctgatcatgaaggatggaagagaaatcgtggtcccttgtcggaaccaggacgagctcgtgggcagggctcgagtttcacagggtgccgggtggagtttgcgtgaaacggcatgcctgggaaagtcttacgctcaaatgtggcagcttatgtatttccacagacgcgatctgcggctcgccgcaaatgccatttgtagcgcggtgcccgtcgactgggtgccaacatccaggaccacttggtcaatacacgctcatcaccagtggatgacaaccgaggatatgttaagcgtatggaacagagtttggatcgaagagaatccctggatggaggacaaaactcatgtgtcttcctgggaagaggtcccttacctgggcaagcgcgaagaccaatggtgcggcagtttgattgggctgaccgcccgggcaacatgggccacgaacatccaggtggctattaatcaggttaggcgactcatcggaaacgagaattatcttgattacatgaccagcatgaaaagatttaagaacgagtcggacccagaaggtgccctgtgg

SEQ ID NO: 14242 - RNA, 9876 nt, synthetic construct
  misc_feature 1..9876: note = derived and/or modified CDS sequence (opt3) from DENV-1__KF672764__SS-prME
  source 1..9876: mol_type = other RNA
agcgtgaccatgctgctcatgcttctgcccacagcattggctttccacttaactacgagaggaggggaacctcatatgatcgtctccaagcaggaaaggggaaaatctctgctgtttaagacctcagccggtgttaacatgtgcacactcattgcaatggacctgggagaactttgtgaagatactatgacctacaaatgcccacggataacagaagcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagaaggtggaaacttgggctctgaggcaccctggattcaccgttattgcactgtttctcgcccatgctatcggcacatcgattacccagaagggcatcattttcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggccaagaataagcccactctagatatcgaactcctgaaaacagaggtgaccaaccctgccgtgcttagaaagctgtgcattgaagctaaaatctccaatacgaccacagactctaggtgtccaactcaaggagaggccaccttggtcgaagaacaagatgcaaacttcgtttgccggcgcacatttgtggaccgaggctggggtaatgggtgtggactcttcggcaagggcagcctgttaacttgcgctaagtttaaatgcgtaaccaagctggaggggaaaatagtgcagtacgaaaacctcaagtattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaagaactggactagatttcaacgaaatggtcctgctcacaatgaaagaaaagagctggctggtgcataaacagtggtttcttgacctgccgttgccctggacgtctggcgcatccacctcacaagagacttggaataggcaggatctcctggtaacattcaagaccgctcacgccaagaaacaggaagttgtggtcttaggtagccaagagggggctatgcacacagccctgactggcgcaaccgaaatccagacgagtggaaccacaactatttttgccggccatctaaagtgccggctcaaaatggacaagctgacccttaaagggacatcttatgtgatgtgtactggatccttcaagttggagaaggaagtcgctgagacccagcacggtacggtgctggttcaggtgaaatacgagggcacagatgcgccttgcaagataccattcagcacccaagacgaaaaaggggtaactcagaacggacgtctcatcacagcaaatcccattgtcaccgataaggagaaacctgtgaacatcgaaactgagccaccctttggcgagtcgtatatagttgtgggtgccggggaaaaggctctgaaactttcttggttcaaaaagggctcctcaattggaaaaatgtttgaggccaccgcacgcggcgccagaaggatggctatcctgggggacacagcctgggatttcggaagtatcggtggcgtctttacgagcgtggggaagttggtacatcaggtgttcggaaccgcatacggcgttctcttttccggtgtctcttggactatgaaaattgggatcggcattctgttaacatggctgggactaaatagccggtcaaccagtctctccatgacatgtatagcggtgggcatggtgactctgtaccttggggtcatggttcaggctgacagcggatgcgtgatcaactggaagggccgagaattgaagtgtggttctgggattttcgtgaccaacgaggtacacacgtggacagaacaatataaatttcaggccgattcaccgaagcgcctgagtgcagccatcggcagagcttgggaggagggcgtctgcggtatcaggagcgccacccggctcgaaaatattatgtggaaacagatatccaacgagctgaatcatatcttactggaaaacgacattaagttcactgtggttgtgggcaatgcaaacgggatccttacccagggcaagaagatgattcgccctcaacccatggagcacaaatactcttggaagtcgtggggcaaggctaaaatcataggggccgacatccagaatacaacttttattatcgatggaccagacacccctgaatgtcccgatgagcagagagcgtggaacatttgggaggtcgaagactatggcttcggtatctttacaacgaatatatggttgaagctcagggatagctacacccagatgtgcgaccaccgtctgatgtccgccgctattaaagattcaaaggcagtgcatgccgacatggggtattggatcgagagtgagaagaatgagacttggaagctagctcgggcctctttcattgaagttaagacatgtatctggccaaaaagccacaccctgtggtccaatggagtgctcgagtcagagatgataatccccaagatgtacggcggtcctattagccaacataactatcgaccaggctacttcactcagacagcagggccgtggcacctgggaaaacttgaattggattttgacctgtgcgagggcaccacggtagtcgtggatgaacactgcgggtctagaggaccctccttaaggactaccacagtgaccggcaagatcattcatgagtggtgttgccgcagttgtactctccctccactgcggttcagaggtgaggacgggtgctggtacggaatggaaatcaggcccgtcaaagagaaggaagagaatcttgttaagagcatggtgtctgcgggctccggtgaagtagattcatttagtctgggcatattgtgtgtgagcattatgatcgaggaggtcatgcgctcgcgatggtcccggaaaatgctcatgacagggaccctggccgtgttcctactgctcatcatgggacagctgacatggaacgaccttattcgtttgtgcatcatggttggcgctaatgcctctgacaagatggggatgggaactacctatctggcattaatggctacgtttaaaatgagacctatgttcgccgtgggcctcctgtttaggcgccttacaagccgggaagtcctgctactcaccattggtctgtcattggtggcaagtgttgagctgccaaactccttagaggaactcggggatggactggccatgggcataatgatgcttaagctgttgactgagttccaaccccaccagctctggaccacactgctatctctgacttttatcaaaaccacgcttagcctcgactacgcttggaagacaaccgcgatggtgctgtccattgtctcattgttcccgctgtgtttaagcactacaagtcagaagaccacttggctccctgtactgcttggctcttttgggtgcaaaccactgacaatgttcttgatcaccgagaacaagatttggggaagaaaatcctggcccctcaatgagggtatcatggccataggcatcgtgagcattctgctatcgtcactgcttaagaacgatgttcctctcgcagggcccctgatcgctggaggcatgttgattgcctgttatgtgatctctggtagttccgccgacttaagcctggaaaaagctgcagaggtctcttgggaagaggaagccgagcatagcgggacgtcccacaatatactcgtggaggtacaggatgacggaactatgaagattaaagatgaagagagggacgataccctgacaatccttctgaaggcgaccttgctagctgtgtcaggcgtctacccaatgagtatccctgccacactgtttgtttggtatttctggcaaaagaaaaagcagcgaagcggcgtgctctgggacactccctctccaccggaagtggagcgcgcagtcctggatgacgggatttaccggatacttcagagaggattactgggtaggtcccaggtgggcgttggggtattccaagatggagtgtttcataccatgtggcacgtcacgcgtggcgccgtgctcatgtatcagggtaaacgcttggagccttcatgggctagtgttaagaaagacctgatcagctacgggggaggctggcggttccagggctcctggaacacaggggaagaggtgcaggtcattgcagtggaacccggaaagaatccaaagaacgtacaaactacccccggtacatttaaaacccctgagggcgaagtcggggccatcgcgctcgacttcaagccaggaacttctggctcgcccattgtgaatagagagggtaaaatcgttgggctgtacggaaacggcgtggtcaccacaagcggcacgtatgtgtcagctatagcccaggcaaaggcctcccaggaggggcctcttccggaaatcgaggatgaagtttttaaaaagaggaatctgactattatggacttgcacccaggaagtggtaagacccgacggtacctacccgctatcgtgcgcgaggccattaaaagaaagctgaggacactcatcttagcacctacccgggtcgtggcttctgaaatggccgaggcgctgaaaggcatgccaatacgatatcaaactacagccgtaaagagcgagcataccgggagagaaattgtggatcttatgtgccacgcaacgttcactatgcgcctgctctcccccgttagggtccctaactacaatatgatcatcatggacgaggctcattttacagatccggcctcaattgctgcacgtggatatatctctacccgggtgggcatgggtgaagccgccgctatattcatgaccgcgactcccccagggagcgtggaggcatttcctcagagtaacgccgtcattcaggacgaagagagagatatccccgagaggtcctggaatagcggatacgactggattacagatttcccaggcaaaaccgtatggtttgtgccttctatcaagtcaggcaacgacatagctaattgtttgcgcaagaacgggaaacgagttattcagctgtccagaaagacattcgatactgaatatcagaaaacgaagaacaatgactgggactacgtggtcaccacagatatcagtgagatgggagccaacttccgggcagacagggtgatcgatccccgccgttgcctcaaaccagttattctgaaggacggtccggaaagagtgatccttgccggccctatgcccgtcactgtggctagcgcggcccagcggagggggcgcattggacgaaatcagaacaaggagggcgatcagtacgtatatatgggtcaaccactaaataacgacgaggatcacgcacattggaccgaagctaaaatgctgttggacaatataaacacacccgaggggatcattcctgccttatttgaaccagagagagaaaagtcggcagccatcgatggcgagtaccggctgaggggagaggctcgcaaaaccttcgtggaactcatgagaaggggcgacctgcccgtttggctttcttataaggtcgcctccgaggggtttcagtacagcgatcggcgttggtgcttcgacggagaacgcaataaccaggtgctggaggaaaatatggatgtggagatctggactaaagagggtgaacgaaagaaactcagacctaggtggttggacgcgcggacgtattcagacccgctggcactacgcgagtttaaggagttcgccgctggcagaaggagtgtctctggggatctgattctcgagataggaaaacttccacagcacctgaccttacgggcccaaaacgctttggacaatctggttatgctccacaactccgaacagggcggtaaagcataccgacatgccatggaggagctgcccgatacaatcgaaactcttatgctgctcgctttgattgccgtgctgaccgggggcgtaacattatttttcctaagcggaaagggcctggggaaaacctcaatcggactcctttgtgtgactgcaagtagcgcgctgttgtggatggcctccgtcgagcctcactggattgctgcctctatcatactggaatttttcctcatggtgctgcttatccccgagccagacagacagcgcacacctcaggataatcaactcgcatatgttgtgattggtctgttgtttatgatcctgacggtcgctgccaacgagatgggcttactagaaaccactaagaaagacctggggattggacatgtagcagccgagaaccaccagcacgctacaatgctcgatgtggaccttcatcccgcgagcgcctggaccctgtacgcagttgctaccacagtgatcactccaatgatgaggcacacgatagaaaataccacagccaacatttccttgactgccatcgcaaatcaggctgccattctgatgggcctcgataagggttggcctatctcaaagatggacctgggggtcccgcttttagcgctgggctgctactctcaagtgaaccccctcaccttgacagctgccgtcctgatgctagtggcacattatgccataatcggaccaggcctgcaggctaaagcaacccgggaggcccagaagcgtactgcggctgggattatgaaaaatcctacggttgatggaatcgtggccattgacctcgatcccgtagtgtacgacgcaaagttcgaaaaacagcttggccaaatcatgctgttgatactgtgtacaagtcagattctcctgatgagaaccacttgggccttatgcgagtcgatcacccttgctacaggtccactgactaccctctgggaggggagccctggaaagttttggaacacaacgatcgccgtctccatggcaaatattttcaggggctcttatctagctggtgccggcctggcgttctcattgatgaaaagcctagggggaggccgccgggggaccggagcccagggcgaaactctcggtgagaaatggaagcgacagcttaaccaactgtccaaaagtgaatttaatacatacaagagatctgggatcatggaggttgacaggaccgaagcaaaagagggattgaagcgcggcgagactacaaagcacgctgtgagccggggtaccgccaaactgagatggttcgtcgaacgtaacctcgtgaagcccgagggcaaagtaatagatttagggtgtggaaggggcgggtggtcatattactgcgcaggactgaagaaagtgacggaagttaagggctataccaaaggtgggccgggacatgaggaaccaattcctatggctacatacggctggaatcttgtgaagctgcactccggcaaggacgtctttttcatgcccccagagaaatgtgatactctactctgcgacatcggggagagtagccccaaccctaccattgaagagggacggacactgcgcgtgttgaagatggtcgaaccgtggctgcgaggtaatcagttttgtatcaaaatactcaacccctacatgccatctgtggttgagactcttgagcagatgcagagaaagcacggcgggatgctggtaaggaatcctttatcccggaactcaacccatgaaatgtattgggtgagctgcggaacaggcaatatcgtctcggccgtgaacatgacctctcgcatgctgttgaacagattcactatggcccacaggaaacccacgtacgagcgagatgttgacctcggtgcggggacacggcatgtggctgtcgaacctgaggtggcaaatctggatattatcggacaacgtattgaaaacatcaagaatgagcacaagagtacctggcactatgacgaggataacccatacaaaacttgggcctatcatggctcctacgaagtaaagcccagcggctcagcttcctctatggtgaatggggttgtcagactacttaccaaaccttgggacgtgattccaatggtgacacagatcgccatgacggataccactccctttggacagcaacgcgtcttcaaggagaaagttgacacaaggaccccgcgggcaaagagaggtactgcccagataatggaagtgacagctaagtggctgtggggctttctcagccgcaacaaaaagcctaggatttgtacccgagaggagttcacacggaaagtaagaagtaatgcggccatcggggcagtgtttgtcgacgagaaccagtggaactccgctaaggaggccgtggaagatgagaggttctgggacctggttcaccgcgaacgtgagttgcataaacagggaaagtgcgcaacttgcgtgtataacatgatgggcaagcgggagaaaaagctgggtgagtttgggaaagccaagggaagcagagctatctggtacatgtggctcggcgccaggttccttgagttcgaagcgctgggctttatgaatgaggatcactggttctctcgcgaaaactcattaagtggggtcgagggagagggtctgcataaattgggctacattctccgagacatatccaagatcccagggggaaatatgtatgcagatgacaccgccggctgggatacgcggattaccgaagacgatctgcaaaacgaggctaaaatcacagacattatggaacccgagcacgccctacttgcaactagcatctttaagctgacctaccagaataaggtggtaagagttcagaggcctgctaaaaacggtacagtgatggatgtcatatctcgcagagaccagcgggggtcgggacaagtgggcacttatggcctcaacaccttcacgaatatggaagtgcagctgatcaggcagatggagtcagaggggatatttttcccaagcgaattggagtcccccaacttagccgaacgtgtcctggattggctcgagaagcacggagctgaacgacttaaacgcatggccatcagtggtgacgactgtgttgtgaagccgattgatgacagatttgcaacagcgctgatcgccctaaatgatatgggcaaagtacggaaggacatacctcagtgggagccctctaaggggtggaacgattggcaacaggtgccattctgcagccatcactttcatcagctgattatgaaagacggaagggagatcgtcgtgccttgtcgcaatcaggatgaactcgttggcagagctcgggtgtcccaaggtgccgggtggtcattgagggagaccgcatgcctgggaaagagttacgctcagatgtggcagcttatgtatttccaccgacgtgacctgagactcgccgcaaacgccatctgttctgcggtccccgtggattgggtaccaactagccgcacaacctggtccattcacgctcatcaccaatggatgactaccgaagacatgttatcagtttggaatcgggtgtggatagaggaaaacccctggatggaggataaaacacatgtcagctcttgggaggaagtgccttacctgggcaagagggaggaccagtggtgcggctccttgatcgggctgacggccagagcaacctgggccactaatattcaggttgctatcaaccaggtgcgccggctcattggaaatgaaaactatcttgactacatgacaagtatgaaaaggtttaagaatgagagcgatccagagggtgccctgtgg

SEQ ID NO: 14243 - RNA, 9879 nt, synthetic construct
  misc_feature 1..9879: note = derived and/or modified CDS sequence (opt3) from DENV-1__EU863650__SS-prME
  source 1..9879: mol_type = other RNA
agcgtgaccatgctgctcatgcttctgcccactgtattgactttccacttaacgaccagaggaggggagcctcatatgatcgtttccaagcaggaaaggggaaaatctctgttatttaagacctcagccggtgtgaatatgtgcactctcattgctatggacctgggcgagctttgtgatgacaccatgacatacaaatgcccacggataaccgaaactgagccggatgacgtagattgttggtgcaatgcaacagaaacctgggtgacgtatgggacttgtagtcaaaccggagagcaccgccgagacaagcgttccgtcgccctggcgccccatgtgggcttgggtctcgagacaagaactgaaacctggatgtcctctgagggggcttggaggcagatccagaaagttgaaacatgggccctgcggcaccctggattcaccgtgattgcactgtttctcgcccatgctatcggcacgtcgattactcagaagggcatcatattcatcttactgatgcttgtcacaccatcaatggcaatgcgctgcgtggggattggaaacagagattttgtagagggtttgagcggcgccacctgggttgacgtggtcctggagcacgggagttgtgtgactacaatggctaaggataaacccaccctggacatcgaactcctgaagacggaggtgaccaatcctgccgtccttaggaaactgtgcattgaagcgaagatctccaacacaactaccgattctcggtgtccaacacaaggagaggcaactttggttgaagaacaagacaccaatttcgtgtgccgccgaacatttgtagatagaggctggggtaacgggtgtggactcttcggcaaaggcagcctgataacctgcgccaagtttaagtgcgtgactaaattagaggggaagattgtccagtacgaaaatctgaaatattccgtgatcgttacggtgcacacaggagaccagcatcaagtcggtaacgagaccactgaacacggcaccattgctacaatcacaccccaggcccctacttcagagatccagctcacagactacggggcacttacgctggattgtagtccaaggaccggattggacttcaatgaaatggtgctactgactatgaaggagaaaagctggctcgtacataagcagtggtttctggatcttccgctgccctggacatctggcgcttccacctcacaagagacatggaaccggcaggacttgctcgttactttcaaaaccgcccacgcgaagaagcaggaagtggtcgtgctgggtagccaagagggggccatgcacacggcattaaccggcgctacagaaattcagacaagtggaaccacaactatatttgccggccatctgaaatgccgtctaaagatggataaactcaccctgaaggggatctcttatgtcatgtgtacgggacttttcaaattggagaaggaagtggctgagacacagcacggtaccgttctggtgcaggtaaagtacgagggcactgacgccccttgcaaaattccattctccagccaagatgaaaagggggcaacacagaatggacgcctcgtcaccgccaaccccatcgtgactgacaaagagaagcctgttaatatagaagctgagccaccctttggcgagtcgtatattgtggtcggtgcgggggaaaaagcactgaaactttcttggttcaagaaaggctcctcaatcggaaagatgtttgaggccaccgctagaggcgccaggcggatggcaatcctgggggatacagcctgggacttcggaagtattggtggcgtgtttacgagcgtagggaaattggtgcatcagatcttcggaaccgcttacggcgttctcttttccggtgtctcttggactatgaagattgggataggcatcctgttaacatggctgggactaaacagccgatcaaccagtctctccatgacatgtattgccgtgggcatggtgactctgtaccttggggtcatggttcaggcagatagcggatgcgtgatcaattggaaaggccgcgaattgaagtgtggttctgggatcttcgtgaccaacgaggtacacacgtggacagaacaatataagtttcaggcggactcaccgaaaagactgagtgctgccattggaaaggcatgggaggagggcgtctgcggtataaggagcgccacccggctcgaaaacatcatgtggaaacagatttccaatgagctgaaccatatcttactggaaaatgacatgaagttcactgtggttgtgggcgatgtctctgggattcttgctcagggcaagaagaccatccgccctcaacccatggagcacaaatactcgtggaaaagctggggcaaggccaaaataatcggggcagacgtgcagaacacaacttttattatcgatggaccaaatacccctgaatgtcccgacgatcagagagcttggaacatttgggaggttgaggactatggcttcggtatctttacaacgaatatatggttgaagctcagggattcctacacccaggtgtgcgaccaccgtctgatgtcagccgcgattaaagatagtaaggccgtacatgctgacatggggtattggatcgaatctgagaaaaacgaaacttggaagctagcacgggccagcttcattgaggtcaagacatgtgtgtggccaaaatcccacaccctgtggtcacatggagtgctcgaaagcgagatgatcatacccaagatctacggcggtcctatttctcaacacaattatcgaccaggctacttcactcagacagctgggccgtggcacctgggaaaacttgagttggattttgacctgtgcgaaggcaccacggtcgttgtggatgagcattgcgggaacagaggaccctccttaaggactaccacagtaaccggcaagatcattcacgaatggtgttgccgcagttgtactctccctccactgcggttcaaaggtgaggacgggtgctggtacggaatggagatcagacccgtgaaggaaaaggaggaaaatcttgtcaaaagcatggtgtctgccggctccggtgaggttgactcatttagtctgggcttgctctgtataagcattatgatcgaagaggtgatgaggtcgcgctggtcccgaaagatgctgatgacagggaccctagtcgtgttcctgctcctgacacttggacagttgacttggaacgatctgatccggttatgcattatggttggcgcaaatgcgtctgacaacatggggatgggaaccacgtatctcgccctgatggctacatttcgtatgagacctatgttcgccgtgggccttctgtttaggcgcctaaccagccgggaggtcctcctgttgactgtaggtctgtcattagtggcaagtgttgaactcccaaattccctggatgagcttggggacggactggctatgggcatcatgattttgaaactcctgaccgatttccaatctcatcagctatgggccacactgcttagcctcacttttgtgaagaccacgctgtccttgcactacgcatggaaaacaatggccatgatactgtcaatcgtcagcttactccccctgtgtcttagtaccacttctcagaagacaacctggctgccggtgttgctcggctccctggggtgcaagcctctaactatgttcctgattacagaaaacaaaatctggggaagaaagagctggccacttaacgagggtattatggctgtaggcatcgtgtcgatactcctgtcatctttgctaaagaatgacgtccccctggcggggcctctcatcgccggaggcatgctgattgcatgttatgttatcagtggttccagcgctgatctttctctggaaaaggccgccaaagtgagctgggaggaggaagctgagcattccggggcatcacacaacattttggtggaaatccaggacgatggaaccatgaagataaaagacgaggaaagggatgacacgattactatcctactgaaggccaccctcctggcgatcagtggcgtctaccccatgagcattccagctacactttttgtgtggcacttctggcaaaagaaaaagcagcgatctggcgttttatgggataccccttcacccccagaggtagagaaagccgtgctggacgacgggatatatcgcatcctccagcggggattgctgggtagaagccaggtcggcgtgggggtttttcaagaaggagtgttccatacaatgtggcacgtcactaggggcgcagtgctcatgtaccagggtaagcgtctggagccgagttgggccagcgtcaaaaaggatcttatttcctatgggggaggctggcgcttccagggctcttggaataccggggaagaggtccaggtgatcgctgttgagcctggaaagaaccccaaaaatgtgcaaacggcaccaggtacatttaagacttcggaaggcgaggtcggggccattgcgctggacttcaaacccggaaccagcggctcacctatcgtgaaccgggaaggtaagatagttgggttgtacggaaatggcgtggtcacaacctccggcacttacgtgagtgctatcgcccaggcaaaagcctctcaggaggggccactacccgaaattgaggatgaggtatttagaaagaggaacctgaccatcatggacctccatcctggaagcggtaagacacgacggtatttaccggctattgtgcgcgaagccatcaaaagaaagctgaggacgcttgttctggcaccaactcgggtcgtggcttccgagatggccgaagcgctcaaaggcatgcccatacgataccaaaccacagccgtgaagtcagagcacaccgggaaagaaattgtcgatttgatgtgccatgcaactttcacaatgagactgctctctcctgtacgcgtgccaaattataacatgatcatcatggacgaggctcactttaccgatcccgccagcattgctgcaaggggatacatcagtacgcgtgttggcatgggtgaggccgccgctatattcatgactgcgacacctccggggtccgtggaagcatttccccagagcaatgccgtcattcaggacgaggaaaaggatatcccagagcggtcttggaactcaggatatgactggattaccgatttccctggcaagaccgtgtggtttgttccctccatcaaaagtggcaatgacatagctaactgtctgagaaagaatgggaaaagggtgattcagcttagccgcaagactttcgacacagaataccagaaaaccaagaacaacgattgggactatgtcgtgacaactgatatctcggagatgggagccaattttcgagcagacagagtaatcgatccacggaggtgcctaaagcctgtgattctgaaagacggtcccgagcgcgttatcttggccggcccaatgccggtcacggtggcttctgcggcccagcgtagagggcggattggaaggaaccagaataaggaaggcgatcagtacatatacatgggtcaacctttaaacaatgacgaggatcacgcacattggaccgaagctaaaatgctgctcgacaacatcaatacacccgaggggattatcccagccctgttcgagcccgaacgcgagaagtccgcagccatcgatggcgaatatcgacttagaggagaggctcggaaaactttcgtggaactgatgaggcgcggcgacctccctgtctggttgagctacaaggttgcctcagaggggtttcagtatagtgatagaaggtggtgcttcgacggagagcggaacaatcaggtgctggaagagaacatggacgtagaaatttggaccaaagagggtgaacgtaagaagctacgcccacgatggctggatgcgagaacatactctgaccccctcgcacttagggagtttaaagagttcgccgctggccggcgctccgtgagcggggatctgatattagaaatcggaaagttgcctcagcacctgacccaaagagcccagaaagctctcgacaatctggtcatgcttcataactcagagcagggcggtaaggcatataggcacgccatggaggaactgccggatactattgaaacgatcatgctcttggctctgattgccgtgttaaccgggggcgttacactatttttcctgagtggacggggcctcgggaaaactagcatcggacttctgtgtgtgacctcctctagcgcattgctgtggatggcgtccgtcgagccacactggatagccgcttcaatcattctcgagtttttcctgatggtacttctcatccccgaacctgaccgacagagaacaccccaagataatcagctggcctacgtggttattggtttgctgtttatgatcttaaccgtggcagctactgagatgggcctactggaaacaacgaagaaggacctcgggataggacatgccgcagccgagaaccaccatcacgctgcgatgcttgatgtcgacctgcatccagcctctgcatggaccttgtatgctgtggccactacaattatcacccctatgatgcgccacaccattgagaatacaactgccaacatcagtctgacggcaatagctaaccaggccgcgatcctcatgggcctggataaaggttggcccatttcgaagatggacatcggggtcccacttttagctctgggctgctacagccaagtgaatcctctcaccttgacagccgcagttctgatgctagtggcccactacgctattatcggaccgggcctgcaggcaaaagccactagggaagcgcagaagcggaccgctgccgggataatgaaaaaccccacagtagatggaattgtggcaatcgacctcgacccagtcgtttatgatgccaagttcgagaagcagcttggccaaatcatgctgttgattctgtgtacctcccagatcctcctgatgcgtactacgtgggctttatgcgaatctataacacttgccaccggtcctctgactaccctctgggaggggtcacccggaaaattttggaatacaactattgcagtgagcatggctaacatcttcagaggctcctacctagccggtgcgggcctggcctttagtttgatgaagtctctagggggaggcaggcgcgggaccggagcacagggcgaaacactcggtgagaaatggaagcggcagcttaatcaactgagcaaatcagagttcaagacgtataagcgatccgggattatcgaagtcgacagaagtgaggctaaagaaggattgaagaggggcgagaccactaaacatgccgtgagccgcggtacagcaaagctgcggtggttcgtagaaagaaacctcgtgaaaccagagggcaaggttatagatttagggtgtggacgtggcgggtggtcttactattgcgctggactgaaaaaggtgaccgaggtcaagggctccactaaaggtgggcctggacacgaggagcccatcccgatggccacatacggctggaatcttgtgaagctgcattcaggcaaagacgtctttttcattccacctgaaaagtgtgataccctactctgcgacatcggggagagctcgcccaacccaacgattgaagagggaaggaccctgcgggtgttgaaaatggttgagccctggctgcgcggtaatcagttttgtatcaagattctcaacccttatatgccgtctgtagtggaaacacttgagcagatgcagcgaaagcacggcgggatgctggtcagaaatcccttaagtaggaactccactcacgaaatgtactgggtgagctgcggaaccggcaatatcgtttcagccgtgaacatgacatcccggatgctgttgaatcgcttcactatggcgcatagaaaaccaacctacgagagggatgtcgacctcggtgctgggacacgacacgtggcagtagagcctgaagtggccaacctggatataattggacaacggatcgagaatatcaagaacgaacataaatctacctggcactatgacgaggataacccctacaagacttgggcttatcatggcagctacgaagttaaacctagtggctccgccagctctatggtcaatggggtggtgcgtctacttacgaagccatgggacgtcattcccatggttacacagatagcaatgaccgacactaccccttttggacagcaaagagtgttcaaggagaaagtagatacacgcacgccaaaggccaaaaggggtaccgctcagatcatggaggtgactgcgaagtggctgtggggctttctctcacggaacaaaaagcccagaatttgtacacgcgaagagttcaccaggaaggtccgaagtaatgccgcaatcggggctgtgtttgttgacgaaaaccagtggaactccccgaaagaggccgtggaagatgagcggttctgggacctggtccacagagagagggaattgcacaagcagggaaaatgcgcaacttgcgtgtataacatgatgggcaagcgcgagaaaaagctgggtgaatttgggaaagccaagggaagccgtgctatttggtacatgtggctcggcgcccggttccttgagtttgaagcgctgggcttcatgaatgaggatcattggttctctagagagaactcgttatcaggggtagaaggagagggtctgcacaagttgggctatatcctcagggacataagcaaaatccctgggggaaatatgtacgcagatgacacagccggctgggatacccgcattacagaagacgatctgcaaaacgaggctaagatcactgacattatggagccagaacatgccctacttgcaacctccatctttaaactgacgtaccagaataaggttgtgcgagtccagcggcccgctaaaaacggtaccgtgatggatgtgataagtagaagggaccagcgcgggtctggacaagtcggcacatatggcctcaatactttcaccaacatggaggcccagctgattagacagatggaaagcgaggggatctttttgccttccgaattagagccacccaatctggctggacgggttccggactggctcgagaagcacggtacagaaaggcttcgtcgaatggccatctcaggcgatgactgtgtggtaaagcctattgatgaccgcttcgcaactgcgctgaccgccctaaacgatatggggaaagtgagaaaggacataccccagtgggagccaagtaaaggatggaacgattggcaacaggtccctttttgctctcaccatttccaccagctgatcatgaaggacggccgggaaattgtggttccctgtaggaatcaggatgagctcgtgggtcgcgctagagtcagccaaggggccggatggtccttgcgggaaacggcatgcctgggcaaatcatacgctcagatgtggcagcttatgtattttcataggcgagacctgcgtctcgccgcaaacgccatctgtagcgcggtgccagtagattgggttcccacatctagaaccacttggtccattcacgctcatcaccaatggatgacaaccgaggacatgttaagtgtgtggaatcgcgtctggatcgaggaaaacccttggatggaggacaagactcacgtgagctcgtgggaagatgttccatacctgggcaagcgggaggaccagtggtgcgggtccttgataggactgaccgccagggcaacatgggccacgaatatccaggtggctattaaccaggtcagacgcctcatcggtaatgaaaactatcttgattacatgacctctatgaaacggttcaagaatgagtcagacccggagggcgccctgtggtga

SEQ ID NO: 14244 - RNA, 9879 nt, synthetic construct
  misc_feature 1..9879: note = derived and/or modified CDS sequence (opt3) from DENV-1__KU365900__SS-prME
  source 1..9879: mol_type = other RNA
agcgtgaccatgctgctcatgcttatgcccactgcactggctttccacttgactacgagaggaggggaacctcatatgatcgtctccaagcaggaaagggggaaatctttactgtttaagacctcagccggtgttaatatgtgcacactaattgccatggacctcggagaactgtgtgaagatactatgacctacaaatgcccacggatcacagaggcggaaccggacgatgtggactgttggtgcaatgctaccgatacttgggtgacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtggacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaggacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggcagcttcaaactggagaaggaagtcgctgagacccagcacggtacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggccgattctggatgcgtcatcaactggaaaggccgcgaacttaagtgtggttcagggatcttcgttactaatgaggtgcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagttcaccgtagtcgtgggcgatgttgctgggattctggcccagggcaagaagatgatccgccctcaacccatggagcacaaatactcgtggaaaagctggggcaaggcgaagataatcggggccgacgtgcagaatactacctttattatcgatggaccaaacacacctgaatgtcccgacgatcagagagcttggaatatttgggaggtcgaggactatggcttcggtatctttactaccaacatatggcttaagttgagggattcctacacacaggtgtgcgaccaccgtctcatgtcagcagccattaaagatagtaaggctgttcatgccgacatggggtattggatcgaatctgagaaaaatgaaacgtggaagctggcacgggcgagcttcattgaggtgaagacctgtatctggccaaaatcccacactctatggtcaaacggagtactggaaagcgagatgataatccccaagatttacggcggtcctatctctcaacataattatcgaccaggctacttcacacagaccgccgggccgtggcacctcggaaaactggagcttgattttgacttgtgcgaaggcactacagtcgtggtggatgagcactgcgggaacagaggaccctccctgaggaccacgactgtcaccggcaagattatccatgaatggtgttgccgcagttgtacattacctccactccggttcagaggtgaggacgggtgctggtacggaatggagataaggcccgttaaagaaaaggaggaaaatctggtaaagagcatggtatctgctggccctggtgaggtggactccttttcacttggcctgttgtgtattagtatcatgatcgaagaggtcatgcgcagccgatggtcgcggaaaatgctcatgaccgggactctggccgtgttctttctactgattatgggacagctcacatggaacgatctgatccgtctttgcattatggttggcgcaaatgcttccgacagaatggggatgggaaccacatatttggccctgatggcaactttcaagatgaggccaatgtttgccgtgggcttactcctgcgccggcttacctctagagaggtcctgctactcacgataggtctgagcttggtggcttcagttgaactgcccaacagtttagaggaactcggggatggactggcgatgggcatcatgattcttaaactgttgacagacttccaatcccaccagctctgggccaccctgctatctctgacttttatcaagaccacattcagccttcattacgcatggaaaactatggctatggtgctctccattgtctcactgtttccgttgtgtctgagcaccacgagtcagaagacaacctggttacctgtactcctgggctctcttgggtgcaagccactgactatgttcttgatcgccgagaataaaatatggggaaggaagtcctggcccctcaacgaaggtatcatggccgtgggcattgttagcatcctgctatcgtcactgcttaaaaacgatgtgcctctcgctgggcccctgattgcaggaggcatgttgatcgcctgttatgtcatatctggtagttccgcggacttaagcctggagaaggctgccgaggtgtcttgggaagaggaagcagagcacagcggggcctcccataatattctcgtagaagtgcaggatgacggaacaatgaaaatcaaggatgaggagcgagacgataccctgactatccttctgaaagctacattgctagcagtctcaggcgtttacccactgagtattcctgccaccctctttgtgtggtatttctggcaaaagaagaaacagcgcagcggcgtgctgtgggacacgccctctccaccggaagtcgagcgggcggtgcttgatgacgggatatacagaatcatgcagaggggattactgggtcgttcccaggttggcgtaggggtgttccaagaaaacgtctttcacactatgtggcacgtgacccgcggagctgttctcatgtatcagggcaagcggttggagccttcatgggccagtgtgaaaaaggacctgattagctacggtgggggatggagactccagggctcctggaatacaggcgaggaagtccaggtgatcgcagtagagcccgggaaaaacccaaagaatgtccaaaccgcccccggaacattcaagactcctgaaggtgaggtgggcgctattgccctggattttaaaccagggacctctggatcgcccatcgttaacagggaaggcaagatagtgggtctttacgggaatggagtcgtgacgacaagcggcacttatgtttcagcaatcgctcaggccaaagcgtcccaggagggccctctgccggagattgaagacgaggtgttccgaaagcggaacttgaccatcatggatctacatccagggagtggaaaaacacgcagatacctgcccgccattgtcagggaagcaatcaagcggaagctccgaaccttaatactggctcctactagagtggtagcctctgagatggctgaagcacttaaaggtatgccaattcgctatcaaaccacagccgtaaagagcgagcacacgggcaaagagatcgttgacctgatgtgccatgccacttttaccatgaggctcttgtcccccgtccgtgtgcctaattacaacatgatcattatggatgaagctcacttcacagacccgtcatctatcgcggcacgggggtatataagcaccagagtgggaatgggcgaggccgctgccatttttatgactgcaacacccccaggtagtgtcgaagccttccctcagtccaatgctgtaatccaggatgaggaaagggacattcccgagcgcagctggaactctgggtacgagtggatcaccgattttccaggaaagacggtgtggttcgttccttcaataaaatccggcaatgacattgcgaactgtctgcgaaagaatggcaagagagtgatccagctcagtcggaaaacttttgatacagaatatcaaaagaccaaaaacaacgactgggactacgtcgtgaccactgatatcagcgagatgggggccaatttcagggcagaccgcgttattgatccccgtagatgcctgaagccagtgatccttaaagacggaccggaacgggtcattctagctggtcctatgcccgtgacagtagcctcggcagcccagaggcgcggccgaatagggagaaaccataataaggagggagatcagtacatctatatgggccagccactgaacaatgacgaggatcacgctcactggaccgaagccaagatgttgttagacaacattaatacacccgagggtatcatccctgcgctgttcgaaccagagcgggaaaaatctgcagccattgatggggagtacaggctccgcggcgaggctagaaagacttttgtggaactgatgaggcggggagaccttcccgtttggctgtcctataaagtcgccagcgagggcttccaatactcagatcgtaagtggtgctttgacggggaacgcaacaatcaggtgctcgaggaaaacatggatgtggagatatggacgaaagagggagaacgaaagaaattgagacctaggtggctggacgctcggacctatagtgacccgctagcactgcgcgagttcaaggaatttgccgctggtagaaggtctgtctccggcgatctcatccttgagattgggaagctgccacagcatttaacacagcgggcccaaaatgcattggacaacctggttatgctccacaatagcgaacagggaggccgagcgtacagacatgccatggaggagctgcccgatactatcgaaacccttatgctgctcgctttgattgccgtgctgacaggtggggtaaccttattctttctatcaggccgcggactgggcaaaacaagtatcgggctcctttgtgtgatggcaagctccgtcctgttgtggatggcttctgtggagcctcactggatagccgcaagcatcattctggagttctttctcatggttctgcttatccccgagccagacaggcagcggacgcctcaggataaccaactcgcctatgtggtcattggactgttgttcatgatcctgaccgtagctgcgaatgagatgggtttactagaaacaactaagaaagacctgggcatagggcacgtggccgttgagaaccatcaccatgcaaccatgctcgatgtggaccttcaccccgcttccgcctggacactgtacgccgtcgcaaccactattatcacaccaatgatgcgtcatacgattgaaaacaccactgctaatatctcattgacagccatagcgaaccaggctgccatcctgatgggactcgataagggctggcctatttctaaaatggacatcggtgtgccgctgcttgcattagggtgctacagtcaggtcaatcccctgaccctcaccgccgctgtgttgatgctggttgcacactatgccattatcggcccaggactacaagcgaaggctacaagagaggcccagaagaggactgcagccggcataatgaaaaaccctacggtggatgggattgtagctatcgacctggatcccgtggtctacgacgccaagtttgaaaaacagctcggacagatcatgcttctgattttgtgtacctcgcaaatcctgctcatgcgcacaacttgggcactgtgcgagagcataaccttagctacaggcccacttaccactctgtgggagggttcccctgggaagttctggaatacgacaattgccgtttctatggcgaacatctttcggggatcatatctcgccggcgcaggtctagctttcagcctgatgaaatccttgggcgggggacgaagaggcaccggggcccagggagaaactctgggcgagaagtggaagaggcagctcaatcagcttagtaaatctgagttcaacacctacaagcgcagcggtattatggaggtggaccggtcagaagcaaaagaggggctgaagagaggagagacaactaaacacgctgtctcccgtggcaccgccaagttgaggtggtttgtggaacggaatctggtaaagcccgagggtaaagtgatcgatctcggctgtgggcgcggaggctggagttattactgcgccgggttaaagaaagttacagaagtgaagggatatacgaaaggcggtccggggcatgaggaaccaatacctatggcgacctacggatggaacctggtcaaactttacagcggcaaagacgtgttctttatacccccagagaagtgtgatactctgctatgcgacattggcgagtcttcccccaatcctacaatcgaagaggggcgaaccctcagagtcctgaagatggtggaaccgtggttgaggggaaaccaattctgtattaaaatcctgaatccctatatgccatcagttgtagagactctcgagcagatgcagcggaagcacggtggcatgcttgtgcgcaaccctctgagcagaaattcgacacatgaaatgtactgggtctcttgcgggaccggaaacattgtgagtgctgttaatatgacgtccaggatgttactgaaccgatttaccatggcacaccggaaacccacatatgagaaggatgtggacttgggcgccggtactcgtcacgtcgctgtggaacctgaggtagccaacctcgatatcatagggcagagaattgaaaatatcaaacatgagcacaagagcacctggcattacgacgaggataacccatataagacatgggcataccacggatcatatgaagtgaaaccctccggctctgccagcagtatggttaatggcgtcgtgaagctgctaactaaaccttgggacgtgatcccaatggtcacccaaattgctatgacagataccactcccttcgggcagcagcgcgtttttaaggagaaagtggacacgaggacaccgaaggcgaagcggggaaccgcccaaataatggaagtaactgcaagatggctttggggtttcctgtcccgcaacaaaaagcctaggatctgtacccgagaggaatttacacggaaagtgagaagcaatgctgccattggcgcagtcttcatcgacgagaaccagtggaactctgccaaggaggctgtggaagatgagaggttttgggacctcgttcatcgcgaacgtgagctgcacaaacaggggaagtgcgccacgtgcgtgtacaacatgatgggaaagcgggagaagaagttgggcgagttcggtaaagcgaaggggtcaagagcaatttggtacatgtggctgggagccaggtttctcgagttcgaagctcttggcttcatgaatgaggatcactggtttagtcgcgaaaactccctgagcggcgtcgagggggagggattacataaactgggttatatcttgcgagacatatctaagatctcgggcgggaatatgtacgccgatgacaccgcaggatgggatactcggattacagaagacgatctccagaacgaggctaaaatcaccgacattatggaaccagagcacgccctgctagctaaggccatcttcaaacttacttatcaaaataaagtggtaagagttcagaggcccgcaaagaacggcacagtgatggatgtcatatcacgcagagaccagcggggtagcggacaggtgggaacctacggcctgaatacatttactaacatggaagcgcaactcattaggcagatggagtccgagggcatcttcagtccttctgaactggagaccccaaacttggccgaacgtgtgttagattggctggggaaatatggagtcgagcgactcaagcgcatggctatcagcggtgacgactgtgttgtgaaacccattgatgacagatttgccacggcacttaccgctctgaatgatatgggcaaggtacggaaggacataccgcagtgggaaccttccaaagggtggaacgattggcagcaagtgcccttctgctcacatcactttcaccagctaatcatgaaggacggaagggagattgtcgtgccatgtcgcaatcaggatgagctggttggcagagcccgggtgagtcagggtgcagggtggtctctcagggaaacagcctgcttgggaaaaagctacgcgcaaatgtggcagctgatgtatttccatcgacgtgaccttagactggctgccaacgcaatctgttccgccgtccctgtggattgggtacccacttcacgcaccacatggagcattcacgctcatcaccagtggatgactaccgaggacatgctctctgtttggaatcgggtgtggatcgaagagaacccatggatggaagataagacgcatatatccagttgggaggacgtcccctacttaggcaaaagggaggaccaatggtgcggcagcctgatcgggttgacagccagagcaacctgggctactaatattcaggtggccatcaaccaggttcgccggctgattggaaatgaaaactacctcgattatatgacatcgatgaagaggtttaagaatgagtccgaccctgaaggtgcgctttggtga

SEQ ID NO: 14245 - RNA, 9879 nt, synthetic construct
  misc_feature 1..9879: note = derived and/or modified CDS sequence (opt3) from DENV-1__FJ176779__SS-prME
  source 1..9879: mol_type = other RNA
agcgtgaccatgctgctcatgcttatgcccacagccctggctttccacttgactacgagaggcggggagcctcatatgatcgtctccaagcaggaaaggggaaaatctttactgtttaagacctcagcaggtgttaacatgtgcacactagtggccatggacctcggcgagctgtgtgaagatactatgacctacaaatgcccacggattacagaggcggaaccggacgatgtagactgttggtgcaatgctaccgatacttgggtgacatatgggacctgtagtcaaacgggagagcaccgccgagacaagcgtagcgtcgcccttgcaccccatgtgggcctgggtttggagactagaaccgaaacatggatgtcctctgagggggcctggaaacagatacagagggttgaaacttgggctctccggcaccctggattcaccgtgatcgcactgtttctggcccatgctattggcacatcgatcacccagaagggcattatcttcatactcttaatgctggtcacgccatcaatggccatgcgctgcgtggggatcggaagcagagattttgtagagggtcttagtggcgcgacttgggttgacgtggtcttggagcacgggtcctgtgtgacaaccatggcaaaggataaacccactctggacattgaactactcaagacagaggtgaccaaccctgccgtcctgaggaaactttgcatcgaagctaagatttctaatacgaccacagatagccggtgtccaactcaaggagaggccaccctggttgaagagcaggacgcaaacttcgtgtgccgccgaacatttgtagatagaggctggggtaatgggtgtggattgttcggcaaaggctccctcctgacttgcgctaagtttaagtgcgtgaccaaattagaggggaagatcgtccagtacgaaaacctgaaatattcagtgatagttacagtgcacaccggagaccagcatcaagtcggtaatgagagtactgaacacggcacgacagccaccattactccccaggcgcctaccacagagatccagctcaccgactacggggcccttactctggattgtagcccaaggacaggattggacttcaacgaaatggtgctactgacgatgaaggagaaatcttggctcgtacataagcagtggtttctggatcttccgctgccctggacctccggcgcatcaactagccaagagacatggaatcggcaggacttgctcgttaccttcaaaacagctcacgccaagaagcaggaagtggtcgtgctgggtagtcaagagggggctatgcacactgccttaaccggcgcaacggaaattcagacctctggaacaactaccatctttgccggccatctgaaatgccgtctaaagatggataaactcacactgaaggggatgtcctatgtcatgtgtactggaagcttcaaacttgagaaggaagtggctgagacccagcacggtacggttttggtgcagatcaagtacgagggcacagacgcgccttgcaaaattccattctcgacccaagatgaaaagggggtaactcagaacggacgcctgataacagcaaatcccatcgtcaccgacaaagagaagcctgtgaacattgaagccgagccaccctttggcgagtcttatatcgttataggtgtgggggaaaaagctctcaagctgtcctggttcaagaaaggctcaagtattggaaagatgtttgaggccactgcaagaggcgccaggcggatggctatccttggggataccgcctgggacttcggaagcatcggtggcgtctttacatccgtggggaaactggtacatcagattttcggaacggcatacggcgtgttgttttctggtgttagctggaccatgaagatcgggattggcgtcctcctgacttggttaggactgaattcacgaagtacatccctaagcatgacctgtatagcggtgggcctcgtgacactgtaccttggggtcatggttcaggctgattctggatgcgtgatcaactggaaaggccgcgaattgaagtgtggttcagggattttcgtgactaatgaggtacacacctggacggaacaatataagtttcaggccgacagtccgaaaagactgagcgcagccatcggaaaggcttgggaggagggcgtctgcggtatcaggtccgccacacggctcgaaaacattatgtggaaacagatatctaacgagctgaatcatatcttactggaaaacgacatgaagttcaccgtggttgtgggcgatgtcgcagggattcttgctcagggaaaaaagatgatccgccctcaacccatggagcacaaatactcgtggaagaattggggcaaggccaaaattatcggggcggacgtgcagaacagcacttttataatcgatggaccaaatacccctgaatgttccgacgatcagagagcctggaacatttgggaggttgaggactatggcttcggtatctttacaactaatatttggttgaagctcagggattcatacacccaggtgtgcgaccaccgtctgatgagtgctgcaatcaaagattctaaggccgtacatgctgacatggggtattggatagaaagcgagaaaaacgaaacatggaagctagcccgggcatccttcattgaggtcaagacgtgtatctggcccaaatcacacaccctgtggagcaatggagtgctcgaatctgagatgattatcccaaagatatacggcggtcccatctcccaacataactatcgacctggctacttcactcagacagcggggccatggcacctgggaaaacttgagttggattttgacctgtgcgaaggcaccactgtggtcgttgatgagcactgcgggaatagaggaccgagtttaaggacaaccacggtgactggcaagattatccatgaatggtgttgccgcagctgtaccctcccccctctgcggttcagaggtgaggacgggtgctggtacggaatggagattaggccagtaaaagaaaaggaggaaaaccttgtgaagtctatggtctccgccggctcaggtgaggtggacagttttagcctgggcttgctctgtatctcgataatgattgaagaggttatgcgctcccgatggtctcggaaaatgctgatgacagggaccctagctgtgttctttctgctcatcatgggacagctgacttggaatgatcttatccgtttgtgcattatggtcggcgccaacgcaagcgacagaatggggatgggaacaacctatctggctttaatggccacattcaagatgaggcccatgtttgcagtgggcctcctgttccgccggcttacttcaagagaggttctgctactcaccatcggtctgagtttggtggcctccgtcgaactgcctaattctttagaggaactcggggatggactggctatgggcattatgatacttaaactgttgacggactttcaaagccaccagctctgggcgacactgctatccatgaccttcatcaagactaccttttcactgcattacgcctggaaaacaatggcaatggtacttagcattgtgagtctcttcccactgtgtttgtctactacctcccagaagacgacatggctgcccgttttactcggcagcctggggtgcaagccgcttaccatgtttctgatcgctgagaacaaaatttggggaaggaagtcgtggcctttgaacgaaggtatcatggccgtgggcatagtctcaatcctcctgtctagtctactgaaaaatgatgtgccacttgccgggcccctcattgctggaggcatgctgatcgcatgttatgtaatttccggtagctctgccgacttgagcttagagaaggcggctgaggtgtcctgggaagaggaagccgagcactcaggggcaagtcataacatcctggtcgaagttcaggatgacggaactatgaaaataaaggatgaggagcgagacgatacactcaccattctgcttaaagccactctgttggctgtgagcggcgtgtaccctctatctatccccgcaacactgttcgtctggtatttctggcaaaagaagaaacagcgctccggcgtgctctgggacaccccatcacctcccaaggttgaacgggccgtactggatgacgggatctacagaattatgcagaggggacttttaggtcgtagtcaggtgggcgtcggggtgtttcaagagaatgttttccacacgatgtggcacgtgactcgcggagcggtcctgatgtatcagggcaaacggctcgaaccaagctgggcttccgtgaagaaagacttgatatcttacggtgggggatggagactgcagggctcgtggaacaccggcgaggaggtacaggtcatcgccgtggaaccggggaagaatcctaagaacgttcaaacagcacccggaacctttaaaacaccagagggtgaagtgggcgccattgctctcgatttcaagcccgggactagcggatcacctatcgtcaatagggagggcaaaattgtgggtctgtacgggaacggagttgtgaccacgtccggcacatatgtcagtgccatcgcacaggctaaggcctctcaggaaggcccacttcccgagatagaggacgaagtgtttcgaaaacggaatctgactatcatggatttgcatcctgggagcggaaagacccgcagatacctaccggcgattgtaagggaggccatcaagcggaaaatgcgaacactgattctcgcaccaaccagagtggttgcttccgaaatggccgaggctttaaagggtatgcccatccgctatcaaactaccgcagtcaaatcagaacacacaggcaaggagatagtggacctgatgtgccatgccacgttcactatgaggcttctgtctcctgtgcgtgtcccaaactacaatatgattatcatggatgaggcccactttaccgaccccagcagtatcgctgcgcgggggtatatttccacaagagtaggaatgggcgaagcagccgctatcttcatgaccgccactcctccgggtagcgtggaggcatttccccagtctaacgccgttatacaggatgaagagagggacattccagaacgctcatggaattccgggtacgagtggatcacagagttccctggaaaaaccgtgtggtttgtccccagtattaaggctggcaacgatatcgcgaattgtctccgaaagaacggcaaaagagtgatacagttgagccggaagacgttcgacactgaatatcaaaaaacaaagaacaatgattgggactacgttgtgaccaccgacatttcggagatgggggccaacttcagggcagatcgcgtcatcgacccacgtagatgcctgaaacctgtgatcctcaaggatggacccgaacgggtaattctggctggtccaatgccggtgactgttgcctctgcagcccagaggcgcggccgaatcgggagaaatcataacaaggagggagaccagtacatttatatgggccagcctcttaataacgatgaggaccacgctcactggacagaagccaaaatgctactggataatataaacacccccgagggtatcattccagcgttgtttgaacccgagcgggaaaagtccgcagccatcgacggggagtacaggttacgcggcgaggctagaaaaacattcgtcgaactgatgaggcggggagatctccctgtgtggctgagctataaggtggcctcagagggctttcaatacagtgaccgtcgctggtgcttcgatggggaacgaaataaccaggtccttgaggaaaatatggacgttgagatctggactaaagagggagaaagaaagaaactgaggccacggtggctcgatgctcgcacgtattctgaccccttggcactgagagagtttaaggaattcgccgctggtaggcggtccgtgagcggcgacctaattctggagatagggaagctccctcagcatcttacccagcgagcccaaaacgcactggataatttagtaatgttgcacaactcagaacagggaggcagagcgtaccgccatgccatggaggagctgccggacacaatcgaaactctcatgctgcttgctctgattgccgtgctcaccggtggggtcacattgtttttcctgagtggcaaaggattaggcaagaccagcatcgggctactgtgtgtgatggcatcctctgttctcctttggatggctagcgtggagccacactggattgccgcatccatcatactggaatttttcttgatggtcctgctcatccccgagcctgataggcagcggactccccaggacaatcaactggcctatgtagtgattggacttctctttatgatcctgacggttgctgcgaacgagatgggtttgctggaaaccacaaaaaaggatttaggcattgggcacgtggccgtcgagaaccatcaccatgcagctatgctagacgtggatctgcacccagcctcagcctggactctctacgcagtcgctaccacaatcataacccctatgatgcgtcatactattgaaaatacaacggccaacatctctcttaccgcgattgctaatcaggccgcaatcctgatgggattggacaaaggctggcccataagtaagatggatatcggtgtgccactgctcgccctggggtgctactcgcaggttaaccctcttactttaacagctgcagtgctgatgctcgtagcccactatgcgattatcggcccgggattgcaagctaaggccaccagagaggcacagaaaaggaccgccgctggcattatgaagaatcccacaatcgacgggatagtggccattgatctggacccagtcgtttacgatgcaaaattcgaaaagcagctaggacagatcatgctgctcatcctttgtactagccaaattctgttgatgcgcacgacctgggctctgtgcgagtccatcacactcgccactggccctctgaccacattatgggagggttctcccgggaaattttggaacaccactatagcggtgtcaatggccaatattttccggggaagctatcttgcaggcgctggtctggccttctccctcatgaagagtctaggcgggggacgaagaggcacgggggcacagggagaaacactgggcgagaagtggaaaaggcagttgaaccagctgtctaagagcgaatttaatacctacaaacgctcaggtatcatggaggtcgaccggtccgaagctaaggaggggctcaaaagaggagagactaccaagcacgccgtgagtcgtggcacagccaagcttaggtggttcgtagaacggaacctggtgaaaccagagggtaaggttattgacttgggctgtgggcgcggaggctggagctattactgcgcggggctgaaaaaggtgactgaagtcaaaggatataccaagggcggtcctgggcatgaggaacccatcccgatggctacatacggatggaatctcgtgaaattacactctggcaaggatgtctttttcataccacctgagaagtgtgacacgctgctttgcgatatcggcgagtcctcacccaacccaaccattgaagaggggcgaactctgagagtgctaaaaatggttgaaccctggctcaggggaaatcaattttgtatcaagattctgaacccttacatgccgagcgtagtggagacattggagcagatgcagcggaaacatggtggcatgctggtccgcaatcccctctcgagaaactctacccacgaaatgtattgggtgagttgcgggactggaaatatcgtttccgcagtgaacatgacaagcaggatgcttctgaaccgattcaccatggcccaccggaagccaacgtacgagcgtgacgtcgatttaggcgctggtaccagacatgtggccgtagaacctgaggtgacaaatctggacattatcgggcagcgcatagaaaacattaaatatgagcacaagtcaacttggcattacgatgaggacaatccctataagacctgggcataccacggatcctatgaagttaaaccttctggcagcgccagttccatggtcaacggcgtggtgaagttgctcacaaaaccatgggatgtcatccccatggttactcaaatcgctatgaccgacacaaccccttttgggcagcagagggtgttcaaggagaaagtagatactcggacgccaaaggcgaagagaggaacagcccaaattatggaagtgaccgcacgctggctgtggagctttctatctaggaataaaaagccccgaatatgtactcgggaggaattcaccagaaaagtcaggtcaaacgctgccatcggtgcagtgtttgttgacgagaatcagtggaacagtgccaaggaggctgtggaagacgatcgcttctgggaccttgtccatcgtgagcgggaactgcacaaacagggcaagtgcgccacatgcgtgtacaatatgatggggaagagagagaaaaagctcggagaatttggcaaagcgaagggttccagggcaatttggtacatgtggctgggggcccgcttcttggagttcgaggctctgggatttatgaacgaagatcactggttcagccgagagaattctctctcgggcgtagaaggcgaggggcttcataaactgggatatatcttacgggacatttcaaagatcccgggtggcaacatgtacgccgatgacacggcagggtgggataccagaataactgaggacgatctgcagaatgaagctaaaatcacagacattatggagcctgaacacgccttgctcgctaagagcatctttaagctgacctatcaaaacaaagttgtgagggtccagcgcccagccaagaatggaactgtgatggatgtgatttccagacgggaccagaggggcagtggtcaggtcgggacatacggactaaacaccttcacaaacatggaggcacaacttatccgtcagatggaatctgagggcatatttagccccaatgagctggaaactcctaacctcgcggagcgagttctggattggttggaaaaatatggcgtggagcgcttaaagagaatggccatttccggggacgactgtgtagtgaaaccaatcgatgaccggttcgctaccgccctgacggcactcaatgatatgggaaaggtcaggaaggacatcccccagtgggaaccgtcaaaaggttggaacgattggcagcaagtgcctttttgcagtcatcacttccaccagcttattatgaaggacggccgcgagatagttgtgccctgtagaaatcaggatgagctggtcgggcgggctagggtgtctcagggagccggctggagcctacgagaaaccgcatgcctgggtaaatcctacgcccaaatgtggcagctcatgtattttcatcgtagagacttgcgcctggcggctaacgccatctgttcagcagtaccagttgattgggtgcctacaagccggactacctggtctattcacgcccatcaccagtggatgacaactgaggacatgctttccgtctggaatagggtgtggatcgaagagaacccctggatggaagataagaccagaattagtagctgggaggacgttccatacctggggaaacgcgaggaccaatggtgcggatcgctcatcggcttaacggctcgggccacatgggcaaccaatatacaggtggctatcaaccaggtcaggcgactgattggcaatgaaaactactccgattatatgacttctatgaagagattcaagaatgagtcagaacccgagggggccttgtggtga

SEQ ID NO: 14246 - RNA, 9879 nt, synthetic construct
  misc_feature 1..9879: note = derived and/or modified CDS sequence (opt3) from DENV-1__FJ176780__SS-prME
  source 1..9879: mol_type = other RNA
agcgtgaccatgctgctcatgcttatgcccacagccctggctttccacttgactacgagaggaggggaacctcatatgatcgtctccaagcaggaaagaggaaaatctttactgtttaagacctcagccggtgttaacatgtgcacactaattgccatggacctcggcgaactgtgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggcccttgcaccccatgtcggcctgggtttggagactagaaccgaaacatggatgtcctctgagggggcctggaaacagatccagagggtggaaacttgggctctccggcaccctggattcaccgttattgcactgtttctggcccatgctatcggcacatcgattacccagaagggcatcatattcatcctcttaatgctggtgacgccatcaatggccatgcgctgcgtcgggattggaagcagagattttgtggagggtcttagtggcgcgacttgggtagacgttgtgttggagcacgggtcctgtgtcacaaccatggcaaaggataaacccactctggacatcgaactactcaagacagaggtgaccaaccctgccgtgctgaggaaactttgcattgaagctaagatctctaatacgaccacagatagccggtgtccaactcaaggagaggccaccctggtcgaagaacaagacgcaaacttcgtttgccgccgaacatttgtggatagaggctggggtaatgggtgtggattgttcggcaaaggctccctcataacttgcgctaagtttaagtgcgtaaccaaactggaggggaagattgtgcagtacgaaaacttaaaatattcagtcatcgtgacagttcacaccggagaccagcatcaagtgggtaatgagagtactgaacacggcacgacagccaccattactccccaggcgcctaccacagagatccagctgaccgactacggggccctcactcttgattgtagcccaaggacaggactggacttcaacgaaatggtcttgctaacgatgaaggagaaatcttggctggtgcataagcagtggtttctcgatctgccgcttccctggacctccggcgcatcaactagccaagagacatggaatcggcaggacctgttggtaaccttcaaaacagctcacgccaagaagcaggaagttgtggtcctcggtagtcaagagggggctatgcacactgccctgaccggcgcaacggaaatccagacctctggaacaactaccatttttgccggccatttaaaatgccgtctgaagatggataaactaacactcaaggggatgtcctatgtgatgtgtactggtagcttcaaactggagaaggaagtcgctgagacccagcacggaacggtgcttgttcagataaagtacgagggcacagacgcgccttgcaaaatcccattctcgacccaagatgaaaagggggtgactcagaacggacgcttgattacagcaaatcccatcgtaaccgacaaagagaagcctgtcaacatagaagccgagccaccctttggcgagtcttatattgtgatcggtgctggggaaaaagccctgaagctctcctggttcaagaaaggctcaagtatcggaaagatgtttgaggcaactgccagaggcgctaggcggatggccattctgggggataccgcatgggacttcggaagcatcggtggcgtttttacatccgtggggaaacttgtccatcagattttcggaacggcgtacggcgtgctgttttctggtgtaagctggaccatgaagatagggatcggcgtgttgctcacttggctgggattaaattcacgaagtacatccctgagcatgacctgtattgctgttggcctagtcacactctacctgggggtgatggtgcaggccgattctggatgcgtcatcaactggaaaggccgcgaacttaagtgtggttcagggatcttcgttactaatgaggtgcacacctggacggaacaatataagtttcaggcagacagtccgaaaagattgagcgccgctattggaaaggcctgggaggagggcgtgtgcggtataaggtccgcaacacggctggaaaacatcatgtggaaacagatttctaacgagctcaatcatatcctgttagaaaacgacatgaagttcaccgtagtcgtgggcgatgttgctgggattctggcccagggcaaaaagatgatccgccctcaacccatggagtacaaatattcgtggaaaagctggggcaaggcgaagataatcggggccgacgtgcagaatactacctttattatcgatggaccaaacacacctgaatgtcccgacgatcagagagcttggaatatttgggaggtcgaggactacggcttcggtatctttactaccaacatatggcttaagttgagggattcctatacacaggtgtgcgaccaccgtctcatgtcagcagccattaaagatagtaaggctgttcacgccgacatggggtactggatcgaatctgagaaaaatgaaacgtggaagctggcacgggcgagcttcattgaggtgaagacctgtatctggccaaaatcccatactctatggtcaaacggagtactggaaagcgagatgataatccccaagatttatggcggtcctatctctcaacacaattaccgaccaggctacttcacacagaccgccgggccgtggcatctcggaaaactggagcttgattttgacttgtgcgaaggcactacagtcgtggtggatgagcactgcgggaacagaggaccctccctgaggaccacgactgtcaccggcaagattatccacgaatggtgttgccgcagttgtacattacctccactccggttcagaggtgaggacgggtgctggtatggaatggagataaggcccgttaaagaaaaggaggaaaatctggtgaagtccatggtatctgctggctccggtgaggtggactcatttagtcttggcctgttgtgtattagcatcatgatcgaagaggtcatgcgctcgcgatggtcccggaaaatgctcatgaccgggactctggccgtgttctttctactgattatgggacagctcacatggaacgatctgatccgtctttgcattatggttggcgcaaatgcttctgacagaatggggatgggaaccacatacttggccctgatggcaactttcaagatgaggcctatgtttgccgtgggcttactcttccgccggctgaccagcagagaggtccttctgctaacgataggtctctcactggtggctagtgttgaattgccaacatccctggaggaattaggggatggactcgcgatgggcatcatgattctgaaacttctgaccgactttcaatctcatcagttgtgggccactctcctgagcctaaccttcgtgaagacaactttttccctgcactatgcatggaaaaccatggctatggtcctttcaatcgtaagcctcttccccctgtgtttgagtacgacatctcagaagaccacttggctgccggtgttactcggctccctggggtgcaagcctcttacaatgtttctgattgccgagaacaaaatctggggaaggcgaagctggccattgaatgaaggtataatggccgttggcatcgtgtcgattctcctgtcatctctactgaagaacgatgtcccccttgctgggcctctcatcgcaggaggcatgctgattgcctgttacgtgatcagtggttccagcgcggacttgtctttagagaaagctgccgaggtaagctgggaagaggaagcagagcattccggggcctcacacaacatactggtggaagtccaggatgacggaaccatgaagattaaagatgaggagcgcgacgatactctcacaatcctgcttaaggctaccctgttggcagttagtggcgtgtatcccctaagcatcccagccacgctgttcgtgtggtacttctggcagaaaaagaagcagcggtctggcgtcctctgggacactccttcacccccagaagtggagagagcggttctggatgacgggatttataggataatgcagcgtggacttttaggtcgcagccaggtaggcgtgggggtctttcaagaaaatgtgttccataccatgtggcacgttacacggggagctgtgctgatgtaccagggcaaaagactcgagccgagttgggccagcgtcaagaaagacttgatctcctacggtgggggatggaggctgcagggctcttggaacaccggcgaggaagtgcaggtaattgcagtcgagcctgggaagaatcccaaaaacgtgcaaacagccccaggaacttttaagacccccgaaggtgaggttggcgctatcgccctcgatttcaagcctgggacgtcgggaagcccaattgtgaatcgagaaggcaaaatcgtcggtctgtatgggaacggagtggttacaacttcaggcacctacgtgtccgcaatagctcaggccaaggcgagtcaggagggcccccttcctgagatcgaagacgaggtctttcggaaacgcaatctgacaattatggatttgcacccggggtctggaaagaccagaaggtatctaccagccatcgtgcgggaagcaattaaacgaaagctgagaactctcatcttagctcccacccgcgtagtggccagcgagatggctgaagcactgaagggtatgcctataaggtaccaaacaacggccgttaaatccgagcatactggcaaggagattgtcgaccttatgtgccacgccaccttcacaatgcgtctgctctcaccagtgcgggtgcccaactataatatgatcatcatggatgaagctcattttaccgacccttctagcattgcggcaagagggtacatcagtactagggtcggaatgggcgaggccgctgccatattcatgacagcaaccccgcccggttccgtagaagcctttccacagagcaacgctgtgattcaggatgaggaacgcgacatccctgagcgatcttggaactcagggtatgagtggattacggatttccccggaaaaactgtttggtttgtgccatccatcaagagtggcaacgacatagcgaattgtttgaggaaaaatggcaagcgggtcattcagctgagcaggaagacattcgataccgaataccagaaaaccaagaataacgactgggactacgtggttactacagatatctcggagatgggggccaacttccgcgcagaccgtgtgatcgatcctagacggtgcctcaaacccgtcattctgaaggacggaccagaaagggtgatccttgctggtccgatgcctgtaaccgtggcctctgcagcccagcgccgaggcagaattgggcggaatcacaacaaagagggagatcagtatatatacatgggccagcccctaaataacgacgaggatcatgctcactggacagaagccaagatgctgttggacaatatcaacactccagagggtattatccccgcgttatttgaacctgagagggaaaagtccgcagccatcgatggggagtatcgcctgagaggcgaggctaggaaaacgttcgttgaactcatgcggcgtggagacctgccagtctggcttagctacaaggtggcctcagagggctatcaatacagtgatcgccgatggtgctttgacggggaaagaaataaccaggtgctggaggaaaatatggatgtcgagatttggaccaaagagggagaaaggaagaaactccggccccgctggttggacgctagaacatattctgaccctctggcactaagggagttcaaggaatttgccgctggtcggcgatccgttagcggcgatctgatactcgagatcgggaaacttccgcagcacctgactcagagagcccaaaacgcattagacaatttggtgatgctgcataactcagaacagggaggccgcgcgtacaggcacgccatggaggagctcccagataccattgaaacactgatgcttctggctctcatcgccgtattgaccggtggggtgactctgttctttttaagtggccggggactaggcaagacgagcattgggctgctctgtgtcatggcatcctctgtgcttctgtggatggctagcgttgagccccattggatcgccgcatccataatcttggagttctttctgatggtgctcctgattcctgagcccgaccgtcagagaaccccacaggataatcaacttgcctacgtcgtaatcggactcctgttcatgattttgacagtggctgcgaacgagatgggtctgttagaaactaccaagaaagacctaggcatcgggcacgttgccgtggagaatcaccatcacgcagctatgctggatgtcgacctccatcctgcctcagcctggacactttatgcagtggctaccactataattacacccatgatgaggcacacgatcgaaaacaccactgccaacatttctctgacagcgatcgctaatcaggccgcaatattgatgggactggataagggctggccaatcagtaaaatggacattggtgtccctctcctggcccttgggtgctactcgcaagtgaacccgttaaccctgaccgctgcagttctcatgttggtggcccattatgcgatcattggccccggactgcaagctaaggccacacgcgaggcacagaaacggactgccgctggcatcatgaagaatccaacggtagatgggatagtggccattgacctagatcctgtcgtttacgacgcaaagtttgaaaaacagctgggacagatcatgctccttatcctgtgtaccagccaaattttgctgatgcgaacaacttgggctctctgcgagtccatcaccctggccacaggccccttaaccactctttgggagggttctccagggaagttctggaacacgacaatagcggtgtcaatggccaatatttttagaggaagctatctggcaggcgctggtctcgccttctccctaatgaaaagtctgggcgggggaaggcgcggcaccggggcacagggagaaactttgggcgagaagtggaaacggcagctgaaccagctctctaagagcgagttcaatacctacaagagatcaggtatcatggaggtcgaccgttccgaagctaaagaggggcttaagaggggagagacaactaaacacgccgtgagtcggggcaccgccaagctgcgctggtttgtagaacgaaacttggtgaaacctgagggtaaggttattgatctgggctgtgggagaggaggctggagctattactgcgcggggctcaagaaagtgacagaagtcaagggatacacgaaaggcggtcccgggcacgaggaaccgatcccaatggctacctatggatggaatttagtgaagctgcattctggcaaagacgtcttctttatacctcccgagaagtgtgatactcttctgtgcgacatcggcgagtcctcaccaaaccccacaattgaagaggggaggaccctacgggtgctcaaaatggttgaaccttggctgcgcggaaatcaattctgtatcaagattttgaacccgtacatgcccagcgtagtggagactctggagcagatgcagagaaagcacggtggcatgctcgtcaggaatccactttcgcgaaactctacacatgaaatgtattgggtgagttgcgggaccggaaatatcgtttccgcagtgaacatgacgagccggatgctgttaaatcgttttaccatggcccacagaaaacctacatacgagcgcgatgtcgacctgggcgctggtactaggcacgtggccgtagaacccgaggtgaccaacttggatattatcgggcagcggatagaaaacattaagcatgagcacaaatcaacatggcattatgacgaggataatccttacaagacttgggcatatcacggatcctacgaagttaaaccatctggcagcgccagttccatggtcaacggcgtggtgaagctcctgaccaagccctgggacgtcatccctatggttacacaaatcgctatgaccgatactacgccattcgggcagcagagagtgtttaaagagaaggtagacacacgcacccccaaagcgaagaggggaactgcccaaattatggaagtgaccgcaaaatggctatggggtttccttagccgaaataagaagccgcggatatgtacaagagaggaatttacgaggaaagtccgctctaacgctgccatcggcgcagtgttcgttgacgagaatcagtggaactcagccaaggaggctgtggaagatgagcgtttttgggacctggtccatcgggaaagagagctccacaaacaggggaagtgcgcaacctgcgtgtacaatatgatgggaaaaagggaaaagaagctgggcgagttcggtaaagcgaaggggagtcgcgcaatttggtatatgtggttgggagcccgatttctggagttcgaagctctcggcttcatgaacgaggatcactggttttcccgggaaaatagcctttctggcgtagagggggagggactgcataaattaggttacatcctgagagacatttcgaagatccctggcgggaacatgtatgccgatgacactgcaggatgggatacaaggataaccgaagacgatttgcagaatgaggctcgcatcactgacattatggaaccagagcacgccctcctggctaaatcaatcttcaagctaacataccaaaacaaagttgtgagagtccagcggcccgccaagaatggcaccgtgatggatgtgattagcaggcgtgaccagcgaggttccgggcaggtcggaacatatggccttaacacttttaccaatatggaagcacaactgatccgccagatggagagtgagggcatattctctcctagcgaactcgagacgccaaacctggcggaaagagttttggattggttagagaagtacggggtggaacggctgaaaaggatggccatttccggagacgactgtgtagtgaagcccatcgatgaccgctttgctaccgccctcacagcacttaacgatatgggtaaagtcagaaaggacatcccgcagtgggagccttcaaaaggctggaatgattggcagcaagtgcccttctgcagtcatcactttcaccagctgattatgaaggacgggcgggagatagttgtgccatgtaggaaccaggatgagctagtcggacgagctcgtgtgtctcagggcgccggttggagcctgagagagactgcatgcctcgggaagtcctatgcccaaatgtggcagttgatgtacttccatcgccgggacctgaggcttgcggctaatgccatctgttcagcagtacctgttgattggattcccaccagcagaacaacttggtctatccacgcccatcaccagtggatgaccacggaagacatgctgtccgtgtggaaccgcgtctggattgaggaaaatccatggatggaggataaaacacatatcagtagctggggagacgtgccctacctcggcaagcgggaggaccaatggtgcggctcgttaatagggctgaccgctagggccacttgggcaacaaacatccaggttgctatttatcaggtgcgaagattgatcggaaatgaaaactacctggattatatgacctccatgaaacggtttaagaatgagtctgaccctgaaggtgccctctggtga

SEQ ID NO: 14247 - RNA, 9879 nt, synthetic construct
  misc_feature 1..9879: note = derived and/or modified CDS sequence (opt3) from DENV-1__JN205310__SS-prME
  source 1..9879: mol_type = other RNA
agcgtgaccgtcctgttcatgctccttcccacagccctggcttttcacttgactacgttaggcggggagcctcatatgatcgtttccaagcaggaaagaggaaaatctctgctattcaagacctcagcaggtgtgaacatgtgcacactcattgccatggacctgggcgagctttgtgaagatactatgacctacaaatgcccaaggataacagagaccgaaccggacgatgtagactgttggtgcaatgcgactgagacatgggtgacctatgggacgtgtagtcaaactggagagcaccggcgcgataagcgaagcgtcgctctggccccccatgtgggcttgggtctcgaaacccgtacagagacttggatgtcctctgaaggggcatggaaacagatccagaaggttgagacctgggccctgagacaccctggatttacagtgattgctctgttcctcgcacatgccatcggcacctcgattacgcagaagggcatcatatttatcttactgatgcttgtcactccatcaatggctatgaggtgcgtggggattggaaaccgggacttcgtagagggtcccagcggcgccacatgggttgatgtggtcttggaacacgggagttgtgtgaccactatggcgaaaaataagcctacactggacatcgagctactcaaaaccgaagtgacgaacccagcaattctgcgcaagctttgcatcgaggccaaaatatccaataccacaactgattctagatgtcccacccaaggagaagctacactggtcgaggagcaggacactaactttgtttgcaggcggaccttcgtggatcgcggctggggtaatgggtgtggattgtttggcaagggcagcctcattacatgcgccaagttcaaatgcgtaaccaagctggaagggaaaatcgtgcagtacgagaacttaaagtattccgtcattgtgactgttcacacgggagaccagcatcaagtgggtaatgaaacaaccgagcacggcactaccgcaatcatcacacctcaggctccaacctcagaaattcagctgactgattacggggccctcacaccggactgtagtccccgaacgggacttgactttaacgagatggtcctgttgaccatgaaagagaagagctggctagtgcataaacagtggttcctggatctccctctgccatggacttctggcgcgtccacatcacaagaaacctggaatagacaggaccttctggtaacatttaagactgcccacgcaaagaaacaggaggttgtggtcttgggtagccaagaaggggctatgcacaccgccctcacgggcgctaccgagatacagacaagtggaactaccacaatcttcgccggccatctgaagtgcaggttaaaaatggataagctgactctaaaaggggtgtcttatgtcatgtgtaccggatccttcaagctcgaaaaggaggtggcagagacgcagcacggtacagttctggtgcaggtaaaatacgaaggcaccgacgccccctgcaagattcctagctcgtctcaagatgagaaaggggtcatccagaacggacggcttataactgctaatccaattgtgacagacaaggaaaaacccgttaacatcgaggcggagccgccttttggcgaatcctatatcgtggtcggtgcaggggagaaggccttgaagctgtcatggttcaaaaagggcagtagcattggaaaaatgtttgaagctaccgcccgtggcgcacgcagaatggccatcctcggggatactgcttgggacttcggatccattggtggcgtgtttacctctgtagggaagctggtgcatcagatattcggaacagcctacggcgttctttttagcggtgtctcatggacgatgaaaatcgggattggcatcctgttgacctggctcggactgaatagtaggtccactagcttatctatgacatgtatcgcagtgggcatggtgaccctgtacctaggggtcatggttcaggcggattcaggatgcgtgattaactggaagggccgggagctcaagtgtggtagtgggatattcgtgacaaacgaagtacacacttggaccgagcaatataaatttcaggctgacagccccaagcgactgtccgccgcaatcggaaaagcctgggaggaaggcgtctgcggtattcgctctgctacgagacttgagaatatcatgtggaagcagatttcgaacgaattgaatcatatcctgctcgagaacgatatgaaattcacagtggttgtgggcgacgtcagcgggatactggcccagggaaagaaaatgatcaggccacaacctatggaacacaagtactcctggaagtcatggggcaaagcaaagattatcggggctgacgtgcagaataccacttttattatcgatggacccaacaccccagagtgtcccgacaatcagcgggcctggaacatatgggaggttgaagattatggcttcggtatttttacaactaatatctggttaaaactgcgcgacagtttcacccaggtgtgcgatcacagacttatgtctgcggccattaaggacagcaaagctgtacatgcagatatggggtactggatcgagtccgaaaagaaggagacatggaaattggccagggcttcattcatagaagtcaagacgtgtatctggcctaaaagccacaccctctggtctaacggagtgctggagtccgagatgattatcccaaagatttatggcggtccggtgagtcaacataattaccgtcccggctattttactcagacagccgggccttggcacctaggaaaactggaactcgacttcgatctgtgcgagggcaccactgtcgttgtggacgaaaactgcgggaatcggggaccaagccttcgaacaaccacggtaactggcaagaccacacacgagagatgttgcaggtcttgtaccttgccccctctgcgctttaagcgggaggatggttgctggtacgggatggaaatcagaccagtgaaagagaaggaagagaacttagtcaaatccatggtgtcagcaggaagtggcgaagttgacagcttctcgctcggtctgctttgtatatccattatgatcgaggaggtgatgaggtctcgctggagccgaaagatgctgatgactggcacattggcggtctttctcctgctaaccatggggcagtcaacatggaatgatctgatccggctctgcactatggtgggagccaacgctagtgacatgatgggcatggggaccacgtacctggcccttatggcaacattccgtatgagacccatgtttgctgttggattgctgttcaggcgcttaacctcccgggaaattctcctgcttactgtgggcctgtctctagtcgccagcgtagagctcccgaactccctggaagagttgggtgacgggctggcaatgggaatcatgatgttaaaactcctgaccgattttcaacctcatcagctttgggccacactgttgtcactcactttcgtgaagaccacgctgagcctacactatgcttggaagacaatggcgatgattctgagtatagtttctcttctcccactgtgtttgtccaccactagccagaaaacaacctggctgcccgtgttactcggctcgctgggctgcaagcctcttactatgtttctgatcacagaaaataaaatttgggggagaaggtcatggcccttgaacgagggaatcatggccattggtatcgtctctatactcctgagttccccactaaagaatgacgtgcctctggcaggcccccttatcgctgggggaatgctcattgcctgttacgtaatcagcggctctagcgccgatctgtccttggagaaagctgcagaagtgtcatgggaggacgaagccgagcatagtggtgcgagccacaacattttagtcgaagttcaggatgacgggaccatgaagatcaaagatgaggagcgagacgatacgctgactatactcctgaaggctacccttctggtgatttctggagtgtatccaatgtccatcccggccacattgttcgtctggtacttttggcaaaagaaaaagcagcgctcaggcgtgctatgggacacccctagtcccccagaagttgagcgggcagtactggataatggcatctatagaattctccagagggggctgcttggacgtagccaggtgggtgtcggcgtgttccaagaaggggttttccatacaatgtggcacgtgactcgcggagccgtcttaatgtaccagggcaaacggctggagccctcctgggcttctgtgaagaaagacctcatatcgtatggtgggggatggagatttcagggcagctggaacaccggcgaggaagtacaggtcatcgcagtggagcctgggaagaatccaaagaacgttcaaacgacacccggaactttcaaaacccctgaaggtgaggtgggcgccattgcgttggattttaagccggggacatcaggatccaccatcgtcaatagggaaggcaaaattgtgggtctgtacgggaacggagttgtgactaccagtggcacatacgtctctgctatcgcccaggcaaaggccagccaggagggcccactccccgagatagaagacgaggtgttccgaaaacggaatctgacgatcatggaccttcaccctgggtccggaaagactcgcagatatctgccagctattgtaagggaagccatcaagcggaaattgcgaaccctagtgctggcacccacaagagttgtcgcttcagagatggccgaagcgctcaagggtatgcctattcgctaccaaaccactgccgtgaaatctgagcatacaggcaaggagatcgtggatttaatgtgccacgcaacctttacgatgaggctgcttagcccggtccgtgtacccaactataatatgataattatggacgaagctcatttcactgatccagccagtatcgctgcacgggggtacatctccacaagagtgggaatgggcgaggccgccgctatttttatgaccgcgacccctcccggtagcgttgaagcattcccacagtctaacgccgtgatccaggacgaggaaagggatatacctgagcgctcatggaattccgggtatgagtggattactgactttcccggaaaaacagtctggttcgtgccaagtatcaagagcggcaacgatattgctaactgtctgcgaaagaatggcaaaagagttgtgcagctctcgcggaagacctttgacacagaataccaaaaaactaagaacaatgattgggactatgtcgtgacgaccgatatctctgagatgggggccaacttcagggcagaccgcgtaatagacccgcgtagatgcttgaaacctgtgattctgaaggatggacccgaacgggttatcctcgccggtccaatgcccgtcacagtggcttccgcggcccagaggcgcggccgaatcgggagaaatcctaacaaggagggagaccagtacgtgtacatgggccagccactgaataacgatgaggaccacgcacattggactgaagctaaaatgcttctagataatattaacacccccgagggtatcattcctgccctgttcgaaccggagcgggaaaagagcgcagccatagacggggagtataggttgcgcggcgaggctagaaaaacatttgtcgaattaatgaggcggggagatctgccagtttggctctcatacaaggtggccagtgagggcttccaatattctgaccgtcgctggtgctttgatggggaacgaaataaccaggtactggaggaaaatatggacgtggagatctggaccaaagagggagaaagaaagaaacttaggccccggtggctggatgcgcgcacttactccgaccctctcgcattgagagagttcaaggaatttgccgctggtaggcggagcgtctcaggcgatctgattctagagatcgggaagctgccccagcacctcacgcttaaagcccagaacgctctggacaatttagtgatgttgcacaacagtgaacaaggaggcaaggcatatcgacatgccatggaggagctgccagacaccatcgaaacactcatgctgcttgctctgattgccgttctcactggtggggtgaccttgttctttctgagcggcagaggattaggcaaaacatccatagggctactgtgtgtcatggcatctagcgtactcctttggatggcgtccgtggagcctcactggatcgccgcttcaattatcctggaattctttttgatggttctgctcattcccgagccagatcgccagaggacccctcaggacaaccagctggcctacgtggtcatcggacttctcttcatgatactgactgtggcagctaatgagatgggtttgctggaaacaacgaagaaagatttaggcatcgggcatgccgcagccgagaaccaccaccatgctgcgatgctagacgtcgatctgcacccggcctctgcatggaccctctatgctgtggccactacaattatcacccccatgatgcggcataccattgaaaatacaactgccaacatcagtcttacggcaatagctaatcacgccgcgattctgatgggattggacaagggctggccaatctcgaagatggatattggtgttcctctgctcgctctggggtgctacagccaagtgaacccccttaccttaacagccgcagtactgatgctcgtggcccattacgctatcataggcccaggattgcaggcaaaagccactcgtgaggcgcagaagagaaccgctgccggcatcatgaaaaatcctacagtcgacgggattgttgcaatcgatctggaccccgtggtctatgatgccaagattgaaaaacaactaggacagatcatgctgctcatactttgtacctcccagattctgttgatgaggactacgtgggctctgtgcgagtctatcacactcgccaccggcccgctgactaccttatgggagggttcaccagggaagttttggaacacaactatcgcagtgagcatggctaatattttccgcggatcctaccttgccggcgcgggtctggcctttagtctcatgaagtctctaggcgggggacggcgaggcaccggggcacagggagaaacactgggcgagaaatggaagagacaattgaaccagctgagcaaatcagaattcaatatctataagaggtccggtataattgaggtagaccgcagtgaagctaaagaggggctcaagcggggagagacgaccaagcacgccgtgagcagaggcactgcaaaacttcgttggttcgttgaaaggaacctggtgaagcctgagggtaaagtcatcgatttgggctgtgggcggggaggctggtcttactattgcgctgggctgaagaaagtgacagaagtcaagggatacaccaaaggcggtcccgggcacgaggaaccaattcccatggccacttatggatggaatctcgtgaagttacattccggcaaggacgtttttttcacacctccggagaaatgtgacaccctgctttgcgatatcggcgagtcaagccccaacccaacgatagaagaggggcgcaccctgcgagtactaaagatggtggaaccttggctcagaggaaatcagttttgtatcaaaattctgaacccctacatgccttcggtcgtggagacattggagcagatgcaaaggaagcacggtggcatgctggttcggaatccactctctcgcaacagtactcatgaaatgtactgggtgtcctgcgggaccggaaacatcgtcagcgccgtgaatatgacatcaagaatgcttctgaacaggttcactatggcgcaccgaaaacccacctatgagcgggacgtagatttaggcgctggtacacgtcacgtggcagttgaacctgaggtcgccaatctggacattatcgggcagagaattgaaaacatcaagaatgagcataagtccacctggcactacgatgaggacaacccatataaaacttgggcttaccatggatcttatgaagtgaagcccagcggcagtgcctccagcatggtgaatggcgtcgttcgcttgctcacgaaaccgtgggatgtgatacctatggtaacacagattgcaatgaccgacactaccccatttgggcagcaaagggtgttcaaggagaaagtcgatacacggacgcccaaggccaagagaggaaccgctcagatcatggaagtgactgcgcgctggctgtggggttttctatctaggaacaaaaagcctcgaatctgtacacgggaggaattcaccagaaaagttaggtcaaatgccgcaattggcgctgtgtttgtcgacgagaaccagtggaatagtgccaaggaggcagtggaagatgagcgcttctgggaccttgtacaccgtgaacgggagctgcataaacaagggaagtgcgccacttgcgtttacaacatgatgggaagaagggaaaagaaactcggcgagtttggtaaggctaaagggtcccgcgccatatggtatatgtggctgggagcgcgattcttggagtttgaagcactgggcttcatgaatgaggaccactggttcagccgggaaaactctctctcgggcgtggagggggagggacaccataagcttggttacatcctgagagatatttcaaaaatcccaggcgggaatatgtacgccgacgatacagctggatgggacaccaggattacagaagatgacttacagaacgaggccaagatcactgatataatggaacccgagcacgcactgttggctaccagcatctttaaactcacgtatcagaacaaggtcgtgcgcgtgcagagaccggccaagaatggcaccgtcatggacgttatttcccggagggatcaacgtggtagtgggcaggtgggaacatacggcctgaacactttcaccaatatggaagctcagctaatccgacagatggagtctgagggcatttttagcccttccgaacttgagacacccaacctggccgaacgcgtattcgactggctcgagaaacatgggatcgaaagactgaagcggatggcaatatcaggagatgactgtgtggtcaaaccaattgatgacaggtttgcgactgccttgaccgctttaaatgacatgggtaaggtgcgcaaagatatccctcaatgggagcccccaaagggctggaacgactggcagcaggttcccttctgcagtcaccactttcatcagctgatcatgaaggatgggagagagattgtggtcccttgtcggaatcaagacgaactcgtgggaagggcccgagtatctcagggcgcaggttggagccttcgtgagacggcttgcctggggaaatcctatgcccagatgtggcagctaatgtacttccacagacgcgatctgcggctcgcagccaacgcgatatgttcagctgttccagtggactgggtcccgacaagcaggaccacttggtctatccatgcccaccatcaatggatgacaaccgaagatatgttgtccgtgtggaatagagtttggattgaggaaaacccctggatggaggacaagactcacgtgagtagctgggaggatgtcccttatctgggaaaacgcgaagaccagtggtgcggctcgcttatcggcctgaccgcacgggccacatgggctacgaatattcaggtggccatcaaccaagtaaggcgactcatagggaatgagaactacttagattatatgacctccatgaagagatttaaaaatgaatctgacccagagggagcactgtggtga

SEQ ID NO: 14248 - RNA, 9879 nt, synthetic construct
  misc_feature 1..9879: note = derived and/or modified CDS sequence (opt3) from DENV-1__HQ332182__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaaggggacatcttatgtgatgtgtactggatccttcaaattggagaaggaagtcgctgagacccagcacggtacggtgctggttcaggtgaagtacgagggcacagatgcgccttgcaaaataccattcagcacccaagacgaaaagggggtaactcagaacggacgcctcatcacagcaaatcccattgtcaccgataaagagaagcctgtgaacatcgaaactgagccaccctttggcgagtcgtatatagttgtgggtgccggggaaaaagctctgaagctttcttggttcaagaaaggctcctcaattggaaagatgtttgaggccaccgcaagaggcgccaggcggatggctatcctgggggacacagcctgggatttcggaagtatcggtggcgtctttacgagcgtggggaaattggtacatcaggtgttcggaaccgcatacggcgttctcttttccggtgtctcttggactatgaagattgggatcggcattctgttaacatggctgggactaaatagccgatcaaccagtctctccatgacatgtatagcggtgggcatggtgactctgtaccttggggtcatggttcaggctgacagcggatgcgtgatcaactggaaaggccgcgaattgaagtgtggttctgggattttcgtgaccaacgaggtacacacgtggacagaacaatataagtttcaggccgattcaccgaaaagactgagtgcagccatcggaaaggcttgggaggagggcgtctgcggtatcaggagcgccacccggctcgaaaatattatgtggaaacagatatccaacgagctgaatcatatcttactggaaaacgacatgaagttcactgtggttgtgggcgacgcaaatgggattcttgctcagggaaaaaagatgatccgccctcaacccatggagcacaaatactcttggaagtcgtggggcaaggccaaaattatcggggcggatatacagaacaccacatttatcattgacggaccagatactcctgaatgtcccgacgatcagagagcctggaatatctgggaggtcgaggactatggcttcggtatttttaccacaaacatctggttgaagctcagggatagctacacgcagatgtgcgaccaccgtctgatgtccgctgcaataaaagattcaaaggccgtgcatgctgacatggggtattggattgaaagtgagaaaaatgaaacctggaagctagcccgggcatctttcatcgaggttaagacttgtacatggccaaaaagccacaccctgtggtccaacggagtgctcgaatcagagatgattatccccaagatatacggcggtcctatcagccaacataattatcgaccaggctacttcactcagacagcggggccgtggcacctgggaaaacttgagttggattttgacctgtgcgaaggcaccacggtagtcgtggatgagcactgcgggaacagaggaccctctttaaggactaccacagtgaccggcaagattatccatgaatggtgttgccgctcctgtactctccctccactgcggttcagaggtgaggacgggtgctggtacggaatggagattaggcccgtcaaagaaaaggaggaaaatcttgttcgcagtatggtgagcgccggctctggtgaggtagactccttttcactgggcatcttgtgtgtgagtataatgattgaagaggtcatgcgaagccggtggtcgcgtaagatgctcatgacagggaccctggctgtgttcctactgctcatcatgggacagctgacatggaacgatcttatcagattgtgcattatggttggcgccaatgcatccgacaggatggggatgggaactacctatctggctttaatggccacgtttaaaatgcgccctatgttcgcagtgggcctcctgtttcggagacttacatctagggaggtcctgctactcaccatcggtctgagcttggtggcctcagttgaactgccaaacagtttagaggaactcggggatggactggctatgggcattatgatgcttaagctgttgactgagttccaaccccaccagctctggaccacactgctatccctgacttttataaaaaccacgctttctctcgactacgcgtggaagacaaccgccatggcactgagcatcgtgtccttgttcccgctgtgtttatcaactacaagccagaaaaccacttggctccctgtcctgcttggcagttttgggtgcaagccactgacaatgttcttgattaccgaaaacaagatctggggacgaaaatcttggcccattaatgagggtatcatggctataggcatcgtatccattctcctgagctcgctactgaagaacgatgtgcctcttgccgggcccctcatcgccggaggcatgctgattgcttgttatgttatctcaggttctagtgcagacttgtccttagagaaagccgcggaagtgagctgggagcaggaagctgagcattctgggacgagccacaatatactggtcgaagtgcaagatgacggaactatgcgcattaaggatgaggagaaagacgataccctcacaatcctgcttaaggccaccctgttggcagtatccggcgtgtacccaatgtcaatccctgccacactatttgtctggtatttctggcagaaaaagaagcagcggagtggcgttctgtgggacactcccagcccaccggaagtggagagagctgtgctcgatgacgggatttacaggatactgcagcgtggacttttaggtcgctctcaagtcggcgtgggggttttccaggacggagtatttcataccatgtggcacgtgacgcggggcgcagtcctgatgtatcagggtaaaagactcgaaccttcctgggcctcagtgaagaaagatttgatcagttacgggggaggctggaggttccagggcagctggaacacaggggaggaggttcaagtgattgcggtcgaacccggaaagaatccaaaaaacgtgcagactacccccggtacatttaagacccctgagggcgaagtaggggctatcgccctggacttcaagccaggaacttccggctctcccattgtcaatcgagagggtaaaatcgtggggctctacggaaacggcgttgtgaccacatcgggcacgtatgtcagcgcaatagcccaggctaaggcctcacaagaagggcctctgccggagatcgaggatgaagtgtttaaaaagcggaatcttactattatggacctgcacccaggatccggtaaaacccgcagatacttgcccgcaatcgttagggaggctattaagcggaagctacgaacactgatcctcgcccctaccagagtggtcgcgagtgaaatggccgaggcattaaaaggcatgccaatacgctatcagactacagctgtgaagtctgaacataccgggagggagattgtagatctgatgtgccacgccacgttcactatgcgtcttctgagccccgtgcgggttcctaactacaatatgatcatcatggacgaggctcattttacagatccggcatccattgccgccagaggatatatctcaaccagggtcggcatgggtgaagctgcggcaatattcatgaccgccactcccccagggtctgtggaggcttttcctcagagcaacgccgtgattcaggacgaagagcgcgatatccccgaacgaagttggaattccggatacgactggattacagatttcccaggcaaaaccgtctggtttgtacctagcatcaagtctggcaacgacatagcaaattgtctcagaaaaaacgggaagcgggtgattcaattgtcaaggaagacattcgacactgagtatcagaaaacgaagaacaatgattgggactacgttgtgaccacagatatctccgagatgggagccaacttccgcgctgaccgtgtcatcgatcccagacggtgcctgaaaccagtgattctcaaggacggtccggaaagggttatcctggcgggccctatgcccgtgactgtcgccagtgcagctcagcgccgagggagaattggacggaatcagaacaaagagggcgatcaatacgtgtatatgggtcagccacttaataacgacgaagatcacgcccattggaccgaggcaaagatgctactggacaatataaacacacccgaggggatcattcctgccttgtttgaaccagagagggaaaagagcgctgccatcgatggcgagtaccgcttaagaggagaagcgaggaaaaccttcgtagagctgatgcggcgtggcgacctccccgtgtggctgtcgtataaggttgcatctgaggggtttcagtactccgatcgccgatggtgcttcgacggagaaagaaataaccaggtccttgaggaaaatatggacgtggagatctggactaaagaaggtgagaggaagaaactgcggcctcgctggctcgatgccagaacgtatagcgacccgttggctctgagggagtttaaggaattcgccgctggccggcgatcagtgagtggggatctaattctggagataggaaaactcccacaacaccttaccctgagagcacagaacgccttagacaatttggtcatgctgcacaactctgaacagggcggtaaggcttaccgccatgccatggaggaactccccgatacaatcgagactctgatgcttctggcactcattgcggttttgaccgggggcgtgacactgtttttcttatccggaaagggcctagggaaaaccagcatcggactgctctgtgtaactgcctcaagtgtgcttctgtggatggctagcgtcgagcctcactggattgccgcatccatcatattggaatttttcctgatggtgctcctgatccccgagccagacaggcagcggacacctcaagataatcagcttgcttatgttgtgattggtctcctgtttatgatcttgacggtcgccgcaaacgaaatgggcctgttagagaccactaagcgtgacctagggattggacatgtagccgctgagaaccaccagcacgcgacaatgctggatgtggacctcagacccgcctctgcatggaccctttacgctgttgccaccacagtgatcactccaatgatgaggcatacgatagaaaataccacagccaacattagcctgactgcaatcgctaatcaagccgcgattttgatgggcctggataaaggttggcctatctccaagatggacataggggtcccgctcctggctcttggctgctactcacaggtgaaccccttaaccctgacagccgcagtcctcatgttggtggcccactatgctatcattggaccaggcctgcaggcaaaagccacccgcgaggcgcagaagcggactgctgccgggatcatgaagaatcctacggttgatggaattgtggcaatcgacctagaccccgtagtgtacgatgccaaattcgaaaagcaactgggccagataatgctccttattctgtgtgcttctcaggtcttgctgatgcgaacaacctgggccctctgcgagagtatcactctggcaaccggtccattaacaactctttgggaagggtcgcctggaaaattttggaacaccacaatcgctgttagcatggccaatattttcagaggctcctatctggcgggtgccggcctcgcattctctctaatgaagtcactggggggaggcaggcgcgggacgggagctcagggcgagaccttgggtgagaaatggaagcggcaactgaaccagctcagcaagtccgaatttaatacttacaaaagaagtgggatcatggaggtggaccgttctgaagccaaggagggacttaaaaggggcgaaacaaccaagcatgcagtcagccggggtactgctaaactgcgctggttcgtggagcgaaacttggtaaagcccgagggcaaggtgatagatctggggtgtggaagaggcgggtggtcatattactgcgccggactcaaaaaggttacagaagtgaaaggctataccaagggtgggccgggacacgaggaaccaattcctatggccacgtacggctggaatttagtcaaactgcattccggcaaggacgtgtttttcatgcccccagagaaatgtgatacccttctgtgcgacatcggggaaagtagccccaaccctacaattgaggagggaaggactctacgggtcctcaagatggtggaaccgtggctgcgcggtaatcagttttgtatcaagatattgaacccctacatgccatctgttgtagagaccctggaacagatgcaaagaaaacacggcgggatgctcgtgaggaatcctctttcccgaaactcaacacacgagatgtattgggtcagctgcggaactggcaatatcgtgtcggcggttaacatgacctctcggatgctgttaaaccgtttcacaatggctcatagaaagcccacctacgagcgcgatgtggacctgggtgcagggactaggcacgtcgccgtggaacctgaggtagctaatttggatattatcggacagcggattgaaaacatcaaaaatgagcataagagtacgtggcactatgacgaagataacccatacaaaacatgggcctatcacggctcctacgaggtgaagcccagcggctcagcatcctctatggttaatggggtcgtgagactcctgaccaagccttgggacgtgattccaatggtcactcagatcgccatgaccgacacaacgccctttggacaacagcgcgttttcaaagagaaggtggataccaggactccgcgagctaaacggggtacaacccagataatggaagtaactgcgaagtggctatggggctttcttagcagaaacaaaaagcctaggatttgtacacgcgaggaattcacccgtaaggtgcggagtaatgccgcagtcggggctgtgtttgttgacgagaaccagtggaattccgccaaagaagcagtggaggatgagagattctgggacctggtccatagggaacgcgagctccacaagcaaggaaaatgcgccacatgcgtgtataacatgatgggcaagcgagaaaaaaagctgggtgagtttgggaaggctaaaggaagccgggccatctggtacatgtggttgggcgcgagattcctggaattcgaggcactcggctttatgaatgaggatcattggttctctagggaaaactcacttagtggggtagagggagaaggtctgcacaagttaggctacatcctgcgcgacatttccaaaataccagggggaaatatgtatgccgatgacactgctggctgggataccagaatcacggaggacgatttgcagaacgaggccaagattaccgacatcatggaacccgagcatgcactcctggctacaagcatttttaaactaacttaccagaataaggttgtgcgggtccagaggcctgccaaaaacggtaccgtgatggatgtgatctctcgtcgagaccaacgcgggtcgggacaggtcggcacatatggccttaacactttcaccaatatggaagttcagctgataagacagatggagtcagaagggatctttctcccaagcgagctggagacgcccaacttggctgaacgggtgttagactggctggagaagcacggagccgaaaggctcaagcgcatggcaatttccggtgatgactgtgtagtgaaaccgatcgatgacagattcgcgacagcccttaccgctctgaatgatatgggcaaggtccggaaagacattcctcaatgggagcccagtaaggggtggaacgattggcagcaggtgccattttgctctcaccatttccaccagctaatcatgaaagacggaagggaaatagttgtgccttgtcgaaatcaagatgagctggtcggccgtgccagagtgagccagggtgcagggtggtccctccgcgagactgcttgcttgggaaagtcatacgcccagatgtggcaactgatgtattttcatcggagggaccttagactggcagccaacgcgatttgtagtgctgtacccgttgattgggtgccaacatctcgcaccacttggagcatccacgcccaccatcagtggatgaccacagaagacatgctctccgtctggaatcgggtgtggatcgaggaaaacccctggatggaggacaagacgcacgtttcaagctgggaagaggtgccttacttaggcaaaagggaggatcagtggtgcggctctctgattgggttgaccgcacgagccacttgggctacaaatatacaggtcgccatcaaccaagtgagacggctgattggaaatgaaaactatctcgactacatgacctccatgaagaggttcaaaaatgagagtgatccagaaggtgcactttggtga

SEQ ID NO: 14249 - RNA, 9879 nt, synthetic construct
  misc_feature 1..9879: note = derived and/or modified CDS sequence (opt3) from DENV-1__HQ332181__SS-prME
  source 1..9879: mol_type = other RNA
agcgtgaccatgctgctcatgcttctgcccacagccttggctttccacttaactacgaggggcggggagcctcatatgatcgtctccaaacaggaaaggggaaaatctctgctatttaagacctcagctggtgttaacatgtgcaccctcattgccatggacctgggcgagctttgtgaagatactatgacctacaaatgcccacggataacagaggcggaaccggacgatgtggactgttggtgcaatgctaccgatacttgggtaacatatgggacctgtagtcagacgggagagcaccgccgagagaagcgtagcgtggccctggctccccatgtcggcttgggtctcgaaactagaaccgagacatggatgtcctctgaaggggcctggaaacagatccagagggtggagacttgggccctgcggcaccctggattcaccgttattgcatttttcctggcccatgctatcggcacatcgattacccagaagggcatcatatttatcctcttaatgctggtgacgccatcaatggccatgcgctgcgtcgggattggaaacagggacttcgtggagggtcttagcggcgcgacttgggtagatgttgtgttggaacacgggagttgtgtcacaaccatggcaaagaataaacccactctggacatcgagctactcaagacagaagtgaccaaccctgccgtgctgaggaaactttgcattgaggctaagatctccaatacgaccacagattctcggtgtccaactcaaggagaagccaccctggtcgaggagcaggacgcaaactttgtttgccgccgaacattcgtggatagaggctggggtaatgggtgtggattgtttggcaaaggcagcctcctgacttgcgctaagttcaagtgcgtaaccaaattagaagggaagatagtgcagtacgagaacctgaaatattccgtcattgtgacagttcacaccggagaccagcatcaagtgggtaatgaaactacggagcacggcacaatcgccaccattactccccaggcgcctacctcagaaatccagctcacagattacggggcccttaccctggactgtagtccaaggactggattggactttaacgagatggtcctactgacaatgaaggagaaaagctggctcgtgcataagcagtggttcctggatcttccgctgccctggacgtctggcgcatccacctcacaagaaacttggaatcggcaggacttgctcgtaacatttaaaaccgctcacgccaagaagcaggaggttgtggtcctgggtagccaagaaggggctatgcacacagccttaactggcgcaaccgagatccagacgagtggaaccacaactattttcgccggccatctgaaatgccgtctaaagatggataaactcaccctgaaggggatgtcttatgtgatgtgtacaggatccttcaaacttgaaaaggaggtcgctgagactcagcacggtaccgtgttggttcaggtgaagtacgaaggcacggacgcgccttgcaaaataccatttagcacacaagatgagaagggggtaacccagaacggacgcctgatcactgcaaatcccattgtcacagacaaagaaaagcctgtgaacatcgagaccgagccacccttcggcgaatcgtatatagttgtgggtgccggggagaaagctctcaagctgtcttggtttaagagaggctcctcaattggaaaaatgttcgaagccactgcaaggggcgcccggcgaatggctatccttggggataccgcctgggactttggaagtatcggtggcgtcttcacaagcgtggggaagctggtacatcaggtgtttggaacggcatacggcgttttgttctccggtgtctcttggaccatgaaaattgggatcggcattctcctgacttggttaggactgaatagccgctcaacaagtctatccatgacctgtatagcggtgggcatggtgacactctacctgggggtcatggttcaggctgatagcggatgcgtgatcaactggaagggcagagagcttaaatgtggttctgggatttttgtgactaacgaagtacacacctggacggagcaatataagttccaggccgactcaccgaagaggttgagtgcagccatcggaaaggcttgggaggaaggcgtctgcggtatccggagcgccacacgcctggagaatattatgtggaagcagatatccaacgaactcaatcatatcctgttagagaacgatatgaaatttaccgtggttgtgggcgacgcaaatgggattctggtccagggaaagaaaatgatcagacctcaacccatggaacacaagtactcttggaaatcgtggggcaaggctaagattatcggggccgacatacagaacactaccttcatcattgatggaccagacacacctgagtgtcccgatggccagagggcgtggaatatctgggaggtggaagactatggttttggggttttcactaccaacatttggcttaaattgcgtgatagctacacacagatgtgcgaccaccggctcatgtccgccgctatcaaggattcaaaagcagtgcatgccgacatgggatattggatagagagtgaaaagaatgagacgtggaaactggctcgagcctctttcattgaagtaaagacctgtacttggccaaagagccacacactatggtccaacggcgtcctggagtcagagatgatcattcccaaaatctacggtggccctataagccaacataattatagaccagggtactttacccagactgcaggaccgtggcacctcggcaagctggaacttgatttcgacttgtgcgaggggacaaccgtggtggtcgatgaacactgcggaaacaggggcccctctctgcgcacgactaccgttacaggtaaaatcattcatgagtggtgttgccggtcctgtaccttacctccactcagatttagaggggaagacggatgctggtacggcatggaaatccgccccgtgaaggagaaagaagagaatctggtacgaagtatggtgagcgcgggtactggcgaagtcgattctttctcccttgggattctgtgtgtgtcaatcatgatagaggaggttatgcggagtcgttggagcagaaagatgttgatgacaggaaccctcgccgtgtttctgctactgattatgggccagctcacatggaacgacctgatcaggctttgcatcatggtcggggctaatgcctcggaccgcatgggaatgggcactacctatttggcactgatggctacgttcaagatgcggcctatgtttgccgtgggtttactcttcagaaggctgacatcccgagaagttcttctgctaaccattgggctctctctggtggcaagcgtcgagttgccaaactcactggaagagttaggagatggcctcgccatgggcatcatgatgctgaaacttctgactgaatttcaaccccaccagttgtggaccacactcctgagtctaactttcgtaaagaccgctctgtcccttgactacgcgtggaaaacgacagccatggtgctctctattgttagcctgtttccgttgtgtctgtccaccacttcacagaagacaacctggttacctgtgctcctggggagcttcggatgcaaaccacttactatgtttctgataacagagaacaagatctggggtcgcaagagttggcccttgaatgagggcattatggcaatcgggattgtctctatcctcctgtccagcctactgaaaaacgatgtgcctcttgctggacccctcatagccggcggtatgctgatcgcctgttatgtaatttcggggtcatctgctgacttgagtttagaaaaggcagccgaggtgtcctgggaacaggaggcggaacatagcggagcttctcacaatatcctggtcgaggttcaagatgacggcaccatgaaaattaaggatgaggaacgggacgatacgctcactatcctgcttaaagccaccctgttggcagtgagcggcgtgtacccaatgtccatacctgccacactattcgtctggtatttctggcagaagaaaaagcagagatcaggggtgctgtgggacacccccagtccaccggaggttgaaagggctgtactcgataacggaatttaccgtatcctgcagcgcggtcttttaggccggagccaagtgggggtcggagtgtttcaggacggcgttttccatacaatgtggcacgtgactagaggtgcagtcctgatgtatcaggggaagaggctcgagccttcttgggcctccgtgaaaaaggatttgatctcatacggaggcggctggcgatttcaggggagttggaataccggagaggaagtacaagtcattgcggtggagcccggtaaaaacccaaagaatgttcagacgacacccggcactttcaaaacccctgaaggggaggtgggagctatagccctggactttaagccaggcacaagcggttcccccatcgtcaaccgggaagggaagattgtgggactctacggcaatggcgttgtgaccacttctgggacctatgtctcggcaatcgcccaggctaaagccagccaagagggacctctgccggagattgaagacgaggtgttcaagaaacgcaaccttacaatcatggatctgcacccaggttcaggcaagacgagaaggtacttgcccgcaatagtacgggaagctatcaaacgaaagctaagaactctgattctcgcccctacccgcgtggttgcgtccgagatggccgaagcattaaaggggatgccaatcaggtatcagacaaccgctgtcaaaagtgagcatactggacgtgagattgtggacctgatgtgccacgccacatttaccatgcggcttctgtctcccgtgagagtccctaattacaacatgatcataatggatgaagctcatttcacggacccggcaagcattgccgccaggggctatatctccactcgcgtaggtatgggggaggctgcggcaatctttatgacagccacacccccaggatcagtggaggctttccctcagtctaatgccgttattcaggatgaggaacgagacatccccgagagaagctggaacagtggctacgattggataaccgactttccaggcaagactgtgtggttcgtcccttccattaaaagcgggaatgatatcgcaaactgtctccggaagaacggaaaaagggtgattcaattgtctcgcaagacattcgacaccgagtatcagaagactaaaaataacgattgggactacgttgtgactacggacatctcagaaatgggtgccaattttcgtgctgatagagtcatagacccccggaggtgcctgaagccagtgattctcaaagatggcccggagcgcgtaatcctggcggggcctatgcccgtgaccgttgcctccgcagctcagcgaagaggacggatcggcaggaaccagaataaggaaggtgaccaatacgtctatatggggcagccacttaacaatgatgaggaccacgcccattggacagaggcaaaaatgctactggataacattaatactcccgaaggcatcattcctgccttgttcgagccagaacgcgagaagagtgctgccatagacggagaatacagattaaggggcgaggcgcggaagacctttgtggagctgatgcgtcgcggggatctccccgtgtggctgagctataaagtcgcatcggaaggattccagtactctgaccgaagatggtgctttgatggtgagaggaacaatcaggttcttgaagagaacatggacgtggaaatctggacaaaggagggcgagcggaaaaagctgcgccctagatggctcgatgccaggacctattccgacccgttggctctgcgggagttcaaagagtttgccgctgggcgaagaagcgtatcaggagacctaattctggaaatcggcaagctcccacaacaccttactctgcgcgcacagaatgccttagataacttggtgatgctgcacaatagtgagcagggtgggaaggcttacaggcatgccatggaggaactccccgacacgatcgagaccctgatgcttctggcactcattgcggtcttgacaggcggagtgactctgttctttttatctggcaaggggctaggaaagacctccataggtctgctctgtgttacagccagctcagcacttctgtggatggccagtgtggaacctcactggatcgcagctagcattatcttggagttctttctgatggtcctcctgattcccgaaccagatcggcagcgtacccctcaagacaaccagcttgcctatgtagtgatcggcctcctgttcatgatattgactgttgcagccaacgagatggggctgttagagacaacgaaaaaggatctaggaatcggctacgtggctgcggaaaatcatcagcacgccaccatgctggacgtcgatctccaccccgcatccgcttggactctttacgccgtggccacaaccgtcattaccccaatgatgagacatacaatcgagaacactacggcaaatatttctctgaccgctatcgccaaccaagcggctatattgatgggtctggacaaagggtggcctattagcaagatggatatcggcgtgccgctcctggcccttggatgctattcccaggttaatcccttaacactgactgcagccgtgctcatgttggtagctcactacgcaattatcggcccagggctgcaggccaaagcgaccagggaagctcagaagcgcacagccgcaggaataatgaagaaccctaccgtggacggcatcgtcgccattgatctagaccccgttgtgtatgatgctaaatttgagaagcaactgggtcagatcatgctccttattctgtgtacttcacagatcttgctgatgcggacgacatgggccctctgcgaatctataaccctggcaactgggccattaaccacactttgggagggaagtcctggcaaattctggaatactaccattgctgtctcgatggccaacatcttccgaggtagctacctggcgggcgccgggctcgcattttccctaatgaagtctctgggaggcgggagaaggggaacaggcgctcagggtgagacgttgggggaaaaatggaagcgccaactgaatcagctctcaaagagcgagttcaacacctataaacggtccggaatcatggaagtggacagaagtgaggccaaggaaggccttaaacgtggtgagactacaaagcatgcagtatctaggggcaccgctaaactgcggtggtttgtggagcgcaatttggttaagcccgaagggaaggtgattgacctgggatgtggccgagggggatggagctactattgcgccggcctcaaaaaggtcactgaggtgaaaggttacacaaaagggggaccgggccacgaagaaccaatccctatggccacctacggctggaacttagtcaaactgcattcagggaaggatgtgttctttatgcccccagaaaaatgtgacacgcttctgtgcgatataggagagtccagtcccaatcctaccattgaggaaggtagaacactaagggttctcaagatggtagagccgtggctgcggggcaaccagttctgtatcaagattttgaatccctatatgccaagcgtggtcgaaactctggagcagatgcaacgcaaacacgggggaatgctcgtgagaaaccctctttctagaaattccacccacgagatgtactgggtttcatgcggcacaggtaacatcgtgagcgcggtcaacatgacttcgcgaatgctgttaaatcggtttaccatggctcatcgtaagcccacatatgaaagagacgtggatctgggggcaggaacccgccacgtagccgtggagcctgaagttgctaacttggacataatcggccagaggattgagaatatcaaaaacgaacataagtctacttggcactacgatgaggacaatccatataaaacgtgggcctaccacggcagttatgaggtcaagccctccgggagcgcatcatccatggtgaacggagtggtccggctcctgacaaagccttgggatgttattccaatggtgacccagatcgccatgactgacaccacacccttcggtcaacagagagtatttaaagaaaaggtggatacgcgcaccccgagggctaaacgaggcactacacagattatggaggtcaccgcgaagtggctatgggggttcctttctcggaataaaaagcctagaatctgtactagggaagagtttacacgcaaggtgcgtagcaacgccgcaataggagctgttttcgtggacgaaaatcagtggaacagtgccaaagaggcagtcgaggacgaacggttttgggatctggtgcatagagagagggaactccacaagcaaggcaaatgcgcaacctgcgtatacaatatgatgggtaagcgcgagaaaaagctgggggagttcggaaaggctaaaggctcccgagccatttggtacatgtggttgggcgcgcggttcctggagtttgaggcactcgggttcatgaacgaagaccattggtttagcagagaaaattctctttcaggagttgaaggtgagggcctgcacaagttagggtatatcctgagggatatcagtaaaattccaggaggcaacatgtacgccgacgatacagctggttgggacactcgcataaccgaggatgacttgcagaatgaagccaagatcacggatattatggagcccgaacatgcactcctggctacctccatcttcaaactaacatatcagaacaaggtggtcagagtgcagcggcctgccaaaaacgggactgtgatggacgtcattagcaggcgtgatcaacgaggatctggccaggttggcacctacgggcttaatacatttactaacatggaggtgcagctgatccgccagatggaatcggagggaatattcctcccatcagagctggaaacccccaatttggctgagagagccttagactggctggaaaagcacggtgcagagcggctcaagaggatggcgatcagcggcgatgactgtgtagtgaaaccgattgacgatcgctttgccacggctcttacagccctgaacgacatggggaaggtcagaaaagatatccctcaatgggaaccctccaagggatggaatgactggcaacaggtgccattctgcagtcaccattttcaccagctaattatgaaagatggccgggagatcgttgtgccttgtaggaaccaagacgagctggtcggtcgagcacgtgtgtctcagggggctggatggagcctcagagaaaccgcctgcttgggcaagtcctatgcacagatgtggcaactgatgtacttccatcgccgggatcttaggctggccgcgaatgctatatgttcagccgtacccgttgactgggtgccaacaagtagaacaacctggtctattcacgcacaccatcagtggatgactaccgaggatatgctcagcgtctggaaccgcgtgtggatcgaagagaatccctggatggaagacaagacacacgtttcctcatgggaggaggtgccttatttaggcaaacgggaagatcagtggtgcgggagcctgatcggattgacggccagggctacctgggccactaacattcaggtcgcaataaatcaagtgcgaagactgatcggtaacgagaattacctcgactacatgacatctatgaagcggtttaaaaacgaatccgacagtgagggcgctctttggtga

SEQ ID NO: 14250 - RNA, 9879 nt, synthetic construct
  misc_feature 1..9879: note = derived and/or modified CDS sequence (opt3) from DENV-1__HQ332180__SS-prME
  source 1..9879: mol_type = other RNA
agcgtgaccatgctgctcatgcttctgcccacagccttggctttccacttaactacgagaggcggggagcctcatatgatcatttccaagcaggaaaggggaaaatctctgctatttaagacctcagcaggtgtcaacatgtgcacactcatagccatggacctgggcgagctttgtgaagatactatgacctacaaatgcccacggatcacagaggcggaaccggacgatgttgactgttggtgcaatgctaccgatacttgggtgacatatgggacctgtagtcaaacgggagagcaccgccgagacaagcgtagcgtagccctggcaccccatgtgggcttgggtctcgagactagaaccgaaacatggatgtcctctgagggggcctggaaacagattcagagggtcgaaacttgggctctgcggcaccctggattcaccgtgatcgcactgtttctcgcccatgctattggcacatcgatcacccagaagggcataatcttcattttactgatgcttgttacgccatcaatggccatgcgctgcgtggggatcggaaacagagattttgtcgagggtttgagcggcgcgacttgggtggacgtagttctggagcacgggagttgtgtgacaaccatggcaaagaataaacccactctagatattgaactcctgaagacagaggtcaccaaccctgccgtgcttaggaaactgtgcatcgaagctaagatatccaatacgaccacagactctcggtgtccaactcaaggagaggccaccttggtggaagagcaggatgcaaacttcgtctgccgccgaacatttgttgacagaggctggggtaatgggtgtggactcttcggcaaaggcagcctgttaacttgcgctaagtttaagtgcgtgaccaaactggaggggaagattgtacagtacgaaaacctcaaatattccgtgatcgtcacagtgcacaccggagatcagcatcaagttggtaatgagactacggaacacggcacaattgccaccatcactccccaggcgcctacctcagagatccagcttacagactacggggccctgaccttggactgtagtccaaggactggactagatttcaacgaaatggtgctgctcacaatgaaggagaaaagctggctggtccataagcagtggtttcttgacctgccgttgccctggacgtctggcgcatccacctcacaagagacttggaatcggcaggatctcctggtgacattcaaaaccgctcacgccaagaagcaggaagtagttgtgttaggtagccaagagggggctatgcacacagccctgactggcgcaaccgaaattcagacgagtggaaccacaactatatttgccggccatctaaaatgccgtctcaagatggacaaactgacccttaaggggatgtcttatgtcatgtgtacaggatccttcaaattggagaaggaagtggctgagactcagcacggtaccgtcctggtgcaggttaagtacgagggcacggatgcgccttgcaaaatcccattcagcacacaagacgaaaagggggtgacccagaacggacgcctcattactgcaaatcccatcgtaacagataaagagaagcctgtcaacatagaaaccgagccaccctttggcgagtcgtatattgtggttggtgccggggaaaaagctctgaagctttcttggttcaagaaaggctcctcaatcggaaagatgtttgaggccactgcaagaggcgccaggcggatggctatcctgggggacaccgcctgggatttcggaagtattggtggcgtgtttacaagcgtcgggaaattggtgcatcaggtattcggaacggcatacggcgtgctcttttccggtgtttcttggaccatgaagatcgggattggcatactgttaacttggctgggactaaatagccgatcaacaagtctctccatgacctgtatcgcggtcggcatggtgacactgtaccttggggctatggtgcaggccgacagcggatgcgtcattaactggaaaggccgcgaattgaagtgtggttctgggatcttcgttactaacgaggtgcacacctggacggaacaatataagtttcaggcagattcaccgaaaagactgagtgccgctatcggaaaggcctgggaggagggcgtgtgcggtattaggagcgcaacacggctcgaaaatataatgtggaaacagatctccaacgagctgaatcatattttactggaaaacgacatgaagttcaccgtagtcgtgggcgacgctaatgggatccttgcccagggaaaaaagatgattcgccctcaacccatggagcacaaatactcttggaagtcgtggggcaaggcgaaaatcataggggccgatatccagaacactacctttattatcgacggaccagatacacctgaatgtcccgacggccagagagcttggaatatttgggaggttgaggattatggtttcgggatctttactaccaacatatggttgaagctcagggacagctacacacagatgtgcgatcaccgtctgatgtccgcagccattaaagactcaaaggctgtgcatgccgatatgggatattggatcgaaagtgagaaaaatgaaacgtggaagctagcacgggcgtctttcattgaggtcaagacctgtacttggccaaaaagccacacactgtggtccaacggcgtgctcgaatcagagatgatcatacccaagatctacggtggccctattagccaacataattatcgaccagggtacttcacccagactgccggaccgtggcacctgggcaaacttgagttggactttgatctgtgcgaagggacaaccgttgtggtagacgagcactgcggaaacagaggcccctctttaaggacgactaccgtcacaggtaagatcattcatgaatggtgttgccgctcctgtaccctccctccactgcggttcagaggggaggatggatgctggtacggcatggagatcaggcccgtgaaagaaaaggaggaaaatcttgtgcgcagtatggtcagcgctggttctggcgaggttgactccttttcactggggatattgtgtgtgagtattatgatcgaagaggtaatgcgaagccggtggtcgcgtaagatgctcatgactggaacactggccgtgttcctactgctcatcatgggccagctgacctggaacgaccttattagattgtgcatcatggtcggggcaaatgcttccgataggatgggaatgggcacaactcacctggccttaatggcaacctttaaaatgcgccctatgttcgccgtgggtctcctgtttcggagacttacgtctagggaggttctgctactcacaattgggctgagcttgatggcttcaatggaactgccaaacagtttagaggaactcggagacggcctggcgatgggcataatgatgcttaagctgttgaccgagttccaaccccatcagctctggactaccctgctatccctgacatttgtgaaaactaccctttctctcgattatgcctggaagacgacagcaatgatcctgagcattgtctccttgttcccgctgtgtttatcaaccactagccagaaaacaacctggctccctgtgctgcttgggagttttggatgcaagccactgactatgttcttgatcacagaaaacaagatttggggtcgaaaatcttggcccctcaatgagggcatcatggctatagggatcgtttccattctgctaagctcgctgcttaagaacgacgtgcctctcgccggacccctgatcgccggcggtatgttgattgcttgttacgtcatctcagggtctagtgcagatttatccctggagaaagccgcggaagtaagctgggagcaggaagctgagcactctggagccagccataatatactcgtggaagttcaagacgatggcaccatgaagattaaagacgaggagcgcgatgacacgctgactatccttctgaaggcaaccttgctagccgtgtccggcgtctatccaatgtcaatccctgctacactgtttgtgtggtacttctggcagaaaaagaagcagcggagtggggtactctgggatacccccagcccaccggaagtggagagagcagtcctggacgatggaatttataggatacttcagcgtggtttactgggccgctctcaagttggggtgggagtgttccaggacggcgtctttcacacaatgtggcacgtgactcggggtgccgttctcatgtaccaggggaaaagattggaaccttcctgggcgtcagtaaagaaagacctgatcagttatggaggcggctggaggttccaggggagctggaacaccggagaggaggtgcaagtcattgctgtggaacccggtaagaatccaaaaaacgttcagacgacacccggcacttttaagacccctgagggggaagtgggagccatcgcactcgatttcaagccaggcacatccggttctcccattgtcaatcgagaggggaaaatcgtgggactgtacggcaacggcgtagtcaccacttcggggacctacgtgagcgccatagctcaggccaaggcatcacaagaaggacctcttccggagatcgaggacgaagtttttaaaaagcggaatctgacaattatggatttgcatccaggttccggcaaaacgcgcagatatctacccgctatcgtgagggaggccattaagcggaagctgcgaactctcatcttagcgcctaccagagtcgtggccagtgaaatggcagaggctctgaaagggatgccaatacgctaccagacaaccgccgttaagtctgaacacactggaagggagattgtggaccttatgtgccatgctacattcaccatgcgtctgctcagccccgtccgggtgcctaactataatatgatcatcatggatgaggcacactttacggacccggcctccattgccgctagaggctacatctcaactagggtaggtatgggggaagcggcagccatattcatgacagctacccccccaggatctgtggaggcctttcctcagagcaacgcagttattcaggatgaagagcgcgacatccccgaacgaagttggaattccggctatgattggattaccgacttcccaggcaaaactgtctggtttgtgcctagcatcaagtctgggaacgatatagccaattgtttgagaaaaaacggaaagcgggtgattcaactgtcaaggaagacattcgacaccgagtaccagaaaacaaagaacaatgactgggattatgtcgtaactacggacatctccgagatgggtgctaacttccgcgcggatcgtgtgatcgaccccagacggtgcctcaaaccagttattctgaaggatggcccggaaagggtgatccttgccgggcctatgcccgtcaccgtggcaagtgctgcccagcgccgaggaagaattggccggaatcagaacaaagagggtgaccaatacgtttacatggggcagccactaaataacgatgaagaccatgcacactggacagaggccaagatgctgttggataatataaacactcccgagggcatcattcctgctttatttgaaccagagagggaaaagagcgccgcgatcgacggagagtatcgcctgagaggcgaagcaaggaaaaccttcgtggagctcatgcggcgtggggatctgcccgtctggctttcgtacaaggtggcctctgagggatttcagtattccgaccgccgatggtgcttcgatggtgaaagaaataaccaggtactggaggaaaatatggacgtggagatctggacaaaagaaggcgagaggaagaaactccggcctcgctggttggacgctagaacctacagcgatccgctggccctaagggagtttaaggaattcgctgcagggcggcgatcagttagtggagacctgattctcgagataggcaaacttccacaacacctgactttaagagcccagaacgctttggataatctggtcatgctccataactctgaacagggtgggaaggcctatcgccacgcaatggaggaactgcccgacacgatcgagacccttatgctgctcgcgttgattgccgtgctgacaggcggagtgactttatttttcctatccggcaaggggctgggaaaaaccagcatcggtctcctttgtgtcacagcttcaagtgccctgttgtggatggcaagcgttgagcctcattggattgctgcctccatcatactggaatttttcctcatggtgctgcttatccccgagccagataggcagcggacccctcaagacaatcagctcgcatacgtagtgattggcctgttgtttatgatcctgactgtcgccgctaacgaaatggggttactagagacaacgaagaaagatctgggaattggctatgtggcggccgagaaccaccagcacgcaaccatgctcgacgttgatcttcgtcccgcttctgcctggactctgtacgccgtggcaacaaccgtcatcaccccaatgatgagacatacaatagaaaatactacggctaacattagcttgaccgccatcgcgaatcaagctgccattctgatgggtctcgacaaggggtggcctatctccaaaatggatataggcgtaccgctgcttgcattaggatgctactcacaggtgaaccccctgacactcactgccgctgttttgatgctggtggcacactatgccatcattggcccagggctacaggcgaaggctaccagggaggcccagaagcgcacagcagccggaatcatgaaaaatcctaccgtcgacggcattgtggctatcgatctggaccccgtcgtgtacgacgccaagttcgaaaaacaactcggtcagataatgcttctgattttgtgtacttctcagatcctgctcatgcggacgacatgggcactgtgcgagagtatcaccttagctactgggccacttaccacactgtgggaaggatcgcctggcaagttttggaacactaccattgccgttagcatggcgaatatcttccgaggttcctatctcgccggcgcagggctagctttctctctgatgaaatcattgggaggcgggagaaggggaacaggcgcccagggtgagacgctgggggagaagtggaagcgccaactcaaccagcttagcaaatccgaatttaatacctacaagcggagtggaataatggaggtggatagatctgaagcaaaagagggcctgaagcgtggtgaaactacaaaacatgctgtaagcaggggcaccgccaagttgcggtggttcgtggagcgcaacctggtcaagcccgaggggaaagttattgacctcggatgtggccgagggggatggtcatattactgcgccggcttaaagaaagtgactgaagtcaagggttatacaaaagggggaccgggccacgaggaaccaatccctatggcgacctacggctggaatctggtgaagcttcattccgggaaagatgtatttttcatgcccccagagaagtgtgacacgctgctatgcgatattggagaaagtagccccaaccctaccatcgaggagggtagaacactcagggtgctgaagatggttgaaccgtggttgaaaggcaatcagttttgtataaagatcctgaacccctacatgccatctgtggtcgagactctcgaacagatgcaacggaaacacgggggaatgcttgtgcgcaatcctctgtccagaaactcaacccacgagatgtattgggtcagctgcggcacaggtaatattgtgtcggctgttaacatgacttctaggatgttactgaaccgattcaccatggcacatcggaagcccacatacgagcgtgacgtagatttgggggccggaaccagacacgtggctgtcgaacctgaggtggccaatctcgacatcattggccagcgcatcgaaaacattaaaaatgagcataagagtacttggcactatgatgaagacaacccatacaagacgtgggcatatcacggctcctacgaggttaaacccagcgggtcagcctcctctatggtgaatggagtcgtgaggctgctaacaaagccttgggatgtaatcccaatggtgacccagatagctatgactgacaccacaccctttggtcaacagcgggttttcaaagagaaggtcgacacgagaaccccgcgcgcgaaaaggggcactacacagattatggaagtgaccgccaagtggctttgggggtttctgagccgaaacaagaaacctcggatctgtactagagaggaattcacaaggaaggtgcgcagtaatgcagctatcggagccgtctttgttgatgagaaccagtggaattccgcaaaagaagccgtggaggacgagcgtttctgggatctcgtacatcgggaaagagagctgcacaagcaaggcaaatgcgctacctgcgtgtataacatgatgggtaagagggaaaagaaattgggggagtttggaaaggccaaaggcagccgcgcgatttggtacatgtggctgggcgcacgattcctcgaattcgaggcccttgggtttatgaatgaggaccattggttctctcgggaaaactcactgagtggagtcgagggtgaaggcttacacaagctggggtacatattgagagatatctccaaaattccaggaggcaatatgtatgctgacgatacagccggttgggacactaggatcaccgaggatgacctccagaacgaggcaaagattacggatatcatggaacccgagcatgctctgctagccaccagcatatttaaacttacataccagaataaggtggttcgcgtgcagagacctgctaagaacgggactgtcatggacgtgatctctcggagggatcaacgtggatcgggccaggtaggcacctatgggctgaacacattcactaatatggaagttcagctcattcgacagatggagtcagaaggaatctttctgccaagcgagttggagacccccaacttagccgaacgcgtgctggactggctcgagaaacacggtgcagaaagacttaagcggatggcgatttccggcgacgattgtgtcgtgaaaccgatcgacgataggttcgccacggctctgacagccctaaatgacatggggaaggtgcgcaaagatatacctcaatgggagcccagtaagggatggaacgactggcagcaggtcccattttgctctcaccatttccaccagctgattatgaaggatggcagagaaatcgttgtgccttgtcggaatcaagacgagctcgtaggtagggcacgagtgagccagggggctggatggtccttgcgtgagaccgcctgcctgggcaaatcatacgcacagatgtggcaacttatgtattttcatagacgcgatctgcggctcgccgcgaacgctatctgtagtgccgtccccgtggactgggttccaacttctaggacaacctggagcattcacgcacaccatcagtggatgactaccgaagatatgttatccgtgtggaatagagtctggatagaggaaaacccctggatggaggacaagacacacgtgtcaagctgggaagaggtaccttacctgggcaaacgcgaggaccagtggtgcgggtctttgatcggactgacggcccgggctacctgggccactaatattcaggttgcaatcaaccaagtgaggcgactcattggtaatgaaaactatcttgattacatgacatccatgaagagattcaaaaatgagagtgacccagaaggcgctctgtggtga

SEQ ID NO: 14251 - RNA, 9879 nt, synthetic construct
  misc_feature 1..9879: note = derived and/or modified CDS sequence (opt3) from DENV-1__HQ332179__SS-prME
  source 1..9879: mol_type = other RNA
agcgtgaccatgctgctcatgcttctgcccacagccttggctttccacttaactacgagaggcggggagcctcatatgatcgtctccaagcaggaaaggggaaaatctctgctatttaagacctcagcaggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagagggtggaaacttgggctctgcggcaccctggattcaccgttattgcactgtttctcgcccatgctatcggcacatcgattacccagaagggcatcatattcatcttactgatgcttgtgacgccatcaatggccatgcgctgcgtcgggattggaaacagagattttgtggagggtttgagcggcgcgacttgggtagacgttgtgctggagcacgggagttgtgtcacaaccatggcaaagaataaacccactctagatatcgaactcctgaagacagaggtgaccaaccctgccgtgcttaggaaactgtgcattgaagctaagatctccaatacgaccacagactctcggtgtccaactcaaggagaggccaccttggtcgaagagcaggatgcaaacttcgtttgccgccgaacatttgtggacagaggctggggtaatgggtgtggactcttcggcaaaggcagcctgttaacttgcgctaagtttaagtgcgtaaccaaactggaggggaagatagtgcagtacgaaaacctcaaatattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaaggactggactagatttcaacgaaatggtcctgctcacaatgaaggagaaaagctggctggtgcataagcagtggtttcttgacctgccgttgccctggacgtctggcgcatccacctcacaagagacttggaatcggcaggatctcctggtaacattcaaaaccgctcacgccaagaagcaggaagttgtggtcttaggtagccaagagggggctatgcacacagccctgactggcgcaaccgaaatccagacgagtggaaccacaactatttttgccggccatctaaaatgccgtctcaagatggacaaactgacccttaaggggatgtcttatgtgatgtgtacaggatccttcaaattggagaaggaagtcgctgagactcagcacggtaccgtgctggttcaggtgaagtacgagggcacggatgcgccttgcaaaataccattcagcacacaagacgaaaagggggtaacccagaacggacgcctcatcactgcaaatcccattgtcacagataaagagaagcctgtgaacatcgaaaccgagccaccctttggcgagtcgtatatagttgtgggtgccggggaaaaagctctgaagctttcttggttcaagaaaggctcctcaattggaaagatgtttgaggccactgcaagaggcgccaggcggatggctatcctgggggacaccgcctgggatttcggaagtatcggtggcgtctttacaagcgtggggaaattggtacatcaggtgttcggaacggcatacggcgttctcttttccggtgtctcttggaccatgaagattgggatcggcattctgttaacttggctgggactaaatagccgatcaacaagtctctccatgacctgtatagcggtgggcatggtgacactgtaccttggggtcatggttcaggctgacagcggatgcgtgatcaactggaaaggccgcgaattgaagtgtggttctgggattttcgtgactaacgaggtacacacctggacggaacaatataagtttcaggccgattcaccgaaaagactgagtgcagccatcggaaaggcttgggaggagggcgtctgcggtatcaggagcgccacacggctcgaaaatattatgtggaaacagatatccaacgagctgaatcatatcttactggaaaacgacatgaagttcaccgtggttgtgggcgacgcaaatgggattcttgctcagggaaaaaagatgatccgccctcaacccatggagcacaaatactcttggaagtcgtggggcaaggccaaaattatcggggcggatatacagaacactacctttatcattgacggaccagatacacctgaatgtcccgacggccagagagcctggaatatctgggaggtcgaggattatggtttcgggatttttactaccaacatctggttgaagctcagggacagctacacacagatgtgcgatcaccgtctgatgtccgctgcaataaaagactcaaaggccgtgcatgctgatatgggatattggattgaaagtgagaaaaatgaaacgtggaagctagcccgggcatctttcatcgaggttaagacctgtacttggccaaaaagccacacactgtggtccaacggcgtgctcgaatcagagatgattatccccaagatatacggtggccctatcagccaacataattatcgaccagggtacttcacccagactgcgggaccgtggcacctgggcaaacttgagttggactttgatctgtgcgaagggacaaccgtagtcgtggacgagcactgcggaaacagaggcccctctttaaggacgactaccgtgacaggtaagattatccatgaatggtgttgccgctcctgtaccctccctccactgcggttcagaggggaggatggatgctggtacggcatggagattaggcccgtcaaagaaaaggaggaaaatcttgttcgcagtatggtgagcgccggttctggcgaggtagactccttttcactggggatcttgtgtgctagtataatgattgaagaggtgatgcgaagccggtggtcgcgtaagatgctcatgactggaacactggccgtcttcctactgctcatcatgggccagctgacctggaacgaccttatcagattgtgcattatggtgggggcaaatgcttccgataggatgggaatgggcacaacttatctggccttaatggcaacctttaaaatgcgccctatgttcgccgttggtctcctgtttcggagacttacgtctagggaggtgctgctactcacaatcgggctgagcttggtcgcttcagtggaactgccaaacagtttagaggaactcggagacggcctggcgatgggcattatgatgcttaagctgttgaccgagttccaaccccaccagctctggactaccctgctatccctgacatttgttaaaactaccctttctctcgattacgcctggaagacgacagcaatggtgctgagcatagtctccttgttcccgctgtgtttatcaaccactagccagaaaacaacctggctccctgtactgcttgggagttttggatgcaagccactgactatgttcttgatcacagaaaacaagatttggggtcgaaaatcttggcccctcaatgagggcatcatggctattgggatcgtgtccatactgctaagctcgctgcttaagaacgacgttcctctcgccggacccctgatcgccggcggtatgttgattgcttgttatgtgatctcagggtctagtgcagatttactgctcgagaaagccgcggaagtctcctgggagcaggaagctgagcatagcggagcctctcacaatattctggtggaagtacaagacgatggcaccatgaagatcaaagacgaggagcgcgatgacacgcttactatactgttgaaggcaaccctactggccgtgagcggcgtctacccaatgtccattcctgctacactctttgtttggtatttctggcagaaaaagaagcagcggtcaggggtgctgtgggatacccccagtccaccggaagtggagagagcagtccttgacgatggaatctacaggatcttacagcgtggtctgctcggccgcagccaagtgggggttggagtattccaggacggcgtgtttcatacaatgtggcacgtcactcggggtgccgtgttgatgtatcaggggaaaagactggaaccttcttgggcgtccgttaagaaagacctcatttcatacggaggcggctggaggttccaggggagttggaacaccggagaggaggtgcaagtcatagctgtggaacccggtaagaatccaaaaaacgtacagacgacacccggcacttttaagacccctgagggggaagtcggagccatcgcactggatttcaagccaggcacaagcggttcccccattgtgaatcgagaggggaaaatcgttggactttacggcaacggcgtggtcaccacttctgggacctatgtgtcggccattgctcaggccaaggcaagccaagaaggacctctgccggagatcgaggacgaagtttttaaaaagcggaatttgacaataatggatctacacccaggttcaggcaaaacgcgcagatacctgcccgctatcgtgagggaggccattaagcggaagctccgaactttaatcctggcgcctaccagagtcgtggcctccgaaatggcagaggctcttaaagggatgccaattcgctatcagacaaccgccgtaaagagtgaacatactggaagggagatcgtggacctgatgtgccacgctacattcaccatgcgtctcttgtctcccgttcgggtccctaactacaatatgataattatggatgaggcacattttacggacccggccagcatcgccgctagaggctatatctccactagggtgggtatgggggaagcggcagccattttcatgacagctacccccccaggatcagtggaggcctttcctcagtctaacgcagtcatccaggatgaagagcgcgacatacccgaacgaagctggaatagtggctacgattggattaccgacttcccaggcaaaactgtatggtttgtgccttccatcaagagcgggaacgatattgccaattgtctgagaaaaaacggaaagcgggttatccaactctctaggaagacattcgacaccgagtatcagaaaacaaagaacaatgactgggattacgtggtcactacggacatatcagagatgggtgctaacttccgcgcggatcgtgtgattgaccccagacggtgcctgaaaccagttatccttaaggatggcccggaaagggtgatcctagccgggcctatgcccgtcaccgtggcatccgctgcccagcgccgaggaagaattggccggaatcagaacaaagagggtgaccaatacgtatatatggggcagccactgaataacgatgaagaccacgcacattggacagaggccaagatgttgttagataatatcaacactcccgagggcattatacctgctctgtttgaaccagagagggaaaagagtgccgcgatcgacggagagtaccgcctcagaggcgaagcaaggaaaaccttcgtggagctgatgcggcgtggggatcttcccgtttggctgagctataaggtcgcctcggagggatttcagtactctgaccgccgatggtgcttcgatggtgaaagaaataaccaggtgctcgaggaaaatatggacgtggagatttggacaaaagaaggcgagaggaagaaattgcggcctcgctggctggacgctagaacctattccgatccgctagccctgagggagtttaaggaattcgctgcagggcggcgaagcgtctcaggagacctcatccttgagatcggcaaactgccacaacacttaactttgagagcccagaacgctctggataatctcgttatgctgcacaacagtgaacagggtgggaaggcctaccgccatgcaatggaggaacttcccgacacgattgagaccctgatgctcttggcgctgatagccgtgttaacaggcggagtaactctatttttcctgtctggcaaggggctcggaaaaacctccatcggtcttctgtgtgtgacagctagctcagccttgctgtggatggcatgcgtcgagcctcactggattgctgccagtatcattctcgaatttttcctgatggtgcttctcatccccgagccagataggcagcggacccctcaagacaatcagctggcatatgttgtgataggcttgctgtttatgatcttaactgtcgccgctaacgaaatggggctactggagacaacgaagaaagatctcggaattggctacgtagcggccgagaaccatcagcacgcaaccatgcttgacgtggatctgcgtcccgctagcgcctggactttgtacgccgttgcaacaaccgtgatcaccccaatgatgagacacacaattgaaaatactacggctaacatctccctgaccgccatagcgaatcaagctgccattctcatgggtctggacaaggggtggcctatctctaaaatggatattggcgtcccgcttttagcactgggatgttatagccaggtgaaccccctcacattgactgccgctgtcctgatgctagtggcacattacgccatcataggcccagggctgcaggcgaaggctaccagggaggcccagaagcgcacagcagccggaatcatgaaaaatcctaccgttgacggcattgtggctatcgatctcgaccccgtagtgtatgacgccaagttcgaaaaacaacttggtcagattatgctgttgatcctgtgcacttcccagatactcctgatgcggacgacatgggcattatgtgagtcaattacccttgctactgggccactgaccacactctgggaaggatctcctggcaagttttggaacactaccatcgccgtcagtatggcgaatatcttccgaggttcgtacctagccggcgcagggctggctttcagcttgatgaaatccctgggaggcgggagaaggggaacaggcgcccagggtgagacgctcggggagaagtggaagcgccaacttaaccagctgtctaaatcagaatttaatacctataagcggagcggaattatggaggttgatagatccgaagcaaaagagggcttgaagcgtggtgaaactacaaaacacgctgtgagtaggggcaccgccaagctgcggtggttcgtcgagcgcaacctcgtgaagcccgaggggaaagtaatcgacttaggatgcggccgagggggatggtcttactattgtgccggcctgaagaaagtgactgaagttaagggttacacaaaagggggaccgggccatgaggaaccaatacctatggcgacctacggctggaatcttgtgaagctgcacagcgggaaagatgtctttttcatgcccccagagaagtgcgacacgctactctgtgatattggagaatcatcccccaaccctaccatcgaggagggtagaacactgagggtgttgaagatggtcgaaccgtggctgaaaggcaatcagttttgcattaagatcctcaacccctatatgccaagtgtggttgagactcttgaacagatgcaacggaaacatgggggaatgctggtacgcaatcctttaagcagaaactctacccacgagatgtactgggtgtcctgtggcacaggtaatatagtctcagctgtgaacatgactagcaggatgctgttgaaccgattcaccatggcacaccggaagcccacatatgagcgtgacgttgatctcggggccggaaccagacatgtggctgtcgaacctgaggtggccaatctggacatcattggccagcgcatcgaaaacattaaaaatgagcacaagtcgacttggcattacgatgaagacaacccatataagacgtgggcataccacggctcttatgaggtaaaacccagtgggtccgccagctcaatggtgaatggagttgtcaggctacttacaaagccttgggatgtgatcccaatggtgacccagattgctatgactgacaccacaccctttggtcaacagcgggtcttcaaagagaaggttgacacgagaaccccgcgcgcgaaaaggggcactacacagatcatggaagtgaccgccaagtggctgtgggggtttctctcccgaaacaagaaacctcggatatgcactagagaggaattcacaaggaaggtacgctctaatgcagctattggagccgtgtttgtcgatgagaaccagtggaatagcgcaaaagaagccgtggaggacgagcgtttctgggatctggttcaccgggaaagagagttgcataagcaaggcaaatgcgctacctgtgtgtacaacatgatgggtaagagggaaaagaaactgggggagtttggaaaggccaaaggcagtcgcgcgatctggtacatgtggctcggcgcacgattccttgaattcgaggccctggggtttatgaatgaggaccactggttctcccgggaaaacagcttatctggagtcgagggtgaaggcctgcataagttggggtatatcctcagagatatttcaaaaataccaggaggcaatatgtacgctgacgatacagccggttgggacactaggatcaccgaggatgacctgcagaacgaggcaaagattacggatatcatggaacccgagcacgctctacttgccaccagtatttttaaactgacatatcagaataaggtggtacgcgttcagagacctgctaagaacgggactgtgatggacgtcatctcccggagggatcaacgtggaagcggccaggtgggcacctacgggctcaacacattcactaatatggaagtgcagctgatacgacagatggagtctgaaggaatctttttgccatcggagttagagacccccaacctggccgaacgcgtcctcgactggcttgagaaacatggtgcagaaagactgaagcggatggcgatttcaggcgacgattgcgttgtgaaaccgatcgacgataggttcgccacggctctaacagccctgaatgacatggggaaggtacgcaaagatattcctcaatgggagcccagcaagggatggaacgactggcagcaggtgccattttgttcccaccacttccatcagctcatcatgaaggatggcagagaaatagtcgtgccttgccggaatcaagacgagttggttggtagggcacgagtgagtcagggggctggatggtctctgcgtgagaccgcctgtcttggcaaaagctatgcacagatgtggcaactgatgtactttcacagacgcgatctccggttagccgcgaacgctatttgctccgccgtccccgtggactgggtaccaacttcaaggacaacctggagtatccatgcacaccaccagtggatgactaccgaagatatgctgtctgtttggaatagagtgtggatcgaggaaaacccctggatggaggacaagacacatgtcagctcctgggaagaggtgccttatttgggcaaacgcgaggaccagtggtgtgggtcactgattggactcacggcccgggctacctgggccactaatatacaggttgcaatcaaccaagtgaggcgacttattggtaatgaaaactacctggattacatgacaagcatgaagagattcaaaaatgagtctgacccagaaggcgctctatggtga

SEQ ID NO: 14252 - RNA, 9879 nt, synthetic construct
  misc_feature 1..9879: note = derived and/or modified CDS sequence (opt3) from DENV-1__KR919820__SS-prME
  source 1..9879: mol_type = other RNA
accgtggtcgcactgctcatgcttctgcccatggttttcagctttcacttgactactagaggcggggaacctcatatgatcgtgaacaagcaggaaaggggaaagtccttactgttcaagacgtctggtggcattaatatgtgcaccctaatagctatggacctcggggatctgtgtgaggacacaatgacttacaaatgcccacggatcaccgaagcggagccggatgacgtggattgttggtgcaacgccacagacacctgggtgacttatggaatttgttcacccacaggcgaacaccgccgagagaagcgtagtgtcgcgcttgctcctcatgtgggtctggggttggagaccagagccgaaacgtggatgagctccgagggagcatggaaacaaatccagagggttgaaacttgggccctccggcacccaggctttaccgtgattgctctgttcctggcacatatcataggcacatctatcactcagaagggggtcatttttatcctcttaatgctggtgaccccctcgatggccatgcgctgcgtgggagttggtaatagagatttcgtggagggcctttcaggggctacatgggtcgacgtggtgttggagcacggaagctgtgtcaccacgatggccaagaacaaacctactctggatattgaactactcaagacagaggttagtaatccagcggtgctgaggaaactttgcatcgaagcacggatatccaacaccactacagactctcgctgtcccacccagggcgaggccagcctgtccgaagaacaagatacgaattttgtatgccgaagaaccttggtggacaggggttgggggaacggatgtggcctcttcggcaaggggtcactgattacatgcgctaaatttgagtgcttaactaagatggaaggaaagatcgtccagtacgagaatctgaaatatagtgtgattgttaccgtgcacacaggtgatcagcatcaggtcggcaacgaaactaccgggcacggaacaaccgccactatcacgcctcaagcaccaacaagcgagatccagctcaccgactacggcgctcttactctggactgttctccgcggaccggtttggatttcaatgaaatggtgctactgacaatgaaggagaaatcctggctcgtacataagcagtggtttctggaccttcccctgccttgggcctcaggggcgagcagtccacaggagacctggaaccgtcaagatttgctcgttactttcaaaacagcccacgcaaagaaacaggaagtggtcgtgctgggctctcaggagggagctatgcacacggccttaaccggcgctactgaaattcaaacatccgggaccacaactatatttgccggacatctgaagtgccgcctaaagatggacaaactcaccctgaagggtatgagctatgtcatgtgtacgggctcgttcaaacttaagaaagaggtggcagaaacccagcacgggacagttttggtgcaggtagagtacgagggaactgatgccccctgcaagatccctttcaccacacaggacgaaaagggcgtcattcaaaatggtagactgatcactgctaacccaatagtgaccgataaagagaagcccgttaatattgaagcggagccgccttttggggagtcttatatggtgatcggcgtcggagacaaagcactcaagctgtcctggttcaaaaagggctcaagtcttgggaagatgtttgaagccacggctaggggagcccggcgaatggcaatcctgggtgatacagcctgggacttcggcagcgtagggggagtatttacctccatgggcaaattggtgcatcagattttcggtactgcttacggggttctcttttctggcgtcagctggacaatgaagatcggaattggcctgttactgacctggctagggctcaactcacgcagtacttccctgagcatgacctgtatagccgtgggaatcattacactttacttgggcgtgatggtccaggcagatacgggttgcgttgtgaactggaaagggagagagctgaagtgtggatctggcatcttcgtgaccaatgaagtacacacttggacagagcagtataaatttcaagcggactcacccaagaggctcagtgctgccatcggtaaggcatgggaagacggcgtctgcgggattcggagcgccacccgcctggagaacataatgtggaaacagatcgctaatgagttaaactacattctgcttgaaaatgatatgaagttcacagtggttgtgggagacgtcaaaggcatcttgactcaggggaagaaaggaattagaccacagcctatggagcataagtattcctggaaatcttggggcaaggccaagatcataggtgcagatgtgcaaaacaccacgtttatcattgacgggcccgatacaccagaatgtcccgactcgcagagggcttggaatatctgggaggttgaagattacggattcggcatttttaccactaacatctggctcaaactgcgtgacagctatacccaggtgtgcgatcaccggctaatgtccgccgcgataaaggactcacgagccgtacacgctgatatgggttactggattgagagtgagaaaaatgaaacatggaagctgtctagagccagcttcatcgaggtcaaaacttgtacctggcctaagtcccatacactctggtcaaacggcgtgctggaaagcgagatgattatcccaaagatatatgggggaccgatctctcagcacaattacaggcccggctacttcacgcaaaccgccgggccttggcatcttggaaaattggaactggactttgatttatgcgagggcactacagtggtcgttgacgagcagtgcggtaaccgcgggccatccctccggaccactacagtgaccggaaagattatccacgaatggtgttgcagaagttgtacgctgccccctcttaggttcaaaggcgaggacggttgctggtatggcatggaaattcgcccagtaaaggagaaagaggaaaatctggtaaagagcatggtctctgctgggtccggaaaggtggataacttttcattgggcctcctgtgtatcagtataatggttgaggaagtgatgcgaagccggtggtcggggaaaatgctaatgactggaaccatggccgtcttcctgctcctggtgatgggccagcttacatggaatgacttgattcgtgtttgcatcatggtgggtgcacacgcgctggattccatggggatgggaaccacttacttagccctcatggctacatttaagatcagacccatgctggccgtcggccttctgttcaggaaactaacctctcgcgagattctcctgttgacaatcggcctgagcttaattactccggtagaactccctaactcaatagaggagctgggggacggacttgcaatgggtatcatgatgctgaagttgctcaccgattttcaaccatatcagctgtgggctacgctactgagtcttacattcgtgaaaaccactctctccctgcattacgcctggaagaccgcagccatggttttgtctattgtgagcctgttacccctctgtctgtccacaacttcacagaagaccacgtggcttcctatcctgttgggcagcctcgggtgcaaacccctgacaatgtttctaattagtgaaaacaagatctggggacggagatcttggccaataaatgagggcatcatggctgtcggtattgtgtccatcctgatgagctcgcttctcaaaaacgacgtacctctggcggggcccttgattgccggaggcatgttagtggcatgttatgtcatctcaggctctagtgctgatctgaccctcgaaaagactgccgaggtttcctgggaagaggaggccgaacacagcgggacagctcataatatactggtggaggtgcaggacgatggaaccatgaaaattaaggacgaagagagggaagatactcttacaatcctgttgaaagcagccctactggcgctctctggtgtctacccaatgagcatcccggctaccctgttcgtgtggtatttttggcaaaagaagaaacagcgatccggcgttctttgggacattccttcacccccagaggtagagaaggccgtgttagatgacgggatataccgcatcctgcagcggggagtcttcggcagaagtcaggtgggtgttggggtgtttcaagaaggagtcttccacacgatgtggcatgtgactaggggcgcagtactcacctaccagggcaaacgtttggagcccagctgggcctctgtcaagaaagacctgatttcctatgggggaggttggcgcctccagggctcatggaacgtgggggaagaggttcaggtgatcgctgtcgagcctggaaagaatccaaagaacgtgcaaacagttcccggcaccttcaaaacacacgaaggtgaggtgggggcaattgccctggattttaagcctggaacaagtggcagcccgatcgtcaatcgggacggcaaagtggtagggctttacggaaacggtgtggttaccacgtccggcacatatgtctctgcgatagctcagtcgaaggtgagccaggaagggccactgcccgagatcgaagatgaggtgttcaaaaagaagaatttgactattatggacctacaccctggatcaggcaaaaccagaaggtacctgccagccatcgtccgagagtccattaagcggcgcctcagaacattaatcctggcacccaccagggtagtggccagtgaaatggctgaggcccttaaaggtctgcctatacggtatcaaactaccgcagttcgaaacgaacatacagggagagagattgtggatctcatgtgccacgctacgtttactatgcgcttgctgtctccggtcagggtgcccaattacaacatgatcatcatggacgaagcccatttcaccgatccagcgagcattgccgcacgtggatatatctccacacgggttggcatgggcgaggctgccgctatatttatgaccgcaactcctcccgggtcagccgaggccttcccacagtctaatagcgtgatttacgacgaagagaaggatatccctgaaagaagttggaactccggatacgactggattacagattttcagggtaaaaccgtctggttcgtgcccagcatcaagacgggcaatgacatagctaactgtctcaggaagaacgggaaacgcgtaattcagctgtctcgaaagacttttgacacagagtatcagaagaccaaaaattcagattgggacttcgtggttaccactgatatctccgaaatgggagcgaactttagagcagaccgggtcatcgatccaaggcgctgccttaaaccggtgattctacgtgacggccctgagagagtgatcctggccggtcccatgccagtcacagttgctagtgccgcacagcggagggggcgcattggccgaaatcagagcaaggagggagatcagtacatatatatgggccaacccttgaacaatgacgaagatcacgcccattggaccgaggctaagatgttactggacaacatcaatacacctgaagggattatcccagcactcttcgagcccgagagagaaaaatcggccgcaatcgatggagagtaccggctgaggggtgaagctcgcaagactttcgtggagcttatgagaaggggcgacctgcctgtatggctctcttataaagtggcctccgaagggattcagtacgcagatcggaagtggtgctttgacggagagcgtaacaatcagatattggaggaaaacatggacgtcgagatctggacgaaagaaggcgagcgcaagaaactgcgaccgagatggctagatgccaggacctatagcgacccactggctctccgggagttcaaggagtttgccgcgggtcgcagatcagtgagtggggatcttattctggagatcggcaagttaccccaccacttgacacagagggcacaaaatgccctggacaacctcgttatgctgcataattctgaacagggaggccgggcttaccgacacgccatggaggaacttcctgatactattgagaccctgatgctcttggctatgatcgcaacactgaccgggggagtggccttattctttctatccggtaaaggcctggggaagactagcataggactcctttgtgtcatggcttcaagtacgctgttgtggatggccagcgtagaaccccattggatcgcagcgtccattgtgctggagttctttctcatggttctgcttatcccagagcctgacagacagcgcacaccccaagataaccaactcgcctacgtggtcattggcctgttggtgctgatcttaaccgtcgctgccaatgaaatgggtctactggagactaccaaaaaggacctcgggataggctctgcagctgccgaaattcagcaccacacaaccatccttgatgtggacctgcatccagcaagcgcctggactttgtatgctgttgcgacaacggtgattacccctatgctgaggcacactatcgagaacacaaccgccaacatgtccctcaccgcaatagctaatcaggccgccatcctgatgggacttgataaaggctggccgatttcaaagatggacatcggggtacccttactggcactcggatgctactctcaagtgaacccaatgacattgactgctgccgtcctgatgctagttgcgcattatgctattatcggccctggtctgcaggccaaggcaacgcgggatgcccagaaacgtaccgctgcagggataatgaagaatcccacagtggacggaattgtcgccatcgacctcgatccagtggtatacgacactaaattcgagaagcagcttggccaaatcatgctgttgattctgtgtaccagtcagatcctcctgatgagaacaacctgggcgttttgcgaatcgataactttagctacgggtcctcttacaaccctgtgggagggcagccccgggaaattctggaacactaccattgccgtgtccatggcaaatatctttaggggatcttatctcgccggcgctgggctagccttctcactgatgaaatccttgggaggcaaccgccggggtacaggggcacagggagaaactctgggcgagaagtggaaacgacagctcaatcaacttagcaagctggaatttaacacctacaaaagaagtggtattatggaggttgataggacagaggctaaggaaggcttgaaacgcggggagacgacccggcacgccgtgtctagaggaactgcgaagctgcgttggttcgtcgaaaggaatctcgtgaagccggagggcaaagtcatcgacttagggtgtggacggggcggttggagctattactgcgccgggctgaagaaagtgacagaagttaagggatacaccaaaggcggcccagggcatgaggagcctatacccatggcaacttatggatggaaccttgtaaagctgcactcaggtaaagatgtgttctttatcccacccgaaaagtgtgacacactactctgcgatattggcgagtccagtcctaatccgaccatcgaagaggggcgcacgctgcgagtcttgaagatggtggaaccctggctgagaggaaaccagttctgtattaaagttctcaatccatacatgcctagcgtggtcgagacccttgagaggatgcagcggaagcacggcggtatgctggtgcgcaaccccttatctagaaattccacacatgaaatgtattgggtatcatgcgggactggaaacatcgtgagcgctgttaatatgacctcgaggatgctgttgaaccgatttacaatgactcaccggaaacctacctacgagaaggacgtcgatctcggcgccggcacacgtcatgtggcagtggaaccagaggtcgctaacctggacattatcgggcagagaatagagaatattaaaaacgaacacaagtctacctggcactatgatgaggacaatccctacaagacttgggcctatcatggaagttacgaagttaaaccttccggtagcgcctcatccatggtgaacggcgtagtgcgcctacttacgaagccatgggacgtcatccccatggtgacacaaatcgcgatgaccgatactaccccgttcgggcagcagagggtttttaaagagaaggtggacacacggacgcctaaagctaagagaggaaccgcacaagtcatggaaattactgccggctggctgtggaagttcctctctcgcaaaaagaaaccaaggatatgtacacgagaggagtttacccggaaggtgagaagcaatgctgccatcggtgcagtattcgttgatgaaaaccagtggaatagtgccaaagaggctgtggacgatgaaaggttttgggacctggtcaaccgcgagcgtgaattgcacaagcaggggaagtgcgcgacttgcgtgtacaatatgatgggaaaacgggagaagaaactgggcgagttcggcaaggccaaagggtccagagcaatttggtatatgtggctcggagctaggtttcttgagttcgaggccctgggttttatgaacgaagatcattggttcagccgcgacaattctttatcaggcgtggagggggaaggactgcacaagttgggctacatcctccgagatattgcacggatccccggtgggaacatgtatgccgacgatacagctggatgggacaccagaataacagaggaggatctgcagaatgaagccagggtcactgagctaatggaacctgaccatgcgcaacttgcaaccagtatcttccgcctgacgtaccagaacaaagttgtgagagtacagcggccaggcaagaatggcaccgtgatggacgtcatttccaggcgtgatcagcgagggagcggacaagtgggtacatatggcctcaacacttttaccaacatggaggcccagctgatccgccagatggagtctgaaggggttttctcgccctcagagttggaaacaccgaatttagctaacagagtgctggactggctcgagaagtacggagtcgaacggcttaaaaggatggccattagcggcgatgactgtgtggtaaagcctatcgatgaccgctttgcaactgctctgaccgccctaaatgatatgggtaaagttagaaaggacataccccagtgggagccatcccgggggtggaacgattggcaacaggtgcctttctgcagtcaccactttcatcagctgattatgaaagacggaagggagatcgtcgtgccctgtcgaaatcaggatgaactcgttggccgtgctagagtgtctcaaggcgccgggtggagcttgcgcgagacggcatgcctgggaaagtcctatgcgcagatgtggcagcttatgtacttccaccggagggacctgagactcgccgctaacgccatctgttcagcagtcccagtggactgggtacccacaagtcgcaccacttggtctattcatgctcaccaccaatggatgacaaccgaagatatgttaagcgtgtggaatcgggtctggatagaggaaaacccttggatggaggacaagactcatgttacctcctgggaggatgtgccatacctgggtaaaagggaagaccagtggtgcggctcattgatcgggctgagcgcccgagcaacatgggccattaatatccaggtcgcgattaaccaggtgagaaagctcatcggaaatgagcactatcaagattacatgacgtctatgcggaggtttaaaaacgaatccgagccggaaggcgctctttggtga

SEQ ID NO: 14253 - RNA, 9879 nt, synthetic construct
  misc_feature 1..9879: note = derived and/or modified CDS sequence (opt3) from DENV-1__DQ285561__SS-prME
  source 1..9879: mol_type = other RNA
agcgtgaccatgctgctcatgcttctgcccacagccttgactttccacttaacgaccagaggcggggagcctcatatgatcgtcggaaagcaggaaaggggtaaatccctgctatttaagacatctgctggcgttaacatgtgcactctcattgcaatggacctgggggagctttgtgatgacaccatgacatacaaatgcccacggataaccgaaactgagccggatgacgtggattgttggtgcaatgccacagaaacctgggtaacgtatggaacttgttcacaaaccggcgagcaccgccgagacaagcgtagtgtggcgctggctccccatgtcggtttggggctcgagacaagaactgaaacctggatgagctccgagggagcctggaggcagatccagaaagtggaaacatgggcactgcggcaccctggcttcaccgttattgccctgtttctcgctcatgcaatcggcacgtctattactcagaaggggatcatattcatcttactgatgcttgtgacaccatcgatggccatgcgctgcgtcggaattggtaacagagattttgtggagggcttgtcaggggctacctgggtagacgttgtgctggagcacggaagctgtgtcactacaatggccaaggataaacccaccctagacatcgaactcctgaagacggaggtgaccaatcctgcggtgcttaggaaactgtgcattgaagcaaagatcagtaacacaactaccgattcccggtgtccaacacaaggcgaggccactttggtcgaagagcaggacaccaatttcgtttgccgccgaacatttgtggatagaggttgggggaacggatgtggcctcttcggcaaagggtctctgataacctgcgctaagtttaagtgcgtaactaaattagagggaaagattgtgcagtacgaaaatctgaaatatagcgtcatcgtgacggttcacacaggtgaccagcatcaagtgggcaacgagaccactgaacacgggaccattgccacaatcaccccccaggcacctacttccgagatccagctcacagactacggagctcttacgctggattgttcaccaaggaccggcttggacttcaatgaaatggtcctactgactatgaaggagaaaagttggctcgtgcataagcagtggtttctggatcttccgctgccctggacaagcggtgcctctacctcccaagagatttggaaccggcaggacttgctcgtaacattcaaaactgcgcacgccaagaagcaggaagttgtggtcctggggtcacaagagggcgcaatgcacaccgctttaacgggagccaccgaaatacagacaagcggcactaccacaatctttgctgggcatctgaaatgccgtctaaagatggataaactcactctgaagggaattagttatgtgatgtgtaccggttctttcaaacttgagaaggaagtcgccgagacgcagcacggcacagtgttggttcaggtgaagtacgaggggaccgacgcaccttgcaaaatcccattctccagccaagatgaaaagggagtaactcagaatggccgcctggtcacagccaaccccatagtgaccgacaaagagaagcctgttaatattgaagctgagccaccctttggtgagtcgtatatcgtggtcggggcgggcgaaaaagcactcaagctgtcttggttcaagaaaggatcctcaatcggcaagatgtttgaggccactgctagaggggccaggcggatggcaattcttggagataccgcctgggacttcggtagtatcggcggggtgtttacaagcgtaggaaaactggtgcatcagattttcggcacggcttacggtgttttgttttccggggtctcttggaccatgaagataggcatcggaattctcctgacttggttaggcctgaacagccgatcaacaagtctatccatgacctgtatcgccgtggggatgatcacactctacctgggagtgatggtccaggcagatagcggctgcgttattaattggaaaggtcgcgaacttaagtgtgggtctggaatattcgtgactaacgaggtgcacacctggacggaacaatataagtttcaggcggactcaccgaaaagattgagtgctgccatcggcaaggcatgggaggagggtgtatgcggcattaggagcgccacacggctggaaaacatcatgtggaaacagatttccaatgagctcaaccatatcctgttagaaaatgacatgaagttcaccgtcgtggttggggatgtgtctggaatactggctcagggcaaaaagtcgatccgccctcaacccatggagcacaaatacagctggaagtcctgggggaaggccaaaattatcggagcagacgtccagaacactacctttattatcgatggcccaaatacacctgaatgtcccgacgatcagagagcttggaacatatgggaggtggaggactatggtttcgggatttttactaccaatatctggcttaagttgagggattcatacacacaggtttgcgaccaccgtctcatgagtgccgcgattaaagattctaaggccgtgcatgctgacatgggatattggatcgaaagcgagaaaaacgaaacgtggaagctggcacgggcctccttcatagaggtaaagacctgtatctggccaaaatcacacactctatggagcaatggcgtcctggaatctgagatgattatccccaagatttacggtggccctatctcccaacataactatcgaccagggtacttcacacagaccgctggaccgtggcacctcggcaaactggagcttgattttgacttgtgcgaagggactacagtggtggtcgatgagcactgcggaaatagaggccccagtctgaggaccacgactgttaccggtaagataattcatgaatggtgttgccgcagctgtacattacctccactccggttcaaaggggaggacggatgctggtacggcatggagatcagacccgtgaaggaaaaggaggaaaacctggtaaaatctatggtgtccgccggttcaggcgaggtcgacagttttagccttgggctgttgtgtatctcgattatgatcgaagaggtgatgaggtcccgctggtctcgaaagatgctcatgaccggaactctggcagttttcctactgctcacaatgggccagctgacctggaatgatcttattcggttgtgcataatggtgggggcgaacgccagcgacaatatgggaatgggcacaacttatctggctttaatggccacctttcgtatgagacctatgttcgcagtcggtctcctgtttaggcgccttacgtcacgggaggtgctgctactcacagttgggctgagtttggtggcttccgtcgaactgccaaactctttagaggaactcggagatggcctggccatgggcatcatgattcttaaactgttgaccgacttccaaagccaccagctctgggcaactctgctatccctgacctttgtaaagacaactttctcacttcattacgcctggaaaaccatggctatgatcctcagcattgtgagtctgtttcccttgtgtctgtctacgacatcccagaagaccacttggttaccggttctcctggggagccttggatgcaagcctctgacaatgttcttgatcaccgagaacaaaatatggggtagaaagtcgtggccactcaatgaaggcatcatggcggtggggattgtctcaatcctgctatctagtctgcttaaaaacgatgtgcccctcgccggacctctgattgcaggcggtatgttgatcgcttgttatgtaatatccgggagctctgccgacttaagcctggagaaggccgctgaggtgtcctgggaagaggaagcagagcactcaggagccagtcataatattctcgtcgaaatccaggatgacggcactatgaaaatcaaggatgaggagagggacgatacaattaccatactgcttaaagcgacgctgttggctatcagcggcgtttaccccatgtctattccagccactctatttgtgtggtatttctggcaaaagaagaaacagcgatccggggtgctgtgggacaccccttcacccccagaagtcgagcgcgcagtgctcgatgacggaatctaccggattctgcagagaggtcttttaggcaggagtcaggttggggtaggagtgttccaagaaggcgtctttcacacaatgtggcacgtgacccgtggtgccgttctgatgtatcaggggaagcgcctcgagccgagctgggcttccgtgaaaaaggacttgatctcttacggaggcggctggcggttccaggggtcgtggaacacaggagaggaagtccaggtgatagcagtagagcctggtaaaaatcccaagaacgtccaaactgccccaggcacctttaagacgagcgaaggggaggtgggagcgatcgctctggatttcaaacccggcacatcaggttcccctattgttaatagagaagggaagatcgtgggactctacggcaacggcgtcgtgactaccagtgggacatatgtttctgccattgcacaggccaaagctagccaggagggaccactgcccgagatcgaagacgaggtgtttaggaagcgaaatcttaccataatggatctgcatcctggttccggcaaaactcggcgctacttgccggccattgtcagagaagcaatcaagaggaagctacggaccctggtgctcgctccaacacgagtagtggcctcagagatggcggaagccttaaaagggatgcccatcagatatcaaacgactgcagttaagtctgagcacaccggacgcgagattgtcgacctgatgtgccatgctacattcaccatgaggcttctgagccctgtgcgtgtgccaaactacaatatgatcataatggatgaagcccactttactgaccccgctagtattgcagcccggggctatatctccacaagagtcggtatgggggaggccgctgcgattttcatgaccgcaacgcctccgggaagcgtagaagcctttccccagtctaacgctgtgatccaggatgaggaaaaagacataccagagaggtcatggaattccggctacgattggattactggcttccctgggaagacagtttggtttgtgcccagtatcaaaagcggaaacgacatcgccaattgtctccgcaagaacggtaagcgagtcattcagttgtcgagaaaaaccttcgataccgagtatcaaaagactaaaaacaatgactgggactacgtggttacaaccgatatctctgaaatgggcgcaaacttccgggccgacagggtgattgatccacgccgttgcctgaagcctgtcatactcaaagacgggcccgagagagtgatcctggctggaccaatgccggtaacagtggcgtccgccgcacagcggaggggccgcattggtcgaaatcagaacaaggaaggggatcagtacatctatatgggccaacctcttaataacgacgaggatcatgctcactggactgaggccaagatgctactggacaatatcaacacgcccgaaggaattataccagcattgtttgagcccgaaagagagaaaagcgccgctatcgatggcgaataccggttaaggggggaggcccgcaagaccttcgttgagctgatgagaaggggagacctccctgtctggctgtcatataaagtggcgagtgaaggttttcagtactctgatcggcgttggtgcttcgacggcgagcgcaataaccaggtgcttgaagagaatatggatgtcgaaatttggacaaaggagggggagcgaaaaaagctgagaccaaggtggctcgacgcacggacttattccgaccccttggccctgcgcgaatttaaagagttcgctgccggaagaaggagcgtttcaggcgatctaatcctggaaattggtaagctccctcagcaccttacccaacgggctcagaacgcactggacaatttagtgatgttgcataacagtgagcaggggggcaaggcctaccgacacgctatggaagagctgccggatacaatcgagaccctcatgctgcttgccctgatagcagtactcactggaggcgtgacgttgtttttcctgagcgggagaggattaggtaaaacctccatcggcctactgtgtgtcatgtctagctccgcgctcctttggatggcctcagtggaaccacattggattgctgcctctatcattctggagtttttcttgatggttctgctcatccccgaacctgaccgccagaggacaccccaagataatcagctggcatatgtggtcatagggcttctctttatgattctgactgtagctgccaacgagatgggattgctggagaccacaaagaaagacttaggcatcggtcacgcagccgctgaaaaccaccatcacgcggccatgctagatgtggacctgcatccagcaagtgcttggaccctctacgccgttgccactacaattatcacgcctatgatgcggcacaccatagagaatactacagcaaacatctcgcttaccgctattgccaatcaggcggctatcctgatggggttggataagggctggcccattagcaaaatggacatcggagtgccactgctcgccctgggctgctactcccaagtcaaccctcttaccttaacagcagccgtgctgatgctcgtcgctcattatgcaataattgggccgggattgcaggccaaggcgactcgtgaagctcagaagagaacggccgcaggcatcatgaaaaatcccaccgtggatggtatcgttgccattgacctggatccagtggtatacgacgctaagttcgagaaacagctagggcaaatcatgctgctcatactttgtacatctcagattctgttgatgaggactacctgggccctgtgcgaatcaatcacactcgcaaccggacctctgactacgttatgggagggcagccccggtaagttttggaacacaaccattgctgtgtccatggccaatatcttccgcggcagttatcttgcgggggccggactggcattctctctcatgaaaagcctaggcgggggacggcgaggcactggtgctcagggggagaccctgggagaaaagtggaagagacagttgaaccaactgtcaaaatccgagtttaatatatacaagaggagtggcatcgtcgaagttgaccgcagcgaggccaaagaaggtctcaagcggggcgagacaattaaacacgcagtgtctagagggactgctaagcttcgttggttcgtcgagaggaacctggtgaagccagaaggaaaagtaatcgatttgggctgtgggcggggaggctggtcctattactgcgccggtctgaagaaagtgaccgaggttaaggggtatacaaaaggaggccctggccacgaagagcccattccgatggccacgtacgggtggaatctcgtgaagttatactcaggaaaagacgtctttttcatcccacctgaaaagtgtgataccctgctttgcgacattggtgagagctcgcccaacccaactatcgaggaaggccgcacactgcgagtgctaaagatggtcgagccctggctcagagggaatcagttttgtataaaaattctgaacccttatatgccgtctgtggttgaaaccttggagcagatgcagaggaagcatggaggcatgctggtacggaatcccctcagtcgcaactccactcacgagatgtactgggtgagctgcggtacagggaatatcgtctcagcggtgaacatgacctccagaatgcttctgaacaggttcacgatggctcatcgaaaaccaacctatgaacgggatgttgacttaggagcaggcacacgtcacgtggccgtcgagcctgaagtggctaatctggatatcattggccaaagaatagagaacatcaagaatgaacacaaatctacttggcattacgacgaggataacccctataagacctgggcctaccacgggagctatgaggtaaagcctagtggatccgcaagctctatggtgaatggtgttgtccgcttgctcacaaaaccatgggacgtgattcccatggtgactcagatcgccatgaccgatacaaccccttttggccagcaaagggtcttcaaggaaaaagttgacactcggacgccaaaggctaaaagagggacagcgcagattatggaggtgaccgccaagtggctgtggggatttctatcacgcaacaagaaacccaggatctgtactcgagaagagttcacccggaaggtaagaagtaatgcagctataggcgccgtgtttgtcgacgaaaaccagtggaattccgcaaaagaggccgtggaggatgaaaggttctgggaccttgttcgccgtgagcgggaactgcataagcagggtaaatgcgctacatgcgtgtacaacatgatggggaagagagagaagaaactcggagaatttggcaaggccaaaggcagcagggcgatctggtacatgtggctgggggcacgcttcttggagttcgaggccctgggatttatgaatgaagatcactggttctctcgagagaactcgctctcaggtgtcgaaggcgaggggcttcataagctgggatatattttacgggacatcagcaaaattccgggcggtaatatgtacgctgatgacacggccgggtgggataccagaatcactgaggacgatctgcaaaacgaagcaaagataacagacattatggagcctgaacacgctttgctcgccacctccatctttaaactgacttatcagaataaggtggtaagggttcagcgcccagctaagaacggaacagtgatggatgtcatcagtagacgggaccagaggggctctggccaagtggggacctacggactaaacacattcactaatatgggtgcccagcttattcgtcagatggagagcgaaggcatattttccccctcagagctggagacccctaacctcgcagggcgagtgctggattggttggaaaaacacggaatcgagcgcttaagacggatggcgattagtggcgacgactgtgtcgttaagccaatcgatgacaggttcgccacggctctgaccgccctcaatgatatgggtaaagtgcgcaaggacattccccagtgggaaccgtctaaagggtggaacgattggcaacaggtacctttttgcagccatcacttccatcagcttatcatgaaggacggaagagagatagtggtcccctgtcggaatcaggatgaactggtgggcagggcacgagtttcccaaggcgctgggtggtcactacgtgagacagcctgcctgggaaagagctatgcacagatgtggcagctcatgtactttcacagacgcgacttgcggctggccgcgaacgctatctgttctgccgtgccagtcgattgggtgcctacttccaggaccacatggagtattcacgcacatcaccaatggatgactaccgaggacatgcttagcgtatggaatagagtttggatcgaagagaacccctggatggaagataaaacgcatgtgtcgtcctgggaggacgtcccatatctgggtaagcgcgaagaccagtggtgcggctctctcattgggttaacagcccgggctacctgggccactaatatccaggtggcaattaaccaggttaggcgactgataggaaatgagaactacttggattacatgacatcaatgaaaagattcaagaatgagagcgaccccgaaggcgctctgtggtga

SEQ ID NO: 14254 - RNA, 9879 nt, synthetic construct
  misc_feature 1..9879: note = derived and/or modified CDS sequence (opt3) from DENV-1__DQ285562__SS-prME
  source 1..9879: mol_type = other RNA
agcgtgaccatgctgctcatgcttctgcccactgcattggctttccacttaactacgagaggaggggagcctcatatgatcgtctccaagcaggaaagaggaaaatctctgttgtttaagacctcagccggtgttaacatgtgcacactcattgccatggacctgggcgagctttgtgaagatactatgacctacaaatgcccacggataacagaggcggaaccggacgatgtggactgttggtgcaatgctaccgatacttgggtgacatatgggacctgtagtcaaacgggagagcaccgccgagacaagcgtagcgtggccctggcaccccatgtcggcttgggtctcgagactagaaccgaaacatggatgtcctctgagggggcctggaggcagatccagaaagtggaaacttgggctctgcggcaccctggattcaccgttattgcactgtttctcgcccatacaatcggcacctcgattacgcagaagggcatcatattcatcttactgatgcttgtgactccatcaatggctatgcgctgcgtcgggattggaaacagagattttgtggagggtttgagcggcgccacatgggtagacgttgtgctggagcacgggagttgtgtcaccactatggcgaagaataaacccacactagatatcgaactcctgaagaccgaggtgacgaaccctgcagtgcttaggaaactgtgcattgaagccaagatctccaataccacaactgactctcggtgtccaacccaaggagaggctacattggtcgaagaacaagatgccaacttcgtttgccgccgaacttttgtggacagaggctggggtaatgggtgtggactcttcggcaaaggcagcctgttaacctgcgcaaagtttaagtgcgtaacaaaactggaggggaagatagtgcagtacgaaaacctcaaatattccgtcattgtgaccgttcacactggagatcagcatcaagtgggtaatgagacgacagaacacggcaccatcgctactattactccccaagcccctacatcagagatccagcttaccgactacggggcgctgactttggactgtagtccaaggacaggactagatttcaacgaaatggtcctgctcacgatgaaggagaaaagctggctggtgcataagcagtggtttcttgacctgccgttgccctggacctctggcgcctccacttcacaagagacatggaatcggcaggatctcctggtaaccttcaaaacagcacacgctaagaagcaggaagttgtggtcttaggtagccaagagggggccatgcacactgctctgaccggcgccacggaaatccagaccagtggaacaactaccatttttgcaggccatctaaaatgccgtctcaagatggacaaactgacacttaagggggtgtcttatgtcatgtgtactggatccttcaaattggagaaggaagtggccgagacccagcacggtacggttctggtgcaggtaaagtacgagggcacagatgctccttgcaaaataccattcagcacccaagacgaaaagggggtcactcagaacggacgcctcatcacagcgaatcccattgtgaccgataaagagaagcctgttaacatcgaaactgagccaccctttggcgagtcgtatatagtgattggtgcaggggaaaaagccctgaaactttcttggttcaagaaaggctcctcaatcggaaagatgtttgaggctaccgccagaggcgcaaggcggatggccatcctgggggacacagcttgggatttcggaagtattggtggcgtctttacgagcgtggggaaattggtacatcaggtgttcggaaccgcctacggcgttctcttttccggtgtctcttggactatgaagatcgggattggcatactgttaacatggctgggactaaatagccgatcaaccagtctctccatgacatgtatcgtggtgggcatggtcactctgtaccttggggttatggtgcaggcagacagcggatgcgtgattaactggaaaggccgcgaattgaagtgtggttctgggatcttcgtaaccaacgaggtccacacgtggacagaacaatataagtttcaggcggattcaccgaaaagactgagtgctgccatcggaaaggcatgggaggagggcgtgtgcggtattaggagcgccacccggctcgaaaatataatgtggaaacagatctccaacgagctgaatcatattttactggaaaacgacatgaagttcactgttgtggtcggcgacgctaatgggatccttacccagggcaagaaaatgattcgccctcaacccatggagcacaaatactcttggaagtcgtggggcaaggccaaaatcataggggcagatatccagaacacaacttttattatcgacggaccagatacccctgaatgtcccgacgatcagagagcttggaatatttgggaggtggaggactatggcttcggtatctttacaacgaacatatggttgaagctcagggatagctacacccagatgtgcgaccaccgtctgatgtccgccgcgattaaagattcaaaggccgttcatgctgacatggggtattggatcgaaagtgagaaaaatgaaacttggaagctagcacgggcctctttcattgaggtgaagacatgtatctggccacgaagccacaccctgtggtccaacggagtactcgaatcagagatgataatccccaaaatttacggcggtcctatcagccaacataattatagaccaggctacttcactcagacagctgggccgtggcacctgggaaaacttgagttggattttgacctgtgcgaaggcaccacggtcgtggtggatgagcactgcgggaacaggggaccctctttacgcactaccacagtcaccggcaaaattatccatgaatggtgttgccggtcctgtactctccctccactgagattcaagggtgaggacgggtgctggtacggaatggagataaggcccgttaaagaaaaggaggaaaatcttgtgcgcagtatggtaagcgccggctctggtgaggtggactccttttcactgggcttgctctgtgtcagtattatggtggaagaggttatgcgaagccggtggtcgcgtaagatgctgatgacagggaccctagcagtgttctttctgctcatcatgggacagctgacatggaacgatcttatcagattgtgcattatggtcggcgcgaatgtgtccgacaggatggggatgggaactacctatctggccttaatggctacgttcaaaatgcgccctatgtttgccgttggcctcctgttccggagacttacatctagggaggtgctgctactcaccatcggtctgagcttggtcgcatcagtagaactgccaaacagtttagaggaactcggggatggactggctatgggcattatgatgcttaagctgttgactgactttcaatcccaccagctctggaccacactgctatctctgactttcataaaaaccacgcttagcctcgattacgcctggaagacaatcgcaatggtgctgtccattgtttcattgtttcccctgtgtttaagcaccacaagtcagaaaacaacctggctcccggtgctgcttggctctttcgggtgcaagcctctgactatgtttttgatcacagagaacaagatttggggacgaaaatcctggccactcaatgaaggtatcatggccgtcggcatagtgagcatcctgctatcgtcactgcttaagaacgacgtacccctcgctgggcctctgattgcgggaggcatgttgatcacctgttatgtgatttctggtagttccgccgatttaagcctggagaaagcagctgaggtctcttgggaagaggaagccgagcatagcggggcctcccacaatatcctcgttgaagtgcaggacgatggaacgatgaagataaaagacgaggagcgcgatgacactctgaccattcttctgaaggctacattgctagcagtgtcaggcgtctaccccatgagtatcccagccaccctgttcgtgtggtatttctggcagaagaagaagcagcggagcggcgttctctgggatacaccttctcccccagaagtagagagagcggtgctggacgacgggatctacaggattcttcagcgtggattactgggtcgctcccaggtcggcgtgggggtttttcaagatggagtgttccatactatgtggcacgtcacccggggcgctgtgctcatgtatcagggtaaaagattggaaccgtcatgggccagtgtaaagaaagacctgataagctacgggggaggctggaggtttcagggctcctggaacacgggggaggaggtccaggtgatcgcagttgaacctggaaagaatcccaaaaacgtgcaaacaactccaggtaccttcaagacacccgagggcgaagtcggggccattgctctcgattttaagcctggaacctctggctcgccaatcgtgaatcgagagggtaaaattgttgggctgtacggaaacggcgtggtcactaccagcggcacatatgtgtcagcaatcgcccaggcgaaggcttcccaggaagggccccttcctgagatagaggacgaagtattcaaaaagcggaatctgacgatcatggatttgcacccgggaagtggtaaaactcgcagatacctaccagccattgtgagggaggcaatcaagcggaagctgcgaaccctcattttagcccccacaagagttgtcgcttctgaaatggccgaggcactgaaaggcatgcctatccgctatcaaaccactgctgtaaagagcgaacatacagggagggagatagtggaccttatgtgccacgccacctttacgatgcgtctgctctccccagtccgggtacccaactacaatatgattatcatggatgaggcgcatttcactgaccctgcctcaatcgcagctagaggatatatttctacaagggtgggcatgggtgaagccgctgcaatctttatgaccgccaccccgcccgggagcgttgaggccttcccacagagtaacgctgtgatacaggatgaagaacgcgacattcctgaacgatcctggaatagcggatacgattggatcactgactttcccggcaaaacagtctggttcgtgccatctattaagtcaggcaacgacatcgcgaattgtttgaggaagaacgggaagcgggttatacagctgtccaggaagaccttcgatacagagtatcagaagactaagaacaatgactgggattacgtggtcacgaccgacattagtgagatgggagcaaactttcgcgccgatcgtgtgatcgaccctagacggtgcctcaaacccgtaatcctgaaggatggtccagaaagggtgattcttgctggcccgatgcctgttacagtcgccagcgcagcccagcgccgagggagaatcggacggaatcagaacaaagagggcgaccagtacatttatatgggtcaacccctaaataacgatgaagaccacgctcattggactgaggcgaagatgctgttggataatataaacaccccagaggggatcattcccgccttattcgaacctgagagggaaaagtcggcagctatcgacggcgagtaccgcctgagaggagaagccaggaaaacatttgtggagctcatgcggcgtggcgatctgccagtgtggctttcttataaggtcgcatccgaggggttccagtacagcgaccgccgatggtgctttgacggagaaagaaataaccaggttctggaggaaaatatggatgtggagatctggaccaaagaaggtgagaggaagaaactccggccccgctggttggacgccagaacttattcagatcctctggctctaagggagttcaaggaatttgccgcgggccggcgaagtgtatctggggacctgattctcgagataggaaaacttccgcagcacctgacgttaagagcacaaaacgccttggataatctggtgatgctccacaactccgaacagggcggtaaggcttaccgccatgccatggaggaactgccagacaccatcgagacacttatgctgctcgctttgattgcagtcctgactgggggcgtgaccttattctttctaagcggaaagggcctggggaaaacatcaatcggactcctttgtgttatggccagtagcgtgctgttgtggatggcttccgtcgagccccactggattgccgcatctatcatactggagttctttctcatggtactgcttatccctgagcccgataggcagcggaccccacaggacaatcaactcgcgtatgtggttattggtctgttgttcatgatcctgactgtggccgctaacgaaatgggcttactagagacaacgaagaaagatctggggattggacatgccgtcgcagagaaccaccaccatgctaccatgctcgacatcgatcttcaccctgccagcgcatggactctgtacgccgtggctacaaccataattacccccatgatgcgtcatacaatcgaaaatactacggcgaacatttccttgaccgccatcgcaaatcaggctgccatactgatgggcctcgacaagggttggccaatctcaaaaatggatattggggtccctctgcttgccttaggctgctactctcaggtgaacccgctgacactcactgcagctgttttgatgctggtggcccactatgcgatcattggacccggcctacaagctaaggccaccagagaggcacagaagaggacagccgctgggatcatgaaaaatccaaccgtagacggaatagtggcaattgacctggatcctgtcgtttacgacgccaagtttgaaaaacagctcggccagatcatgcttctgatcttgtgtaccagtcaaattctgctcatgcgcacgacatgggcgctgtgcgagtcgatcaccttagctactggtccccttaccacactgtgggaagggagcccaggaaagttctggaacactaccatagccgtgtccatggcaaatattttccggggctcttatctcgccggtgctggcctagccttttcactgatgaaaagcctagggggaggccgaagagggacaggagcacagggcgagacgctgggtgagaagtggaagaggcagctcaaccagctttccaagagtgagttcaatacctacaagcgctctgggatcatggaggtcgatcggagcgaagctaaagagggactgaagagaggcgaaactacaaaacatgccgtgtcacgtggtaccgcgaagttgaggtggtttgtagagcggaacctggtgaagcctgagggcaaagttattgacctcgggtgtggacgcggcgggtggtcctattactgcgccggattaaagaaagtgactgaagtcaagggctatacaaaaggtgggcccggacacgaggaaccgatcccaatggcaacctacggctggaatctggtgaaacttcacagtggcaaagatgtcttctttacgcctcccgagaagtgtgacaccctgctatgcgatataggggaaagctctccaaaccccacaatcgaggagggacgaactctcagagtgctgaagatggttgaaccttggttgaggggtaatcaattctgtattaaaatcctgaacccgtacatgccctccgtagtggagaccctcgaacagatgcagcggaagcatggcgggatgcttgtccgcaatccactgtcaagaaacagcacacacgagatgtattgggtgtcgtgcggaactggcaatattgtttctgctgtgaacatgaccagtaggatgttactgaaccgatttacaatggcccatcggaaacctacctacgagcgtgacgtcgatttgggtgcagggactagacacgtggctgtagaacccgagatcgccaatctcgacattatcggacagcgcatagaaaacattaagaatgagcacaaatccacgtggcattatgatgaagacaacccttacaagacatgggcctatcacggcagctacgaggtgaagccatcaggctccgcgtctagcatggttaatggggtcgtgaggctgctaaccaaaccctgggacgtgatccctatggtcactcaaatcgctatgaccgatacaacgccattcggacagcagcgggtttttaaggagaaagtggacaccagaactccccgcccgaagaggggtacagcacaaattatggaagtaaccgccaaatggctttggggcttcctgagtcgaaacaagaagcctcggatatgtactagagaggaatttacaaggaaagtgcgctccaatgctgccatcggggcagtcttcgtggatgagaaccagtggaatagcgccaaggaagctgttgaggacgagcgtttttgggatctcgtgcatcgggaaagagagctgcacaaacagggaaagtgcgcgacctgcgtctataacatgatgggcaaaagggaaaagaagttgggtgagttcgggaaagccaagggatctcgcgcaatttggtacatgtggctgggcgctcgattcctcgaatttgaggcccttggcttcatgaatgaggaccattggttttcacgggaaaacagtctgtccggggtggagggagaaggtttacacaaactgggctacatcttgagagatattagcaagatcccagggggaaatgtatatgcagacgatacagccggctgggacactaggataaccgaggatgacctccagaacgaggctaaaatcacggatattatggaacccgagcacgccctgctagcgacctctatcttcaaacttacataccaaaataaagttgtgcgcgtccagagacctgcaaagtcgggtactgtgatggacattatctcacggagggaccagcgtgggagcggacaggtgggcacctatggcctgaacacatttactaacatggaagtccaactcatacgacagatggagtccgaagggattttcagtccatctgagctggagaatagcaacttggccgaacgcgttttagattggctggagaagcatggagtggaaagactcaaacggatggctatctccggtgacgattgtgtagtgaagcccaccgacgataggtttgccacggcacttacagctctgaatgacatgggcaaagtccgcaaggatatcccgcagtgggagccttcaaaagggtggaacgactggcagcaagtgcccttctgcagtcaccattttcaccagctaattatgaaggatggaagagaaatagttgtgccatgtcggaatcaggacgagctggtcggcagggcccgagtgtctcagggtgctgggtggagcctccgtgagaccgcctgcttgggaaagtcctacgcacaaatgtggcagctgatgtatttccacagacgcgatcttcggctggcggccaacgctatctgttcagccgtacctgttgactgggtgcccactagcaggacaacctggtctattcatgcacaccatcagtggatgactaccgaagacatgctctccgtctggaatagagtgtggatcgaggaaaacccatggatggaggataaaacacacgttagtagctgggaagacgtgccctacttaggcaagcgcgaggatcaatggtgcggctcgctgattgggttgacggctcgggccacctgggcaactaatatccaggtcgccataaaacaggtgaggcgactgatcggaaacgagaattatctcgactacatgacatccatgaagagatttaaaaacgaatctgatcctgagggtgcgctttggtga

SEQ ID NO: 14255 - RNA, 9879 nt, synthetic construct
  misc_feature 1..9879: note = derived and/or modified CDS sequence (opt3) from DENV-1__DQ285558__SS-prME
  source 1..9879: mol_type = other RNA
agcgtgaccatgctgctcatgcttctgcccacagccttgactttccacttaacgacccgaggcggggagcctcatatgatcgtcggaaagcaggaaaggggtaaatccctgctatttaagacatctgctggcgttaatatgtgcactctcattgcaatggacctgggggagctttgtgatgacaccatgacatacaaatgcccacggattaccgaaactgagccggatgacgtggattgttggtgcaatgccacagaaacctgggtaacgtatggaacttgttcacaaaccggcgagcaccgccgagacaagcgtagtgtggcgctggctccccatgtcggtttggggctcgagacaaggactgaaacctggatgagctccgagggagcctggaggcagatccagaaagtggaaacatgggcactgcggcaccctggcttcaccgttattgccctgtttctcgctcatgcaatcggcacgtctattactcagaaggggatcatattcatcttactgatgcttgtgacaccatcgatggccatgcgctgcgtcggaattggtaacagagattttgtggagggcttgtcaggggctacctgggtagacgttgtgctggagcacggaagctgtgtcactacaatggccaaggataaacccaccctagacatcgaactcctgaagacggaggtgaccaatcctgcggtgcttaggaaactgtgcattgaagcaaagatcagtaacacaactaccgattcccggtgtccaacacaaggcgaggccactttggtcgaagaacaggacaccaatttcgtttgccgccgaacatttgtggatcggggttgggggaacggatgtggcctcttcggcaaagggtctctgataacctgcgctaagtttaagtgcgtaactaaattagagggaaagattgtgcagtacgaaaatctgaaatatagcgtcatcgtgacggttcacacaggtgaccagcatcaagtgggcaacgagaccactgaacacgggaccattgccacaatcacaccccaggcacctacttccgagatccagctcacagactacggagctcttacgctggattgttcaccaaggaccggcttggacttcaatgaaatggtcctactgactatgaaggagaaaagttggctcgtgcataagcagtggtttctggatcttccgctgccctggacaagcggtgcctctacctcccaagagacatggaaccggcaggacttgctcgtaactttcaaaaccgcgcacgccaagaagcaggaagttgtggtcctggggtcacaagagggcgcaatgcacacggctttaaccggagccacagaaattcagactagcggcaccacaactatatttgctgggcatctgaaatgccgtctaaagatggataaactcaccctgaagggaatcagttatgtgatgtgtacgggttctttcaaacttgagaaggaagtcgccgagacacagcacggcaccgtgttggttcaggtgaagtacgaggggactgacgcaccttgcaaaattccattctccagccaagatgaaaagggagtaacacagaatggccgcctggtcaccgccaaccccatcgtgactgacaaagagaagcctgttaatatagaagctgagccaccctttggtgagtcgtatattgtggtcggggcgggcgaaaaagcactcaagctgtcttggttcaagaaaggatcctcaatcggcaagatgtttgaggccaccgctagaggggccaggcggatggcaatccttggagatacagcctgggacttcggtagtattggcggggtgtttacgagcgtaggaaaactggtgcatcagatcttcggcaccgcttacggtgttttgttttccggggtctcttggactatgaagattggcataggaatcctcctgacatggttaggcctgaacagccgatcaaccagtctatccatgacatgtattgccgtggggctcatcactctgtaccttggagtgatggtccaggcagatagcggctgcgttatcaattggaaaggtcgcgaattgaagtgtgggtctggaattttcgtgaccaacgaggtgcacacgtggacagaacaatataagtttcaggcggactcaccgaaaagactgagtgctgccataggcaaggcatgggaggagggtgtatgcggcatcaggagcgccacccggctcgaaaacattatgtggaaacagatctccaatgagctgaaccatattttactggaaaatgacatgaagttcactgtcgtggttggggatgtgtctggaatccttgctcagggcaaaaagtcgatacgccctcaacccatggagcacaaatacagctggaagtcctgggggaaggccaaaatcattggagcagacgtccagaacaccacatttatcattgatggcccaaatactcctgaatgtcccgacgatcagagagcttggaacatctgggaggtggaggactatggtttcgggatatttaccacaaatatttggttgaagctcagggattcatacacgcaggtttgcgaccaccgtctgatgagtgccgcgatcaaagattctaaggccgtgcatgctgacatgggatattggattgaaagcgagaaaaacgaaacctggaagctagcacgggcctccttcatcgaggtaaagacttgtatatggccaaaatcacacacactgtggagcaatggcgtcctcgaatctgagatgatcattcccaagatctacggtggccctatttcccaacataactatcgaccagggtacttcacccagactgctggaccgtggcacctgggcaaacttgagttggattttgacctgtgcgaagggacaaccgtggtggtcgatgagcactgcggaaatagaggccccagtttaaggacgactaccgttacaggtaagatcatacatgaatggtgttgccgcagctgtaccctccctccactgcggttcaaaggggaggacggatgctggtacggcatggagattagacccgtgaaggaaaaggaggaaaaccttgtaaaatctatggtgtccgccggttcaggcgaggtcgacagttttagcctggggttgctctgtatctcgatcatgattgaagaggtgatgaggtcccgctggtctcgaaagatgctgatgactggaacactagcagttttcctgctcctgaccatgggccagcttacatggaatgatttgatccggctgtgcattatggtgggggcgaacgccagcgacaatatgggaatgggcactacctatttagctctcatggccacgtttcgtatgagacctatgttcgcagtcggtctgctttttaggcgcctgacatcacgggaggtgctactcctgaccgttgggttgagtctggtggcttccgtcgaattaccaaactctctcgaggaactgggagatggccttgccatgggcataatgatcctgaaattgctcactgacttccaaagccaccagctgtgggcaaccctactgtcccttacatttgtaaagactaccttctcactccattacgcctggaaaacgatggctatgattctgagcatcgtgagtttgtttcccctgtgtttatctacaacctcccagaagactacatggctcccggttctgcttgggagcctgggatgcaagcctttgaccatgttcctcattactgagaacaaaatctggggtagaaagtcgtggccactgaatgaaggcataatggcggtggggatcgtctcaattctactgtctagtcttctcaaaaacgatgtgcccctggccggacctttgatcgcaggcggtatgttaattgcttgttatgtaatctccgggagctctgccgacctgagcctcgagaaggccgctgaggtgtcctgggaagaggaagcagagcactcaggagccagtcataatatactggtcgaaattcaggatgacggcacaatgaaaatcaaggatgaggagagggacgataccatcacgattcttctgaaagcgactttgctagctataagcggcgtttaccccatgtctatcccagccaccctgtttgtgtggtatttctggcaaaagaagaaacagcgatccggggtgctctgggacacaccttcacccccagaagtcgagcgcgcagtgctggatgacggaatttaccggatccttcagagaggtttactgggcaggagtcaggttggggtaggagtgttccaagaaggcgtctttcacaccatgtggcacgtgacacgtggtgccgttctcatgtatcaggggaagcgcttggagccgagctgggcttccgtgaaaaaggacctgatttcttacggaggcggctggcggttccaggggtcgtggaacactggagaggaagtccaggtgatcgcagtagagcctggtaaaaatcccaagaacgtccaaaccgccccaggcacgtttaagacaagcgaaggggaggtgggagcgatagctctcgatttcaaacccggcacttcaggttcccctatcgttaatagagaagggaagattgtgggactgtacggcaacggcgtcgtgaccacaagtgggacctatgtttctgccatcgcacaggccaaagctagccaggagggaccacttcccgagattgaagacgaggtgtttaggaagcgaaatctgactatcatggatttgcatcctggttccggcaaaacccggcgctacctaccggccatagtcagagaagcaattaagaggaagctgcggacactcgtgttagctccaacgcgagtagtggcctcagagatggcggaagccctgaaagggatgcccatcagatatcaaactaccgcagttaagtctgagcacacaggacgcgagatcgtcgaccttatgtgccatgctaccttcactatgaggctgctcagccctgtgcgtgtgccaaactacaatatgattatcatggatgaagcccactttacagaccccgctagtatagcagcccggggctatatttccaccagagtcggtatgggggaggccgctgcgatcttcatgacggcaactcctccgggaagcgtagaagcctttccccagtctaacgctgtgattcaggatgaggaaaaagacatcccagagaggtcatggaactccggctacgattggataacagacttccctggcaagaccgtttggtttgtgcccagtattaaaagcgggaacgatatcgccaattgtttgcgcaagaacggaaagcgagtcatccagctgtcgagaaaaaccttcgacactgagtatcaaaagaccaagaataatgactgggattacgtggttaccacagacatttctgaaatgggtgcaaacttccgggccgatagggtgatcgacccacgccgttgcctcaagcctgtcattctgaaagatggccccgagagagtgatacttgctgggccaatgccggtaactgtggcgtccgccgcacagcggaggggacgcatcggccgaaatcagaacaaggaaggtgaccagtacatttatatggggcaacctctaaataacgatgaggaccatgctcactggacggaggccaagatgctgttggataatatcaacacccccgaaggcatcattccagcattatttgagcccgaaagagagaaaagcgccgctatagacggagaataccggctgaggggcgaggcccgcaagacattcgttgagctcatgagaagaggggatctgcctgtctggctttcatataaagtggcgagtgaaggatttcagtactctgaccggcgttggtgcttcgatggtgagcgcaataaccaggtgctggaagagaatatggacgtcgaaatctggactaaggagggcgagaggaaaaagctcagaccaagatggttggacgcacggacctattccgatcccctggccctacgcgaatttaaagagttcgctgccgggagaaggagcgtttcaggagacctgattctcgaaatcggcaaacttcctcagcacctgacacaacgggctcagaacgcattagataatttggtgatgctgcataacagtgagcagggtgggaaggcctaccgacacgctatggaggaactcccggacaccattgagactctgatgcttctggccctcatcgcagtattgacgggcggagtgaccctgtttttcttaagcggcagagggctaggaaaaacatccataggtctgctctgtgtcatgtctagctccgcgcttctgtggatggcctcagtggaaccacattggatcgctgcctctattatcttggagtttttcctgatggttctcctgattcccgaacctgatcgccagaggactccccaagacaatcagcttgcatatgtggtcatcggcctcctgtttatgatattgaccgtagctgccaacgagatggggctgttagagacaaccaagaaagatctaggaattggccacgcagccgctgaaaaccaccatcacgcggccatgctggacgtggatctccatccagcaagtgcttggactctttacgccgttgccacaacgatcattacccctatgatgcggcacactatcgagaatacaaccgcaaacatatcgctgaccgctatcgccaatcaggcggctattttgatgggtctggacaaggggtggcccatcagcaaaatggatattggcgtgccactcctggcccttggatgctactcccaagtcaaccctttaacactgactgcagccgtgctcatgttggtcgctcattatgcaatcataggcccggggctgcaggccaaggcgacgcgtgaagctcagaagagaaccgccgcaggaattatgaaaaatcccacagtggacggcatcgttgccatcgatctagacccagtggtatacgacgctaagttcgagaaacagctgggtcaaattatgctccttatcctgtgtacttctcagatattgctgatgaggaccacatgggccctctgcgaatcaattaccctggcaactgggcctttaacgacactttgggagggaagccccggcaagttttggaacaccactatcgctgtgtccatggccaatattttccgcggtagttatctggcgggcgccgggctcgcattctctctaatgaaaagcctgggaggcgggcggcgaggaaccggcgctcagggtgagacattgggggaaaagtggaagagacagctgaaccaactctcaaaatccgagtttaatatctacaagaggagtggaatagtcgaagttgatcgcagcgaggccaaagaaggccttaagcggggtgagactatcaaacacgcagtgtctagaggcaccgctaagctgcgttggttcgtcgagaggaacttggtgaagccagaagggaaagtaattgacctgggatgtggcagaggcgggtggtcctattactgcgccgggctcaagaaagtgacagaggttaagggttatacgaaagggggacctggccacgaggaacccatcccgatggccacctacggctggaatttagtgaagctgtactcagggaaagatgtctttttcattccacctgaaaagtgtgacactcttctgtgcgatatcggagagagctcgcccaacccaacaattgaggaaggtcgcaccctacgagtgctcaagatggtcgagccctggctgagaggcaatcagttttgtatcaaaatattgaacccttatatgccgtctgtggttgaaactctggagcagatgcagaggaagcatgggggaatgctcgtacggaatccccttagtcgcaactccacacacgagatgtactgggtgagctgcggcaccggtaatattgtctcagcggtgaacatgacgtccagaatgctgttaaacaggttcaccatggctcatcgaaaaccaacatatgaacgggacgttgatctgggggcaggaactcgtcacgtggccgtcgagcctgaagtggctaatttggacatcatcggccaaagaattgagaacataaagaatgaacacaaatctacctggcattacgatgaggacaacccctataagacatgggcctaccacggcagctatgaggtaaagcctagtgggtccgcaagctctatggtgaatggagttgtccgcctcctgactaaaccatgggatgtgatccccatggtgacccagattgccatgacagacaccactccttttggtcagcaaagggtcttcaaggaaaaagttgacacgcggacaccaaaggctaaaagaggcaccgcgcagatcatggaggtgactgccaagtggctatgggggtttctttcacgcaacaagaaacccaggatttgtacccgagaagagttcacacggaaggtaagaagtaatgcagctatcggagccgtgtttgtcgatgaaaaccagtggaactccgcaaaagaggccgtggaggacgaaaggttctgggatctggttcgccgtgagcgggaactccataagcagggcaaatgcgctacgtgcgtgtacaacatgatgggtaagagagagaagaaactgggggaatttggaaaggccaaaggcagcagggcgatatggtacatgtggttgggcgcacgcttcctggagttcgaggccctcgggtttatgaatgaagaccactggttctctcgagagaactcgctttcaggagtcgaaggtgagggcctgcataagttagggtatatcctgcgggatattagcaaaatcccgggaggcaatatgtacgctgacgataccgccggttgggacactagaattacagaggatgacttgcaaaacgaagcaaagatcaccgatataatggagcctgaacacgctctcctggccacttccatttttaaactaacatatcagaataaggtggtaagggttcagcgcccagctaagaacgggaccgtgatggacgtcatcagtagacgggatcagaggggatctggccaagtgggcacatacgggcttaacactttcaccaatatgggagcccagctgatccgtcagatggagagcgaaggtatattttccccctcagagctcgagacgcctaacctggcaggccgagtgttggactggttagaaaaacacgggatagagcgcctgagacggatggcgatcagtggagacgattgtgtcgttaagccaattgacgataggttcgccaccgctctcacagcccttaatgacatgggcaaagtgcgcaaggatatcccccagtgggaaccgtctaaaggttggaacgactggcaacaggtacctttttgcagccatcacttccatcagctgattatgaaggatgggagagagatcgtggtcccctgtcggaatcaggacgagctagtgggaagggcacgagtttcccaaggcgctggctggtcactgcgtgagactgcctgcctcggaaagagctatgcacagatgtggcagttgatgtactttcacagacgcgatctgcggcttgccgcgaacgctatatgttctgccgtgccagtcgactgggtgcctacctccaggacaacttggagtatccacgcacatcaccaatggatgaccacggaggatatgctgagcgtatggaatagagtttggattgaagagaacccctggatggaagacaaaacacatgtgtcgtcctgggaggacgtcccatatctcggaaagcgcgaagatcagtggtgcggttctttaatcggcctgaccgcccgggctacttgggccacaaatattcaggtggcaatcaaccaggttaggcgattgattgggaatgagaactacctggactacatgacctcaatgaaaagattcaagaatgagagcgatcccgaaggagctctctggtga

SEQ ID NO: 14256 - RNA, 9879 nt, synthetic construct
  misc_feature 1..9879: note = derived and/or modified CDS sequence (opt3) from DENV-1__DQ285559__SS-prME
  source 1..9879: mol_type = other RNA
agcgtgaccatgctgctcatgcttctgcccacagccttgactttccacttaacgaccagaggcggggagcctcatatgatcgtctccaagcaggaaaggggaaagtctctgctatttaagacatcagttggtgtgaatatgtgcactctcattgctatggacctgggcgagctttgtgaagataccatgacatacaaatgcccacggatcaccgaggccgaaccggacgatgtagactgttggtgcaatgccactgatacatgggtgacctatgggacgtgtagtcaaactggagagcaccgccgagacaagcgtagcgtcgcgctggctccccatgtgggcttgggtctcgagaccagaacagaaacttggatgtcctctgagggggcctggaaacagatccagaaggttgaaacctgggcactgaggcaccctggattcacagtgattgccctgtttctcgctcatgcaatcggcacctcgattacgcagaagggcatcatattcatcttactgatgcttgtcactccatcaatggccatgcggtgcgtggggattggaaaccgcgattttgtagagggtttgagcggcgctacatgggttgacgtggtcctggagcacgggagttgtgtgaccactatggccaaaaataagcccacactagatatcgaactcctgaaaaccgaggtgacgaaccctgcggtccttagaaagctgtgcattgaagcaaaaatctccaataccacaactgactctaggtgtccaacccaaggagaggccacattggttgaggaacaagatgctaacttcgtgtgccggcgcacttttgtagaccgaggctggggtaatgggtgtggactcttcggcaagggcagcctgttaacctgcgccaagtttaaatgcgtgacaaagctggaggggaaaatagtccagtacgaaaacctcaagtattccgtgattgttaccgtgcacactggagatcagcatcaagtcggtaatgagacgacagaacacggcaccatcgcaactattaccccacaagctcctacatcagagatccagcttatcgactacggggccctgaccttggactgtagtccaagaactggactagatttcaacgaaatggtgctgctcacaatgaaaggcaagagctggctggtacataaacagtggtttcttgacctgccgttgccctggacgtctggtgcgtccacctcacaagagacttggaataggcaggatctcctggttacattcaagaccgcccacgcaaagaaacaggaggtggtcgtgttagggagccaagaaggcgctatgcacacagccctgactggagctaccgagattcagacgagtggcaccacaactatatttgccgggcatctaaagtgccggctcaaaatggacaagctgacccttaaaggaatgtcttatgtcatgtgtacaggttccttcaagttggaaaaggaggtggcagaaactcagcacggcaccgttctggtgcaggtaaaatacgaggggacggatgccccttgcaagatcccattcagcacacaagacgagaaaggagtcacccagaacggccgtctcattactgctaatcccatcgtgacagataaggaaaaacctgttaacatagagaccgaaccaccctttggtgagtcgtatattgtggtcggggcgggcgagaaggcactgaaactttcttggttcaaaaagggatcctcaatcggcaaaatgtttgaagccactgctcgcggggccagaaggatggcaatcctgggagacaccgcctgggatttcggtagtattggcggggtgtttacaagcgtaggaaagttgacgcatcaggtgttcggcaccgcttacggtgttctcttttccggggtctcttggactatgaaaatcggcattggaatactgttaacatggctgggcctaaatagccggtcaaccagtctctccatgacatgtatcgccgtggggatggtgactctgtaccttggagtcatggttcaggcagacagcggctgcgtgattaactggaagggtcgagagttgaagtgtgggtctggaatcttcgtgaccaacgaagtacacacgtggacagagcaatataaatttcaggcggattcaccgaagaaactgagtgctgccatcggcaaggcatgggaagagggtgtctgcggcattcgcagcgccaccagactcgagaatataatgtggaaacagatctccaacgaactgaattacattttactggagaacgacatgaagttcactgtggttgtgggggacgctaatggaatccttgcccagggcaaaaagatgattaggcctcaacccatggaacataagtattcttggaaatcgtgggggaaggcaaaaatcataggagctgatatccagaacaccacatttattatcgacggcccagatactcctgagtgtcccgacgatcagcgggcctggaatatttgggaagtcgaggactacggtttcgggatctttaccacaaacatatggttgaagctccgcgatagctatacgcagatgtgcgaccacagactgatgtccgcggccattaaagattcaaaggctgtgcacgcagacatgggatactggatcgagagtgaaaagaatgagacctggaaactagccagggcttctttcattgaagttaagacttgtatctggccaaaaagccatacactgtggtccaacggcgtgctcgagtcagaaatgataatccccaagatttatggtggccctatcagccaacacaattaccgtccagggtacttcacccagactgccggaccgtggcatctgggcaaacttgagttggattttgacctgtgcgaggggacaaccgtagtcgtggatgaacactgcggaaaccggggcccctctttacgaacgactaccgtgacaggtaagattatccacgagtggtgttgcagatcctgtaccctccctccactgaggttccgcggggaagacggatgctggtatggcatggagatacggcccgtcaaggagaaagaagagaatcttgttagaagtatggtgagcgcaggttctggcgaagtagactccttttcactggggattttgtgtgtgagtatcctcatcgaggaagtcatgaggagcaagtggtcgcgcaaaatgctgatgactggaacactagcggtgttcctgctcctgattatgggccagcttacctggaacgatttgacacgactgtgcatcatggttggggccaatgcttccgaccggatgggaatgggcactacctacttagccctcatggcaacgtttaagatgcgtcctatgttcgctgtgggtctgctttttagaaggctgacatctcgcgaggtcctactcctgaccattgggttgagcctggtggcctcagttgagttaccaaacagtctcgaggaactgggagatggccttgcaatgggcataatgatcctgaaattgctcactgacttccaaccccatcagctgtggaccacactactgtcccttacttttattaagaccacgctctctctggattatgcctggaagacaatggctatgaccttgagcatcgtgtccctgttcccgttatgtctctcaactacaagccagaaaaccacttggctgcctgtccttctggggagttttggatgcaagccattgacaatgttcctcattaccgaaaacaaaatctggggtcggaagtcttggcccataaatgagggcatcatggcggtagggattgtgtccatcctgctaagctcgctgcttaaaaacgacgttcctctcgccggacccctgattgcaggcggtatgttgatcgcttgttacgtgatatcagggtctagtgccgatttatccctggaaaaggccgctgaggtcagctgggaggaagaggcagaacactctggaacgagccataatattctcgtggaggtacaggacgatggcactatgaaaatcaaggacgaagagagagatgacaccctgacaatccttctgaaggccaccttgctagcggtgtccggcgtctatccaatgtcaattcctgctacactgtttgtttggtacttctggcagaagaagaaacagaggagtggggtgctctgggatactcccagcccaccggaggtggaacgagccgtcctggacgacggaatatatcgcatccttcagcggggtttactgggcagatctcaggtgggggttggagtattccaagatggcgtgtttcacaccatgtggcatgtcacgaggggtgcagtgctcatgtaccaggggaaacgtttggagccttcctgggcctcagttaaaaaggacctgattagttacggaggcggctggcgcttccaggggagctggaacacaggagaagaggtgcaggtcatcgctgtggagcccggtaagaatcccaagaatgtacaaactacccccggcacatttaagacccctgaaggggaggtcggagcaattgccctcgatttcaaaccaggcacttccggttctcccatcgtgaatcgggaagggaagatagttggactgtatggcaacggcgtggtcaccacatcggggacgtacgtgagcgcgatcgctcaggccaaagcatcacaggagggacctcttccggaaattgaggacgaggtttttaagaagagaaatctgactatcatggatttgcacccaggttccggcaaaaccaggcgatatctacccgccattgtgcgggaagctatcaagcgcaaactgagaacactcatattagcccctaccagggtcgtggcaagtgagatggctgaagccctgaaggggatgccaattcggtaccaaactacagcggtaaaatctgagcacaccggacgagaaatcgtggaccttatgtgccatgccacgttcactatgagactgctcagccccgttcgcgtccctaactataatatgatcattatggatgaggcacactttacagacccggcttccatcgccgctaggggctacatatcaacccgtgtgggtatgggggaggcagccgccattttcatgaccgctactcccccaggatctgtggaagcgtttcctcagagcaacgcagtcatccaggatgaggaaaaggacattcccgagcggagttggaactccggctatgattggatcacagacttcccaggcaagaccgtatggtttgtgcctagcataaaatctgggaacgacattgccaattgtttgagaaagaacggaaaaagggttatccagctgtcacgcaagacattcgatactgaataccagaagacgaagaacaatgactgggattacgtggtcaccacagacatctccgagatgggtgctaacttccgagccgatagagtgattgacccccggaggtgcctcaagccagttatcctgaaagatggcccggagcgcgtgattcttgcagggcctatgcccgtcactgtggccagtgctgcgcagcgtagaggacggataggcaggaatcagaacaaggaaggtgaccagtatgtatacatggggcaaccactaaataacgatgaggaccatgcccactggaccgaagcaaaaatgctgttggataatatcaacacacccgagggcattatccctgctttatttgagccagaacgcgaaaagagcgccgcaatcgacggagaatatcgactgagaggcgaggcccggaaaaccttcgtggaactcatgaggcgcggggatctgcccgtttggctttcgtacaaggtcgcttctgagggatttcagtattccgacagaaggtggtgcttcgacggtgagcggaataaccaggtgctggaagagaatatggatgtggaaatttggactaaagagggcgaacgtaagaagctccgccctcgatggttggacgccagaacgtacagcgatccgctggcgctaagggagtttaaagagttcgcagccgggcggcgctcagtcagtggagacctgatactcgaaatcggcaaacttccacagcatctgaccttaagagctcaaaacgccttggataatctggttatgctccacaactctgagcagggtgggaaggcttataggcacgcaatggaggaactgcccgacacaattgaaactcttatgctgctcgccttgatcgctgtgctgaccggcggagtaacattatttttcctatccggcaaggggctgggaaaaaccagcattggtctcctttgtgtgatggcctcaagtgcactgttgtggatggcgagcgtcgagcctcattggatcgccgcttccataatcctggagtttttcctcatggtgctgcttattcccgaaccagatcggcagcgaactcctcaggacaatcaactcgcctacgttgtgatcggcctgttgtttatgattctgacagtcgcagctaacgagatggggttactagaaacgaccaagaaggatctgggaatcggccacgtagccgcagagaaccatcaccacgccactatgctcgacgtggatcttagacccgcttctgcgtggacactgtacgccgttgcaaccaccgtgataacaccaatgatgcgccatactattgagaatacgaccgctaacatcagcttgacagccattgccaatcaggcagctatcctgatgggtctcgacaaagggtggcctatatccaagatggatatcggcgtcccgctgcttgccttaggatgctattcacaggtgaaccccctgactctcaccgcggctgtcttgatgctggtggcccactacgcaattatcggcccagggctacaagccaaagctacaagggaagcacagaagcggaccgccgcgggaattatgaaaaatcctactgttgacggcatcgtggctatagacctggatcccgtagtgtatgacgccaagttcgagaagcagctcggtcagattatgcttctgatcttgtgtacgtctcaaatcctgctcatgcgtacaacctgggcactgtgcgaaagtattactttagccaccgggccacttacaactctgtgggagggatcgcctggcaaattttggaacaccacaatcgctgtcagcatggccaatatattcagaggttcctacctcgcaggcgctgggctagccttctctctgatgaagtcattgggaggcgggaggcgcggaacgggcgcgcagggtgaaaccctgggggagaaatggaagcggcagctcaaccagcttagcaaatccgagtttaatacttataagcgaagtggaattatggaagttgatagatctgaggccaaggaaggcctgaaaaggggtgagacaaccaagcatgcagtgagccgcggcactgctaaattgcggtggttcgtcgaaagaaacctggtgaagcccgaggggaaagtaatcgacctcggatgtggccgtgggggatggtcatactattgcgccggcttaaagaaagtgacagaggttaagggttacaccaaagggggaccgggccacgaggagccaattcctatggcaacgtacggctggaatctggtgaaacttcattccgggaaggatgtctttttcatacccccagaaaaatgtgacaccctgctatgcgatataggagagagtagccccaaccctacaatcgaagagggtaggactctccgggtgctgaagatggtcgagccgtggttgaaaggcaatcaattttgtattaagatcctgaacccctatatgccatctgtggttgaaaccctcgagcagatgcagcgcaagcacgggggaatgcttgtacgaaatcctctgtccagaaactcaacacacgaaatgtactgggtgagctgcggcactggtaatattgtctcggctgtgaacatgacctctaggatgttactgaaccggttcacaatggcccatcgcaaacccacctatgagagagacgttgatttgggggccggaactaggcacgtggcggtcgagcctgaagtggctaatctcgacatcattggccagcgaatcgagaacataaagaatgaacataaaagtacgtggcactacgatgaggacaacccatataagacatgggcataccacggctcctatgaagtaaaacccagcgggtcagcctcctctatggtgaatggagttgtccggctgctaaccaagccttgggacgtgattccaatggtgactcaaatcgctatgaccgatacaacgccctttggtcagcagcgtgtcttcaaggagaaagttgacaccagaactccgcgcgccaagaggggcacagcacaaatcatggaggtgaccgccaaatggctttgggggtttctgagccggaacaagaaacctagaatttgtactcgcgaagagttcacaaggaaggtacgaagtaatgctgcgataggagccgtgtttgtcgatgaaaaccagtggaactccgcaaaggaggctgtggaagacgagcggttctgggatctcgttcatagagagagggaactgcacaaacagggcaagtgcgcaacctgcgtgtacaacatgatgggtaaacgcgagaagaaattgggggaatttggaaaggcaaaaggcagccgtgccatctggtacatgtggctgggcgctcggttcctcgagttcgaagcccttgggtttatgaatgaggaccattggttctctagagagaactcactgagtggagtcgaaggtgagggcttacacaagctggggtatattttgagggatatctccaagattccaggaggcaatatgtacgcggacgatacagcaggttgggacactcgcatcaccgaagatgacctccagaacgaggccaaaataacggatatcatggagcccgaacatgctctgctagccaccgcaatttttaaacttacatatcaaaataaagtggtacgagttcagcggcctgctaagagcgggactgtgatggacgtcatctctagaagggaccagcgcggatcgggccaggtgggcacctacgggctgaacacattcactaacatggaggcccaactcattagacagatggaatcagagggaatctttctgccaagcgaattggagacccccaatttagctaaacgggtgctggattggctcgagaagtatggtgccgaaaggcttaagcgtatggcaatatccggcgacgattgtgtcgttaaaccgattgacgatcgattcgcgaaggccctgacggctctaaacgacatggggaaagtgcgcaaggatatccctcagtgggagcccagtaaaggatggaatgactggcagcaagtaccattttgctctcaccacttccatcagctgatcatgaaggatggcagagaaattgtggtcccttgtcggaaccaggacgagctcgtgggtagggcccgcgttagccagggggcaggatggtccttgagagaaacagcttgcctgggcaagtcatacgcccaaatgtggcagcttatgtattttcaccggagggatctgcgactcgcagccaatgcgatatgtagtgctgtgcccgtcgactgggtgccaacctctcgtactacatggagcatccatgcccaccaccagtggatgaccactgaggacatgttatccgtatggaacagagtttggattgaggaaaatccctggatggaggataaaacccatgtgtcaagctgggaagaggtcccttacctgggcaagcgcgaagaccaatggtgcgggtctttgatcggactgacagcacgggccacgtgggctaccaacattcaggtggccatcaatcaggttaggagactcataggtaacgagaattaccttgattatatggcatccatgaaacgcttcaagaacgagagtgacccagaaggcgctctgtggtga

SEQ ID NO: 14257 - RNA, 9879 nt, synthetic construct
  misc_feature 1..9879: note = derived and/or modified CDS sequence (opt3) from DENV-1__AF311956__SS-prME
  source 1..9879: mol_type = other RNA
agcgtgaccatgctgctcatgcttctgccaactgcattggctttccacttaactacgagaggaggggagcctcatatgatcgtctccaagcaagaaaggggaaaatctctgctgtttaagacctcagccggtgttaacatgtgcacactcattgccatggacctgggcgagctttgtgaagatactatgacctacaaatgcccacggataaccgaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagaaggtggaaacttgggctctgaggcaccctggattcaccgttattgcactgtttctcgcccatgctatcggcacatcgattacccagaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggccaagaataagcccactctagatatcgaactcctgaaaacagaggtgaccaaccctgccgtgcttagaaagctgtgcattgaagctaaaatctccaatacgaccacagactctaggtgtccaactcaaggagaggccaccttggtcgaagaacaagatgcaaacttcgtttgccggcgcacatttgtggaccgaggctggggtaatgggtgtggactcttcggcaagggcagcctgttaacttgcgctaagtttaaatgcgtaaccaagctggaggggaaaatagtgcagtacgaaaacctcaagtattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaagaactggactagatttcaacgaaatggtcctgctcacaatgaaagaaaagagctggctggtgcataaacagtggtttcttgacctgccgttgccctggacgtctggcgcatccacctcacaagagacttggaataggcaggatctcctggtaacattcaagaccgctcacgccaagaaacaggaagttgtggtcttaggtagccaagagggggctatgcacacagccctgactggcgcaaccgaaatccagacgagtggaaccacaactatttttgccggccatctaaagtgccggctcaaaatggacaagctgacccttaaagggacatcttatgtgatgtgtactggatccttcaagttggagaaggaagtcgctgagacccagcacggtacggtgctggttcaggtgaaatacgagggcacagatgcgccttgcaagataccattcagcacccaagacgaaaaaggggtaactcagaacggacgtctcatcacagcaaatcccattgtcaccgataaggagaaacctgtgaacatcgaaactgagccaccctttggcgagtcgtatatagttgtgggtgccggggaaaaggctctgaaactttcttggttcaaaaagggctcctcaattggaaaaatgtttgaggccaccgcacgcggcgccagaaggatggctatcctgggggacacagcctgggatttcggaagtatcggtggcgtctttacgagcgtggggaagttggtacatcaggtgttcggaaccgcatacggcgttctcttttccggtgtctcttggactatgaaaattgggatcggcattctgttaacatggctgggactaaatagccggtcaaccagtctctccatgacatgtatagcggtgggcatggtgactctgtaccttggggtcatggttcaggctgacagcggatgcgtgatcaactggaagggccgagaattgaagtgtggttctgggattttcgtgaccaacgaggtacacacgtggacagaacaatataaatttcaggccgattcaccgaagcgcctgagtgcagccatcggacgagcttgggaggagggcgtctgcggtatcaggagcgccacccggctcgaaaatattatgtggaaacagatatccaacgagctgaatcatatcttactggaaaacgacattaagttcactgtggttgtgggcaatgcaaacgggatccttgctcagggcaaaaagatgattcgccctcaacccatggagcacaaatactcttggaagtcgtggggcaaggccaaaatcataggggcggacatccagaataccacatttattatcgatggaccagacactcctgaatgtcccgatgagcagagagcctggaacatttgggaggtcgaagactatggcttcggtatctttaccacaaatatatggttgaagctcagggatagctacacgcagatgtgcgaccaccgtctgatgtccgctgcaattaaagattcaaaggccgtgcatgctgacatggggtattggatcgagagtgagaaaaacgagacctggaagctagcccgggcatctttcattgaagttaagacttgtatctggccaaaaagccacacactgtggtccaatggagtgctcgagtcagagatgataatccccaagatgtacggcggtcctattagccaacataactatcgaccaggctacttcacccagactgcggggccgtggcacctgggaaaacttgaattggattttgacctgtgcgagggcacaaccgtagtcgtggatgaacactgcgggtctagaggaccctccttaaggacgactaccgtgacaggcaagatcattcatgagtggtgttgccgcagttgtaccctccctccactgcggttcagaggtgaggacgggtgctggtacggaatggaaatcaggcccgtcaaagagaaggaagagaatcttgttcgcagcatggtgtctgccggctccggtgaagtagattcatttagtctgggcatattgtgtgtgagcattatgatcgaggaggtcatgcgatcgcggtggtcccgtaagatgctcatgactgggacactggctgtgttcctactgctcatcatgggacagctgacctggaacgaccttattagattgtgcatcatggttggcgccaatgcatctgacaaaatggggatgggaacaacttatctggctttaatggccacctttaagatgaggcctatgttcgcagtgggcctcctgtttcgccggcttacgagcagagaagtcctgctactcacaattggtctgtcattggtggccagtgttgagctgccaaactccttagaggaactcggggatggactggctatgggcataatgatgcttaaactgttgaccgagttccaaccccaccagctctggactaccctgctatctctgacatttatcaagactacccttagcctcgactacgcgtggaaaacgacagccatggtgctgtccattgtctcattgttcccgctgtgtttaagcaccacaagtcagaagacaacctggctccctgtactgcttggctcttttgggtgcaagccactgactatgttcttgatcacagagaacgagatttggggaaggaaatcctggcccctcaatgaaggtatcatggcaataggcatcgtgagcattctgctatcgtcactgcttaagaacgatgttcctctcgctgggcccctgatcgccggaggcatgttgattgcctgttatgtgatctctggtagttccgctgacttaagcctggagaaagcagccgaagtctcttgggaggaagaggcggagcatagcgggacctcccacaatatactcgtggaagtacaggatgacggaacgatgaagattaaagatgaggaacgagacgatactctgaccatccttctgaaggctacattgctagccgtgtcaggcgtctacccaatgagtatccctgcaaccctgtttgtttggtatttctggcagaaaaagaagcagcgcagcggcgtgctctgggacacaccctctccaccggaggtggagcgggccgtcctggatgacgggatttacagaatacttcagaggggattactgggtcgttcccaggtgggcgttggggtattccaagatggagtgtttcatactatgtggcacgtcacccgcggcgctgtgctcatgtatcagggtaaacggttggaaccttcatgggcaagtgttaagaaagacctgatcagctacgggggaggctggagattccagggctcctggaacacgggggaggaagtgcaggtcattgccgtggagcccggaaagaatcccaaaaacgtacaaacaactcccggtacctttaagacacctgaaggcgaggtcggggcgatcgctctcgacttcaagccaggaacctctggctcgcccattgtgaatagggagggtaaaatcgttgggctgtacggaaacggcgtggtcactaccagcggcacatatgtgtcagccatagcacaggccaaggcttcccaggaagggcctcttccggagatcgaagatgaggtttttaaaaagcgaaatctgacgattatggacttgcacccaggaagtggtaaaactcggcgctacctacccgccatcgtgagagaagcaattaagaggaagctgcggaccctcatcttagctcctacacgagtcgtggcctctgagatggcggaggccctgaaaggcatgccaataagatatcaaaccactgcagtaaagagcgaacatacagggcgcgagattgtggatcttatgtgccacgctaccttcacgatgaggctgctctcccccgttcgtgtccctaactacaatatgatcatcatggacgaagcccattttactgatccggcttcaattgcagcccggggatatatctctacaagagtgggcatgggtgaggccgctgcgatattcatgaccgcaacacccccagggagcgtggaagcctttcctcagagtaacgctgtcattcaggacgaggagagggatatccccgaacgctcctggaatagcggatacgactggattactgatttcccaggcaaaacagtatggtttgtgccttctatcaagtcaggcaacgacatagccaattgtttgcggaaaaacgggaagagagttattcagctgtccagaaagaccttcgatacagagtatcagaaaactaagaacaatgactgggactacgtggtcacgaccgatatcagtgaaatgggagcaaacttcagggccgaccgcgtgatcgatccccgtagatgcctcaaaccagttattctgaaggacggtccggagcgggtgatccttgctggccctatgcccgtcacagtggcgagcgccgcacagaggcgcgggcgaattggaagaaatcagaacaaagagggcgatcagtacgtatatatgggtcaaccactaaataacgacgaagatcacgctcattggactgaggccaagatgctgttggacaatataaacacccccgaagggatcattcctgcattatttgagccagaacgggagaagtcggccgctatcgatggcgagtacaggctgcgcggagaagccagaaaaacattcgtggagctcatgaggcggggcgacctgcccgtttggctttcttataaggtcgcgtccgaagggtttcagtacagcgatcgtcgctggtgcttcgacggagagcgaaataaccaggtgctggaagagaatatggatgtggagatctggaccaaagaaggtgagagaaagaaactcaggcctcggtggttggacgcacgcacttattcagacccgctggccctaagagaatttaaggagttcgctgccggcaggcggagtgtctctggggatctgattctcgaaataggaaaacttccacagcacctgacgttacgagctcaaaacgcattggacaatctggttatgctccacaactccgagcagggcggtaaggcctacagacatgctatggaggaactgcccgataccatcgagacacttatgctgctcgccttgattgcagtgctgactgggggcgtaaccttatttttcctaagcggaaagggcctggggaaaacatcaatcggactcctttgtgtgaccgcgagtagcgccctgttgtggatggcttccgtcgaacctcactggattgccgcatctatcatactggagtttttcctcatggtgctgcttatccccgagccagaccgccagaggactcctcaggataatcaactcgcttatgttgtgattggtctgttgtttatgatcctgacagtcgccgcaaacgaaatgggcttactagagacgaccaagaaagacctggggattggacatgtagccgctgaaaaccaccagcacgcgactatcctcgatgtggaccttcatcccgccagcgcatggacactgtacgctgttgccaccaccgtgataacaccaatgatgcggcacactattgagaatacgaccgccaacatctccttgacagcaattgctaatcaggccgcgatcctgatgggcctcgataagggttggcctatatcaaaaatggacctgggggtcccgcttttagctctgggctgctactctcaagtgaaccccctcactttgaccgccgcagtcctgatgctagtggcccattatgctatcattggaccaggcctgcaggcaaaggccacacgtgaagcgcagaagagaaccgctgccgggatcatgaaaaatcctactgttgatggaattgtggcaatcgacctcgatcccgtagtgtacgacgccaagttcgagaaacagcttggccaaataatgctgttgattctgtgtacgagtcagatcctcctgatgaggacaacctgggctttatgcgagtcgatcactcttgccaccggtccactgacaactctctgggaagggagccctggaaagttttggaacaccacaattgcagtctccatggctaatatcttccgcggctcttatctagccggtgcgggcctggccttctcattgatgaaaagcctagggggaggccggcgagggacgggagcacagggcgagaccctcggtgaaaagtggaagagacagcttaaccaactgtccaaaagtgagtttaatacttacaagaggtctgggataatggaagttgaccgcagcgaggctaaagagggattgaagcggggcgaaacaaccaaacacgccgtgtcaagaggtactgcaaagctgcgttggttcgtcgagaggaacctcgtgaagcccgaaggcaaagtaattgatttagggtgtggacggggcgggtggtcctattactgcgctggactgaagaaagtgacagaggttaagggctataccaaaggtgggccgggacatgaagaaccaatccctatggccacgtacggctggaatcttgtgaagctgcacagtggcaaagacgtctttttcatgcccccagagaagtgtgataccctactctgcgacattggggaaagctctcccaaccctacaatcgaggaaggacgcactctgcgagtgttgaagatggtcgagccgtggctgagaggtaatcagttttgtataaaaatcctcaacccctacatgccatccgtggttgagacccttgaacagatgcagaggaagcacggcgggatgctggtacggaatcctttatcacgcaacagcacacatgagatgtattgggtgtcgtgcggaactggcaatattgtctctgccgtgaacatgaccagtagaatgctgttgaacaggttcacaatggcgcaccgaaaacccacctacgaacgggatgttgacctcggtgctgggactcgtcatgtggcagtcgagcctgaagtggccaatctggatatcattggacaaagaatcgagaacattaagaatgagcacaaatccacgtggcactatgacgaagataacccatacaagacatgggcttatcatggcagctacgaggtaaagccctcaggctccgcctctagcatggtgaatggggttgtccgcctacttaccaaaccttgggacgtgatcccaatggtgactcagatagcaatgaccgatacaacgccctttggacagcaaagggtcttcaaggaaaaagttgacacccggactccgagagccaagcgcggtacagctcagattatggaggtgaccgcgaaatggctgtggggctttctcagtaggaacaagaagcctcgaatctgtactcgggaagagttcacaagaaaagtaaggtccaatgccgcaatcggggctgtgtttgtcgacgagaaccagtggaatagcgccaaggaagcagtggaggatgaacgcttctgggacctggttcaccgtgagcgggaattgcataaacagggaaagtgcgcaacctgcgtgtataacatgatgggcaaaagagagaagaagctgggtgagtttgggaaagctaagggatctagggccatttggtacatgtggctcggcgcgcgcttccttgagttcgaggcactgggctttatgaatgaagatcactggttctcacgagagaacagtttatccggggtcgagggagaaggtctgcataaattgggctacatactccgggacatcagcaagattccagggggaaatatgtatgccgatgacacagctggctgggatactagaatcaccgaggacgatctgcaaaacgaagccaaaattacggacatcatggagcccgaacacgcactacttgctacctctatatttaagctgacataccagaataaagtggtaagggttcagcgccctgccaagaacggtactgtgatggatgtcatctcgagacgggaccagagggggtcaggacaagtgggcacctatggcctcaacacattcactaatatggaggtgcagctgattcgtcagatggagagcgaagggatctttttcccatccgagttggaaagtcccaacttagctgagcgagtcctggattggctcgaaaagcacggagccgagcgccttaaaagaatggcaatttctggtgacgactgtgttgtgaagccgatcgatgaccggtttgcgaccgccctgatagctctaaatgatatgggcaaagtaaggaaggacattcctcagtgggagcccagcaaagggtggaacgattggcaacaggtgccattctgctcccatcactttcatcagctgatcatgaaggacggacgcgaaatcgtcgtgccttgtagaaatcaggatgagctcgttggccgggccagggtgtcacaaggtgcagggtggagtttgcgagaaacggcttgcctgggaaagtcttacgcccagatgtggcagcttatgtatttccaccgtagagacctgcgcctcgcagccaacgcgatttgtagcgctgtccccgtggattgggtaccaacatcccggaccacttggtcaatacacgcccatcaccaatggatgacaaccgaggacatgttaagcgtttggaatagggtgtggatcgaagagaacccctggatggaggataaaactcatgtctcttcctgggaagaggtgccttacctgggcaagagagaagaccagtggtgcggcagtttgattgggctgaccgcacgcgccacatgggctacgaatatccaggttgccattaaccaggtgcggaggctcatcggaaatgagaactatcttgactacatgaccagcatgaaacgatttaagaatgagtcggatccagaaggtgcactgtggtga

SEQ ID NO: 14258 - RNA, 9879 nt, synthetic construct
  misc_feature 1..9879: note = derived and/or modified CDS sequence (opt3) from DENV-1__AF311958__SS-prME
  source 1..9879: mol_type = other RNA
agcgtgaccatgctgctcatgcttctgccaacagccttggctttccacttaactacgagaggaggggagcctcatatgatcgtctccaagcaagaaaggggaaaatctctgctatttaagacctcagccggtgttaacatgtgcacactcattgccatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagaaggtggaaacttgggctctgaggcaccctggattcaccgttattgcactgtttctcgcccatgctatcggcacatcgattacccagaagggcatcattttcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggccaagaataagcccactctagatatcgaactcctgaaaacagaggtgaccaaccctgccgtgcttagaaagctgtgcattgaagctaaaatctccaatacgaccacagactctaggtgtccaactcaaggagaggccaccttggtcgaagaacaagatgcaaacttcgtttgccggcgcacatttgtggaccgaggctggggtaatgggtgtggactcttcggcaagggcagcctgttaacttgcgctaagtttaaatgcgtaaccaagctggaggggaaaatagtgcagtacgaaaacctcaagtattccgtcattgtgacagttcacaccggagatcagcatcaagtgggtaatgagactacggaacacggcacaatcgccaccattactccccaggcgcctacctcagagatccagcttacagactacgggaccctgactttggactgtagtccaagaacaggactagatttcaacgaaatggtcctgctcacgatgaaagaaaagagctggctggtgcataaacagtggtttcttgacctgccgttgccctggacctctggcgcctccacttcacaagagacatggaataggcaggatctcctggtaaccttcaagacagcacacgctaagaaacaggaagttgtggtcttaggtagccaagagggggccatgcacactgctctgaccggcgccacggaaatccagaccagtggaacaactaccatttttgcaggccatctaaagtgccggctcaaaatggacaagctgacacttaaagggacttcttatgtgatgtgtaccggatccttcaagttggagaaggaagtcgccgagacgcagcacggtacagtgctggttcaggtgaaatacgagggcaccgatgctccttgcaagataccattcagcactcaagacgaaaaaggggtaacacagaacggacgtctcatcaccgcgaatcccattgtcactgataaggagaaacctgtgaacatcgaaaccgagccaccctttggcgagtcgtatatagttgtgggtgcaggggaaaaggccctgaaactttcttggttcaaaaagggctcctcaattggaaaaatgtttgaggctacagcccgcggcgcaagaaggatggccatcctgggggacacggcttgggatttcggaagtatcggtggcgtctttaccagcgtggggaagttggtacatcaggtgttcggaactgcctacggcgttctcttttccggtgtctcttggacaatgaaaattgggatcggcattctgttaacctggctgggactaaatagccggtcaacaagtctctccatgacttgtatagcagtgggcatggtgaccctgtaccttggggtcatggttcaggcggacagcggatgcgtgatcaactggaagggccgagaattgaagtgtggttctgggattttcgtgacgaacgaggtacacacatggaccgaacaatataaatttcaggctgattcaccgaagcgcctgagtgccgcaatcggacgagcatgggaggagggcgtctgcggtatcaggagcgctactcggctcgaaaatattatgtggaaacagatatccaacgagctgaatcatatcttactggaaaacgacattaagttcaccgtggttgtgggcaatgccaacgggatccttgcacagggcaaaaagatgattcgccctcaacccatggagcacaaatactcttggaagtcgtggggcaaggctaaaatcataggggccgacatccagaatacaacttttattatcgatggaccagacacccctgaatgtcccgatgagcagagagcgtggaacatttgggaggtcgaagactatggcttcggtatctttacaacgaatatatggttgaagctcagggatagctacacccagatgtgcgaccaccgtctgatgtccgccgctattaaagattcaaaggcagtgcatgccgacatggggtattggatcgagagtgagaaaaacgagacttggaagctagctcgggcctctttcattgaagttaagacatgtatctggccaaaaagccacaccctgtggtccaatggagtgctcgagtcagagatgataatccccaagatgtacggcggtcctattagccaacataactatcgaccaggctacttcactcagacagcagggccgtggcacctgggaaaacttgaattggattttgacctgtgcgagggcaccacggtagtcgtggatgaacactgcgggtctagaggaccctccttaaggactaccacagtgaccggcaagatcattcatgagtggtgttgccgcagttgtactctccctccactgcggttcagaggtgaggacgggtgctggtacggaatggaaatcaggcccgtcaaagagaaggaagagaatcttgttcgcagcatggtgtctgcgggctccggtgaagtagattcatttagtctgggcatattgtgtgtgagcattatgatcgaggaggtcatgcgatcgcggtggtcccgtaagatgctcatgacagggaccctggccgtgttcctactgctcatcatgggacagctgacatggaacgaccttattagattgtgcatcatggttggcgctaatgcctctgacaaaatggggatgggaactacctatctggcattaatggctacgtttaagatgaggcctatgttcgccgtgggcctcctgtttcgccggcttacaagcagagaagtcctgctactcaccattggtctgtcattggtggcaagtgttgagctgccaaactccttagaggaactcggggatggactggccatgggcataatgatgcttaaactgttgactgagttccaaccccaccagctctggaccacactgctatctctgacttttatcaagaccacgcttagcctcgactacgcttggaaaacaaccgcgatggtgctgtccattgtctcattgttcccgctgtgtttaagcactacaagtcagaagaccacttggctccctgtactgcttggctcttttgggtgcaagccactgacaatgttcttgatcaccgagtatgagatttggggaaggaaatcctggcccctcaacgaaggtatcatggccataggcatcgtgagcattctgctatcgtcactgcttaagaatgatgttcctctcgcagggcccctgatcgctggaggcatgttgattgcctgttacgtgatctctggtagttccgccgacttaagcctggagaaagctgcagaagtctcttgggaggaagaggccgagcatagcgggacgtcccacaacatactcgtggaagtacaggatgacggaactatgaagattaaagatgaggaacgagacgataccctgacaatccttctgaaggcgaccttgctagctgtgtcaggcgtctatccaatgagtatccctgccacactgtttgtttggtacttctggcagaaaaagaagcagcgcagcggcgtgctctgggacactccctctccaccggaggtggagcgggcagtcctggatgacgggatttatagaatacttcagaggggattactgggtcgttcccaggtgggcgttggggtattccaagatggagtgtttcataccatgtggcacgtcacgcgcggcgccgtgctcatgtaccagggtaaacggttggaaccttcatgggctagtgttaagaaagacctgatcagctacgggggaggctggagattccagggctcctggaatacaggggaggaagtgcaggtcattgcagtggagcccggaaagaaccccaaaaatgtacaaactacccccggtacatttaagacccctgaaggcgaggtcggggccatcgcgctcgacttcaagccaggaacttctggctcgcccattgtgaacagggagggtaaaatcgttgggctgtatggaaatggcgtggtcaccacaagcggcacgtacgtgtcagctatagcccaggcaaaggcctcccaggaagaacctcttccggaaatcgaggatgaagtttttaaaaagcgaaacctgactattatggacttgcacccagggagtggaaaaacccggcgctatctacccgctatcgtgagagaggccattaagaggaagctgcggacactcatcttagcacctacccgagtcgtggcttctgagatggccgaagcgctgaaaggtatgccaataagataccaaactacagccgtaaagagcgagcataccggccgcgaaattgtggatcttatgtgccacgcaacgttcactatgaggctgctctcccccgttcgtgtccctaattataacatgatcatcatggacgaggctcattttacagatccggcctcaattgctgcacgggggtacatctctaccagagtgggaatgggcgaagccgccgctatattcatgaccgcgactcccccaggtagcgtggaggcatttcctcagagtaatgccgtcattcaggacgaggaaagggatatccccgagcgctcctggaacagcgggtatgactggattacagatttcccaggaaaaaccgtatggtttgtgccttctatcaagtcaggcaatgacatagctaactgtttgcggaaaaatggcaagagagttattcagctgtccagaaagacattcgatactgaataccagaaaacgaagaacaacgactgggactacgtggtcaccacagatatcagtgagatgggggccaatttcagggcagaccgcgtgatcgatccccgtagatgcctcaaaccagttattctgaaggacggaccggagcgggtgatccttgccggtcctatgcccgtcactgtggctagcgcggcccagaggcgcggccgaattgggagaaaccagaataaagaaggagatcagtatgtatacatgggccaaccactaaacaatgacgaggatcacgcacattggaccgaagctaagatgctgttggacaacataaatacacccgagggtatcattcctgccttatttgaaccagagcgggagaagtcggcagccatcgatggggaatataggctgcgcggcgaggctagaaaaaccttcgtggaactcatgaggcggggagacctgcccgtttggctttcttacaaggtcgcctccgagggctttcagtatagcgatcgtcgctggtgcttcgacggggaacgaaacaatcaggtgctggaggagaacatggatgtggaaatctggactaaagagggagaaagaaagaaactcaggcctcggtggttggacgcgcgcacgtactcagacccgctggcactaagagagtttaaggagttcgccgctggtaggcggagtgtctctggcgatctgattctcgagatagggaaacttccacagcacctgaccttacgagcccaaaatgctttggacaacctggttatgctccacaattccgagcagggaggcaaggcatatagacatgccatggaggaactgcccgatacaatcgaaactcttatgctgctcgctttgattgccgtgctgaccggtggggtaacattatttttcctaagcggcaagggactgggcaaaacctcaatcgggctcctttgtgtgactgcaagtagcgcgctgttgtggatggcctccgtcgagcctcactggattgctgcctctatcatactggagtttttcctcatggtgctgcttatccccgaaccagaccgccagaggacacctcaggataaccaactcgcatacgttgtgattggactgttgtttatgatcctgacggtcgctgccaatgagatgggtttactagaaaccactaagaaagacctgggcattgggcatgtagcagccgagaaccaccagcacgctacaatgctcgatgtggaccttcatcccgcgagcgcctggaccctgtacgcagttgctaccacagtgatcactccaatgatgcggcacacgatagaaaacaccacagccaatatttccttgactgccatcgcaaaccaggctgccattctgatgggactcgataagggctggcctatctcaaaaatggacctgggtgtcccgcttttagcgctggggtgctattctcaagtgaatcccctcaccttgacagctgccgtcctgatgctagtggcacattacgccataatcggcccaggactgcaggctaaggcaacccgtgaggcccagaagagaactgcggctggcattatgaaaaaccctacggttgatgggatcgtggccattgacctcgatcccgtagtgtatgacgcaaagttcgagaaacagcttggacaaatcatgctgttgatactgtgtacaagtcagattctcctgatgaggaccacttgggccttatgcgaatcgatcacccttgctacaggcccactgactaccctctgggagggtagccctgggaagttttggaatacaacgatcgccgtctccatggcaaacattttccgcggatcttacctagctggcgccggtctggcgttctcattgatgaaaagcctgggcgggggacggcgaggcaccggggcccagggagaaactctcggcgagaagtggaagagacagcttaatcaactgtccaaaagtgaatttaacacatataagaggtctggtatcatggaggttgaccgcagcgaggcaaaagaagggttgaagcggggagagaccactaaacacgctgtgtcaagaggcgccgcaaagctgcgttggttcgtcgaaaggaatctcgtgaagcccgagggtaaagtaatagatttaggctgtgggcggggaggctggtcctactattgcgctgggctgaagaaagtgacagaagttaagggatacaccaaaggcggtccggggcatgaggagccaattcctatggccacgtacggatggaaccttgtgaagctgcacagtggcaaagacgtctttttcatgcccccagaaaagtgtgataccctactctgcgacatcggcgagagctctcccaatcctacaattgaagaggggcgcactctgcgagtgttgaagatggtcgagccgtggctgagaggaaaccagttttgtatcaaaatactcaatccctatatgccatccgtggttgaaacccttgagcagatgcagaggaagcacggtggcatgctggtacggaaccctttatcacgcaatagcacacatgaaatgtactgggtgtcgtgcgggactggaaacatcgtctctgccgtgaatatgaccagtagaatgctgttgaacaggttcacaatggcgcaccgaaaacccacctatgagcgggatgttgacctcggcgctggtactcgtcatgtggcagtcgaacctgaggtggccaacctggatattatcgggcaaagaattgagaatatcaagaacgaacacaaatccacgtggcactacgacgaggataatccatataagacatgggcttaccatggaagctatgaagtaaagccctcaggctccgcctctagcatggtgaacggcgttgtccgcctacttaccaaaccttgggacgtgattccaatggtgactcagatcgcaatgaccgatacaacgccctttgggcagcaaagggtcttcaaggagaaagttgacacccggactccgagagccaagcgcggaacagctcagataatggaagtgaccgcgaaatggctgtggggttttctcagtaggaataagaagcctcgaatttgtactcgggaggagttcacaagaaaagtaaggtccaacgccgcaatcggcgctgtgtttgtcgacgaaaatcagtggaacagcgccaaggaggcagtggaagatgagcgcttctgggacctggttcaccgtgaacgggagttgcataaacaggggaagtgcgcaacctgcgtgtacaatatgatgggaaaaagagagaagaagctgggcgaatttggtaaagctaaggggtctagggccatctggtacatgtggctcggagcgcgcttccttgagttcgaagcactgggctttatgaacgaggatcactggttctcacgagagaatagtttatccggcgtcgaaggggagggactgcataaattgggttatattctccgggacataagcaagatcccaggcgggaacatgtacgccgatgacacagctggatgggatactagaattaccgaagacgatctgcaaaatgaggccaaaatcacggacattatggaacccgagcacgcactacttgctacctctatctttaagctgacatatcagaacaaagtggtaagggttcagcgccctgccaagaatggcactgtgatggatgtcatatcgagacgggaccagaggggttcagggcaagtgggaacctacggcctcaacacattcactaacatggaggtgcagctgatccgtcagatggaaagcgagggcatatttttcccatccgaattggagagtcccaatttagctgaacgagtcctggattggctcgagaagcacggggccgagcgccttaaaagaatggcaatctctggagacgactgtgttgtgaagccgattgatgaccggtttgcgaccgccctgatcgctctaaacgatatgggtaaagtaaggaaggacatacctcagtgggaacccagcaaaggctggaatgattggcaacaggtgccattctgctcccatcactttcatcagctgattatgaaggacgggcgcgagatcgtcgtgccttgtagaaaccaggatgaactcgttggacgggccagggtgtcacaaggcgcaggttggagtttgcgagagacggcttgcctggggaagtcttatgcccagatgtggcagcttatgtacttccaccgtagagacctgcgcctcgcagccaatgcgatctgtagcgctgtccccgtggattgggtaccaacatcccggaccacttggtcaattcacgcccatcaccaatggatgacaaccgaagacatgttaagcgtttggaacagggtgtggatagaggagaatccctggatggaagataaaactcatgtctcttcctgggaggaagtgccttatctgggaaagagagaggaccagtggtgcggcagtttgatcggcctgaccgcacgcgccacatgggctacgaacattcaggttgccatcaatcaggtgcggaggctcattgggaacgagaattaccttgactacatgaccagcatgaaacgatttaagaacgaatcggatccagagggagcactgtggtga

SEQ ID NO: 14259 - RNA, 9879 nt, synthetic construct
  misc_feature 1..9879: note = derived and/or modified CDS sequence (opt3) from DENV-1__AF311957__SS-prME
  source 1..9879: mol_type = other RNA
agcgtgaccatgctgctcatgcttctgcccacagcattggctttccacttaactacgagaggaggggagcctcatatgatcgtctccaagcaagaaaggggaaaatctctgctatttaagacctcagccggtgttaacatgtgcacactcattgcaatggacctgggcgagctttgtgaagatactatgacctacaaatgcccacggataacagaggcggaaccggacgatgtggactgttggtgcaatgctaccgatacttgggtaacatatgggacctgtagtcaaacgggagagcaccgccgagacaagcgtagcgtggccctggcaccccatgtcggcttgggtctcgagactagaaccgaaacatggatgtcctctgagggggcctggaaacagatccagaaggtggaaacttgggctctgaggcaccctggattcaccgttattgcactgtttctcgcccatgctatcggcacatcgattacccagaagggcatcatattcatcttactgatgcttgtgacgccatcaatggccatgcggtgcgtcgggattggaaaccgcgattttgtggagggtttgagcggcgcgacttgggtagacgttgtgctggagcacgggagttgtgtcacaaccatggccaagaataagcccactctagatatcgaactcctgaaaacagaggtgaccaaccctgccgtgcttagaaagctgtgcattgaagctaaaatctccaatacgaccacagactctaggtgtccaactcaaggagaggccaccttggtcgaagaacaagatgcaaacttcgtttgccggcgcacatttgtggaccgaggctggggtaatgggtgtggactcttcggcaagggcagcctgttaacttgcgctaagtttaaatgcgtaaccaagctggaggggaaaatagtgcagtacgaaaacctcaagtattccgtcattgtgacagttcacaccggagatcagcatcaagtgggtaatgagactacggaacacggcacaatcgccaccattactccccaggcgcctacctcagagatccagcttacagactacggggccctgaccttggactgtagtccaagaactggactagatttcaacgaaatggtcctgctcacaatgaaagaaaagagctggctggtgcataaacagtggtttcttgacctgccgttgccctggacgtctggcgcatccacctcacaagagacttggaataggcaggatctcctggtaacattcaagaccgctcacgccaagaaacaggaagttgtggtcttaggtagccaagagggggctatgcacacagccctgactggcgcaaccgaaatccagacgagtggaaccacaactatttttgccggccatctaaagtgccggctcaaaatggacaagctgacccttaaagggacatcttatgtgatgtgtactggatccttcaagttggagaaggaagtcgctgagacccagcacggtacggtgctggttcaggtgaaatacgagggcacagatgcgccttgcaagataccattcagcacccaagacgaaaaaggggtaactcagaacggacgtctcatcacagcaaatcccattgtcaccgataaggagaaacctgtgaacatcgaaactgagccaccctttggcgagtcgtatatagttgtgggtgccggggaaaaggctctgaaactttcttggttcaaaaagggctcctcaattggaaaaatgtttgaggccaccgcacgcggcgccagaaggatggctatcctgggggacacagcctgggatttcggaagtatcggtggcgtctttacgagcgtggggaagttggtacatcaggtgttcggaaccgcatacggcgttctcttttccggtgtctcttggactatgaaaattgggatcggcattctgttaacatggctgggactaaatagccggtcaaccagtctctccatgacatgtatagcggtgggcatggtgactctgtaccttggggtcatggttcaggctgacagcggatgcgtgatcaactggaagggccgagaattgaagtgtggttctgggattttcgtgaccaacgaggtacacacgtggacagaacaatataaatttcaggccgattcaccgaagcgcctgagtgcagccatcgggcgagcttgggaggagggcgtctgcggtatcaggagcgccacccggctcgaaaatattatgtggaaacagatatccaacgagctgaatcatatcttactggaaaacgacattaagttcactgtggttgtgggcaatgcaaacgggatccttgctcagggcaaaaagatgattcgccctcaacccatggagcacaaatactcttggaagtcgtggggcaaggccaaaatcataggggcggacatccagaataccacatttattatcgatggaccagacactcctgaatgtcccgatgagcagagagcctggaacatttgggaggtcgaagactatggcttcggtatctttaccacaaatatatggttgaagctcagggatagctacacgcagatgtgcgaccaccgtctgatgtccgctgcaattaaagattcaaaggccgtgcatgctgacatggggtattggatcgagagtgagaaaaatgagacctggaagctagcccgggcatctttcattgaagttaagacttgtatctggccaaaaagccacacactgtggtccaatggagtgctcgagtcagagatgataatccccaagatgtacggcggtcctattagccaacataactatcgaccaggctacttcacccagactgcggggccgtggcacctgggaaaacttgaattggattttgacctgtgcgagggcacaaccgtagtcgtggatgaacactgcgggtctagaggaccctccttaaggacgactaccgtgacaggcaagatcattcatgagtggtgttgccgcagttgtaccctccctccactgcggttcagaggtgaggacgggtgctggtacggaatggaaatcaggcccgtcaaagagaaggaagagaatcttgttcgcagcatggtgtctgccggctccggtgaagtagattcatttagtctgggcatattgtgtgtgagcattatgatcgaggaggtcatgcgatcgcggtggtcccgtaagatgctcatgactgggacactggctgtgttcctactgctcatcatgggacagctgacctggaacgaccttattagattgtgcatcatggttggcgccaatgcatctgacaaaatggggatgggaacaacttatctggctttaatggccacctttaagatgaggcctatgttcgcagtgggcctcctgtttcgccggcttacgagcagagaagtcctgctactcacaattggtctgtcattggtggccagtgttgagctgccaaactccttagaggaactcggggatggactggctatgggcataatgatgcttaaactgttgaccgagttccaaccccaccagctctggactaccctgctatctctgacatttatcaagactacccttagcctcgactacgcgtggaaaacgacagccaccgtgctgtccattgtctcattgttcccgctgtgtttaagcactacaagtcagaagaccacttggctccctgtactgcttggctcttttgggtgcaagccactgacaatgttcttgatcaccgagaacgagatttggggaaggaaatcctggcccctcaatgaaggtatcatggcaataggcatcgtgagcattctgctatcgtcactgcttaagaacgatgttcctctcgctgggcccctgatcgccggaggcatgttgattgcctgttatgtgatctctggtagttccgctgacttaagcctggagaaagcagccgaagtctcttgggaggaagaggcggagcatagcgggacgtcccacaatatactcgtggaagtacaggatgacggaactatgaagattaaagatgaggaacgagacgataccctgacaatccttctgaaggctaccttgctagccgtgtcaggcgtctacccaatgagtatccctgcaacactgtttgtttggtatttctggcagaaaaagaagcagcgcagcggcgtgctctgggacactccctctccaccggaggtggagcgggccgtcctggatgacgggatttacagaatacttcagaggggattactgggtcgttcccaggtgggcgttggggtattccaagatggagtgtttcataccatgtggcacgtcacgcgcggcgctgtgctcatgtatcagggtaaacggttggaaccttcatgggcaagtgttaagaaagacctgatcagctacgggggaggctggagattccagggctcctggaacacaggggaggaagtgcaggtcattgccgtggagcccggaaagaatcccaaaaacgtacaaactacccccggtacatttaagacccctgaaggcgaggtcggggcgatcgctctcgacttcaagccaggaacttctggctcgcccattgtgaatagggagggtaaaatcgttgggctgtacggaaacggcgtggtcaccacaagcggcacgtatgtgtcagccatagcacaggccaaggcttcccaggaagggcctcttccggagatcgaagatgaggtttttaaaaagcgaaatctgactattatggacttgcacccaggaagtggtaaaacccggcgctacctacccgccatcgtgagagaagcaattaagaggaagctgcggacactcatcttagctcctacccgagtcgtggcctctgagatggcggaggccctgaaaggcatgccaataagatatcaaactacagcagtaaagagcgaacataccgggcgcgagattgtggatcttatgtgccacgctacgttcactatgaggctgctctcccccgttcgtgtccctaactacaatatgatcatcatggacgaagcccattttacagatccggcttcaattgcagcccggggatatatctctaccagagtgggcatgggtgaggccgctgcgatattcatgaccgcaactcccccagggagcgtggaagcctttcctcagagtaacgctgtcattcaggacgaggagagggatatccccgaacgctcctggaatagcggatacgactggattacagatttcccaggcaaaaccgtatggtttgtgccttctatcaagtcaggcaacgacatagccaattgtttgcggaaaaacgggaagagagttattcagctgtccagaaagacattcgatactgagtatcagaaaacgaagaacaatgactgggactacgtggtcaccacagatatcagtgaaatgggagcaaacttcagggccgaccgcgtgatcgatccccgtagatgcctcaaaccagttattctgaaggacggtccggagcgggtgatccttgctggccctatgcccgtcactgtggcgagcgccgcacagaggcgcgggcgaattggaagaaatcagaacaaagagggcgatcagtacgtatatatgggtcaaccactaaataacgacgaagatcacgctcattggaccgaggccaagatgctgttggacaatataaacacacccgaagggatcattcctgcattatttgagccagaacgggagaagtcggccgctatcgatggcgagtacaggctgcgcggagaagccagaaaaaccttcgtggagctcatgaggcggggcgacctgcccgtttggctttcttataaggtcgcgtccgaagggtttcagtacagcgatcgtcgctggtgcttcgacggagagcgaaataaccaggtgctggaagagaatatggatgtggagatctggactaaagaaggtgagagaaagaaactcaggcctcggtggttggacgcacgcacgtattcagacccgctggccctaagagaatttaaggagttcgctgccggcaggcggagtgtctcttccgatctgattctcgaaatagggaaacttccacagcacctgaccttacgagctcaaaacgcattggacaatctggttatgctccacaacagcgagcagggaggcaaggcctacagacatgctatggaggaactgcccgatacaatcgagactcttatgctgctcgccttgattgcagtgctgaccggtggggtaacattatttttcctatcaggcaagggactgggcaaaaccagtatcgggctcctttgtgtgactgcgagctccgccctgttgtggatggcttctgtcgaacctcactggattgccgcaagcatcatactggagtttttcctcatggtgctgcttatccccgagccagaccgccagaggacacctcaggataatcaactcgcttatgttgtgattggactgttgtttatgatcctgacggtcgccgcaaacgaaatgggtttactagagaccactaagaaagacctgggcattgggcatgtagccgctgaaaaccaccagcacgcgacaatgctcgatgtggaccttcatcccgcctccgcatggaccctgtacgctgttgccaccacagtgatcactccaatgatgcggcacacgatagagaataccacagccaacatttcattgactgcaatcgctaatcaggccgcgattctgatgggactcgataagggctggcctatctctaaaatggacctgggtgtcccgcttttagctctggggtgctacagtcaagtgaaccccctcaccttgacagccgcagtcctgatgctagtggcccattatgctataatcggcccaggactgcaggcaaaggccacccgtgaagcgcagaagagaactgctgccggcattatgaaaaatcctacggttgatgggatcgtggcaattgacctcgatcccgtagtgtacgacgccaagttcgagaaacagcttggacaaatcatgctgttgatactgtgtacatcgcagattctcctgatgaggaccacttgggctttatgcgagagcatcacccttgccacaggcccactgactaccctctgggaaggttcccctgggaagttttggaacacaacgatcgcagtctctatggctaatattttccgcggatcatatctagccggcgcgggtctggccttcagcttgatgaaatccctgggcgggggacggcgaggcaccggggcacagggagagactctcggcgaaaagtggaagagacagcttaaccaactgagtaaatctgagtttaatacatacaagaggagcggtatcatggaagttgaccgctcagaggctaaagaggggttgaagcggggagaaaccactaaacacgccgtgtccagaggcacagcaaagctgcgttggttcgtcgagaggaacctcgtgaagcccgaaggtaaagtaatagatttaggctgtgggcggggaggctggagttattactgcgctgggctgaagaaagtgaccgaggttaagggatatacgaaaggcggtccggggcatgaagaaccaattcctatggccacctacggatggaatcttgtgaagctgcacagcggcaaagacgtctttttcatcccaccagagaagtgtgatacactactctgcgacattggcgaatcttcccccaaccctactatcgaggaagggcgcaccctgcgagtgttgaagatggtcgagccgtggctgagaggaaatcagttttgtataaaaatcctcaacccctacatgccatcagtggttgagacacttgaacagatgcagaggaagcacggtggcatgctggtacggaatcctttaagccgcaactcgactcatgagatgtattgggtgtcttgcgggaccggaaatattgtcagtgccgtgaacatgacatccagaatgctgttgaacaggttcaccatggcgcaccgaaaacccacttacgaacgggatgttgacctcggcgctggtacgcgtcatgtggcagtcgagcctgaagtggccaatctggatatcattgggcaaagaatcgagaacattaagaatgagcacaaaagcacatggcactatgacgaagataacccatacaagacctgggcttatcatggatcatacgaggtaaagccctccggctctgccagcagtatggtgaatggcgttgtccgcctacttactaaaccttgggacgtgatcccaatggtgacccagatagcaatgacagatacgaccccctttgggcagcaaagggtcttcaaggaaaaagttgacactcggacaccgagagccaagcgcggaaccgctcagattatggaggtgactgcgaaatggctgtggggttttctctccaggaacaagaagcctcgaatctgtacacgggaagagttcaccagaaaagtaaggagcaatgccgcaatcggcgctgtgtttgtcgacgagaaccagtggaactctgccaaggaagcagtggaggatgaacgcttctgggacctggttcaccgtgagcgggaattgcataaacaggggaagtgcgccacatgcgtgtataacatgatgggaaaaagagagaagaagctgggcgagtttggtaaagctaaggggtcaagggccatttggtacatgtggctcggagcgcgcttccttgagttcgaggcactgggctttatgaatgaagatcactggttcagtcgagagaactccttaagcggcgtcgagggggaaggactgcataaattgggttacatactccgggacatctctaagattccaggcgggaatatgtatgccgatgacactgctggatgggataccagaatcacggaggacgatctgcaaaacgaagccaaaattaccgacatcatggagcccgaacacgcactacttgctacatcgatatttaagctgacttaccagaataaagtggtaagggttcagcgccctgccaagaacggcaccgtgatggatgtcatctcaagacgggaccagaggggtagcgggcaagtgggaacatatggcctcaacactttcaccaatatggaggtgcagctgattcgtcagatggagtccgaaggcatctttttcccaagtgagttggaatctcccaacttagctgagcgagtcctggattggctcgaaaagcacggggccgagcgccttaaaagaatggcaattagcggagacgactgtgttgtgaagccgatcgatgaccggtttgcgacggccctgatagctctaaatgatatgggtaaagtaaggaaggacattcctcagtgggagccctccaaaggctggaacgattggcaacaggtgccattctgctcacatcactttcatcagctgatcatgaaggacgggcgcgaaatcgtcgtgccttgtagaaatcaggatgagctcgttggacgggccagggtgagtcaaggcgcaggttggtctttgcgagaaacagcttgcctgggaaagagctacgcccagatgtggcagcttatgtatttccaccgtagagacctgcgcctcgcagccaacgcgatttgttccgctgtccccgtggattgggtaccaacctcacggactacatggagcatacacgcccatcaccaatggatgaccactgaggacatgttatctgtttggaatagggtgtggatcgaagagaacccctggatggaggataaaacccatgtctccagttgggaagaggtgccttacctgggaaagagagaagaccagtggtgcggcagcttgattggcctgacagcacgcgccacgtgggctaccaatatccaggttgccattaaccaggtgcggaggctcatcgggaatgagaactatcttgactacatgacttcgatgaaacgatttaagaatgagtccgatccagaaggagcactgtggtga

SEQ ID NO: 14260 - RNA, 9879 nt, synthetic construct
  misc_feature 1..9879: note = derived and/or modified CDS sequence (opt3) from DENV-1__EU280167__SS-prME
  source 1..9879: mol_type = other RNA
agcgtgaccatgctgctcactcttatgcccactgccctggctttccacttgacgaccagaggaggggaacctcatatgatcgtctccaagcaagaaagaggaaagtctttactgtttaagacatcagccggtgttaatatgtgcactctaattgccatggacctcggcgagctgtgtgaagataccgtgacatacaagtgcccacggataaccgaggcggaaccggacgatgtagactgttggtgcaatgctactgatacatgggtgacctatgggacgtgtagtcaaactggagagcaccgccgagacatccgtagcgtcgcccttgcaccccatgtgggcctgggtttggagaccagaacagaaacttggatgtcctctgagggggcctggaagcagattcagagggttgatacctgcgtgctccggcaccctggattcacagtcatcgctctgtttctggcacatgccattggcacctcgatctcacagaaaggcataatcttcattctcttaatgctggtgacgccaagcatgactatgcgctgtgtagggatcggaagtagagactttgttgaaggtctttccggcgctacatgggtggatgtcgtgttggagcacgggtcttgcgtgaccagcatggccaaggacaagcccactctggatattgagctactcaaaacagaagtccctaacccagcggttctgaggaaactttgtatcgaggcaaaaatatccaataccacgaccgactcacggtgccccacacaaggagaagccactctggtggaggaacaggatgctaacttcgtatgtcgccgaacctttgtggacagaggctggggtaatgggtgcggattgttcggcaagggcagtctcctgacatgcgacaaatttaagtgtgtcactaagttagaggggaaaattatccagtacgagaacttcaagtatagcgtgattgttaccgtgcacacaggagatcagcatcaagtcggtaatgaatctaccgagcacggcactacggccacaatcacccctcaggcaccaactaccgaaatccagctgacagactacggggctctcacccttgattgctccccgaggactggactggactttaacgagatggtgttgctaacaatgaaagaaaagtcatggctggtacataaacagtggttcctcgatctgccccttccttggacgagcggcgccagtacctctcgggagacttggaatcgtcaagacctgttggttacatttaagaccgcgcacgccaaaaagcaggaggtggtcgtgctcggttcccaggaaggggcaatgcacacagctctgactggcgccaccgagattcaaacgagcggaaccacaactatattcgctggccatttaaagtgtcgcctgaaaatggataagctaaccctcaaagggatgtcgtatgtcatgtgcacaggatctttcaagctggaaaaagaggtggccgaaactcagcacggtaccgttcttgtgcagatcaagtacgagggcacggacgcaccatgtaagattcccttttccacacaggatgagaaaggggtaacccaaaacggaagattgatcactgccaatcctatagtcacagacaaggaaaaaccagtgaacattgaggctgaacccccgttcggcgagtcatatatcgttatcggtgtgggggagaaggcgctgaaactcagttggtttaagaagggcagctccattggaaaaatgttcgaagcaaccgccaggggcgctcggcgaatggccatcctgggggatactgcatgggactttggatctattggtggcgtcttcaccagcgtggggaaacttgtacatcagatatttggaacagcctacggcgtgctgttctcaggtgttagttggacgatgaaaatcgggattggcgtcttgctcacctggctgggattaaattcccgcagcacttctctgtcaatgacatgcatcgctgtgggcctagtgaccctctacctgggggtcatggttcaggccgacagtggatgtgtgatcaactggaagggcagaggtcttaaatgcgggagcggaatttttgtgacaaatgaggtacacacttggaccggccagtataagttccaagcagattcccctaagggtttgtctgcggctataggcaaagcctgggaagagggggtctgtggaatcaggtcggcaacgcggctggaaaacattatgtggaagcagatcagcaacgagctcaatcatattctgttagagaacgacatgaaatttacagtggttgtgggcgatgtcgccgggatcctggctcagggaaagaaaatgatacgcccccagccaatggaacacaagtactcctggaaaaattggggcaaggccaagatcattggtgcagacgtgcaaaactcaaccttcatcattgatgggcctaatactcccgagtgcagtgacgatcagagagcttggaacatctgggaagttgaggactatggatttggcatattcaccacaaatatttggcttaaattgagggattcttacactcaggtgtgtgaccaccgtctcatgagcgccgcgatcaaggattccaaagccgtacatgctgacatgggttattggattgaatcagagaagaacgagacctggaaactggcacgggccagcttcatcgaagtcaagacatgcatatggccaaagtctcacacgctatggtccaatggcgtgctggagagtgaaatgatcattcccaaaatctacgggggacctattagccagcataactatcgaccaggctactttacccaaactgctgggccgtggcacctcggaaagctggagcttgatttcgacttgtgcgaaggcacaaccgtggtcgttgacgagcactgtggtaatagagggccctctctgggaactacaaccgtgacgggcaaaatcatacatgagtggtgctgtaggtcctgcactttacctccactccgctttcggggtgaagatggctgttggtacgggatggagattagacccgtaaaggaaaaagaggagaacctggtgaagtcaatggtcagtgccggaagcggcgaagtggactcgttctcccttgggctgttgtgcatctctatcatgattgaggaagttatgaggagccgctggtcacgaaagatgctcatgaccggaacactggcagtgtttttcctactgatcatgggccagctcacctggaatgatctgattcggctttgtataatggtcggtgcgaacgccagtgaccgtatggggatgggaactacatatttggctctgatggccacctttaaaatgagacctatgttcgcagtgggcttactctttaggcgcctgacatcccgggaggttcttctgctaactatcggcctctctctggtggctagcgtcgaattgccaaattccctggaggagttaggggatggactcgccatgggtattatgatcctgaaacttctgaccgacttcagatcacaccagttgtgggcaacgctcctgagcatgacatttattaaaaccgccttcagtctacattacgcttggaagactatggcgatggtactgtctatcgtgtccctttttcccctctgcctgtataccacaagccagaagactacctggttgccggttctgttaggctcgctcgggtgtaagcctctgacgatgttccttatagccgaaaacaagatctggggaaggaaatcatggccactgaacgagggcattatggcagtgggtatcgtctctattttgctcagttccctgctaaagaatgatgtgcccctggctgggcctcttatcgccggaggcatgctcatagcctgctacgtaattagcggctctagcgctgacctgtccttggaaaaagcagccgaggtgtcatgggaagaggaggcggaacacagtggggctagccataacatcttagtcgaggttcaggatgacggaacaatgaagatcaaagatgaagaacgagacgataccctgactattctcctgaaggccacacttctggcagtgtctggtgtgtatcccttgtccataccagccaccctattcgtctggtgtttttggcagaaaaagaagcagcgctcaggcgtgctgtgggacactcctagtcccccaaaagttgaacgggctgtactcgacgatgggatctacagaattatgcaaaggggactgcttggccgtagccaggtgggtgtcggggtgttccaggagaatgtttttcacacaatgtggcacgtgacccgcggagcagtcttaatgtatcagggcaagcggctggagccgtcctgggcctctgtgaaaaaggacctcatctcgtacggcgggggatggagattgcaaggtagctggaacacgggcgaagaggtacaggtcattgcggtggaacctgggaaaaatcccaagaacgttcagactgctccaggaaccttcaagacacccgagggcgaggtgggtgccatcgcactggattttaaacctgggacctcaggatccccaatagtcaatagggaaggcaagatcgtgggcctctacgggaacggagttgtgacaacaagtggtacctatgtctctgccattgctcaggccaaagcaagccaagagggccccctgcctgaaatcgaggacgaagtgttccgaaagcggaatcttacgattatggatctgcatccggggtccggaaaaacacgcagatacttgccagctatcgtaagggaggccataaagcggaagatgcgaactctaattctggcgcccaccagagtggttgcctcagagatggcagaagctctcaaaggcatgcctatccgctatcagacaaccgccgtcaagtctgagcacactggtaaagaaatcgtggacttaatgtgccatgctacctttacaatgaggctgcttagcccagtgcgtgtccccaactacaatatgattatcatggatgaggcacacttcacggaccctagttccatagccgcccgggggtatattagcactagagtaggaatgggcgaagctgcggcaatctttatgaccgccacaccgcccggctctgtggaggctttcccacagtcaaacgccgttattcaagatgaggaaagggacatccctgagcgctcctggaatagtgggtacgaatggataaccgattttcccggaaagactgtgtggttcgtcccaagcattaaagcaggtaacgacatcacaaattgcctgcgaaagaacggcaagagagtgatccagctctcgcggaaaaccttcgacacggagtatcagaagactaaaaacaatgattgggactacgttgtgacaaccgatatttctgaaatgggggccaactttagggctgaccgcgtcatggatcctcgtagatgtttgaagcccgtgatcctgaaagacggaccagagcgggtaattctcgcgggcccgatgcctgtgaccgttgcctccgcagctcagaggcgcggtcgaatagggagaaatcataacaaggagggcgatcaatacatctatatgggacagcccctgactaatgacgaagatcacgcccactggacagaggcaaagatgcttctagacaacattaataccccagaaggcatcatccccgccctgttcgagcctgagcgggaaaagagcgctgccattgatggggagtacaggttgcgcggagaggcgagaaagacatttgtcgagttaatgaggcggggtgacctgccagtgtggctctcacataaagtggcaagtgaaggcttccagtattctgatcgtcgctggtgctttgacggggagcgaaacaatcaggtcctggaggaaaacatggacgttgagatatggactaaggaaggagagaggaagaaacttaggccccggtggctggatgcccgcacgtactccgaccctctcgctttgagagagttcaaagagtttgccgctggcaggcggagcgtgtcaggtgatctgatcctagagattgggaagctgccgcaacacctcacccagcgagcacagaatgcccttgacaacctggtaatgttacataatagtgaacagggcggcagagcttatcgccacgccatggaggaattgccagatacaatcgagactctgatgctcctggcacttattgcggtgctgaccggcggggtcacactcttctttttgagcggaaagggtctgggcaaaacctccatcgggttactatgtgtgatggcctctagcgttctgctctggatggcttccgtggaaccccactggatagccgcatcaatcattcttgagttctttctgatggtcttgctgatccctgagcccgacaggcaacggactccacaggataaccagctcgcttacgtagtgattggactgcttttcatgatcctcacggttgccgcaaatgaaatgggcctgttggagaccacaaagaaagacctgggtatagggcatgtggccgtcgaaaaccaccatcacgctgcgatgttagatgtggacctacatcctgcctctgcatggactctgtatgctgtcgccaccacaattatcacccccatgatgcgtcacactattgagaacacaacggccaatatcagtctcaccgcaatagctaaccaggccgcgatccttatgggcctggataagggatggccaatttcgaaaatggacatcggcgtgcctttgctggctctcgggtgctacagccaagttaatccgctgactcttacagccgcagtgttaatgctggtagcccactacgctattatcggacccggcctccaggcaaaggccaccagagaggcgcagaagaggaccgctgccggtataatgaaaaacccaacaattgatgggatcgtggcaatcgacttggaccctgtcgtttatgatgccaagtttgaaaaacaactgggacagattatgctactgatcctctgtacttcccagatacttctgatgcgcacgacctgggctttgtgcgagtctattacactggccactggccccctcaccacactgtgggaaggttcaccaggcaagttctggaataccactatcgcagtgagcatggctaacattttccgggggtcctacttagccggagcgggccttgcctttagtctgatgaaatctctcgggggaggccgaagaggtacgggggcacagggagagacactaggcgaaaagtggaagaggcaactgaatcagttgagcaaatcagagttcaacacctataagcgctccggtatcatggaggtcgaccggagtgaagctaaagagggcctgaagagaggggaaactaccaaacatgccgtgagccgtggaacagcaaagctcaggtggtttgtagagcggaatcttgtgaagcctgaaggcaaagttatagatctggggtgtggacgcggcggttggtcttactattgcgctgggttgaagaaagtgactgaggtcaagggatacaccaaaggcggccccgggcacgaggaaccgatcccaatggccacatatggatggaacctggtgaagctccattccggtaaagacgtcttctttattcctcccgagaagtgtgatacgttactgtgcgacatcggcgaatcaagcccaaatcccaccattgaggaagggcgaactcttagagtgctgaagatggttgagccttggctaaggggaaaccagttctgtatcaaaattctcaatccgtacatgccctcggtagtggagacactggaacagatgcaacggaagcacggcggtatgttggtccgcaacccactgtctagaaatagtacccacgagatgtactgggtgtcctgcgggactggaaacatcgttagcgccgtgaatatgacatcaaggatgctccttaaccgatttaccatggcgcatcggaaacctacgtatgaacgtgatgtcgacctgggcgctggcaccagacacgtggcagtagagcccgaggtggccaacttagatataattgggcagcgcatcgaaaatatcaagcatgagcacaaatccacatggcattacgacgaagataacccttataagacttgggcttaccacggatcttatgaggttaagccaagcggtagtgcctccagcatggtcaatggcgtggtgaaactgttgaccaagccctgggacgtcattcctatggttacacagatagcaatgactgacaccacaccattcgggcagcaaagggtgtttaaagaaaaggtagatacccggactcccaaagccaagagaggaacggctcagatcatggtggtcacagcgcgctggctctggtctttcctgtcaaggaacaagaaaccgcgaatttgcacccgggaggagtttactagaaaggtgaggagtaatgccgcaatcggcgctgttttcgtggacgaaaaccagtggaactccgccaaagaggcagtcgaagatgaccgcttttgggatctagtgcaccgtgagcgggaacttcataagcaaggtaaatgtgcaacctgcgtatacaacacaatggggaagagagagaagaaactgggagagttcggcaaggctaaaggcagcagggccatttggtatatgtggctcggggcgcgcttcctggaatttgaggcattgggattcatgaatgaagaccactggttttctcgagagaactcgctgtcaggtgttgaaggcgaggggctccataaacttggatacatcctgcgggatataagcaaaatccctggcggtaatatgtacgccgacgatacggctgggtgggacaccagaattactgagggagatttacagaacgaagccaagatcacagacattatggagccagaacacgcactgttggctaaatccatcttcaagctcacctatcagaataaggtggtcagggtgcagcgccccgccaaaaacggcactgtgatggatgtcataagtagacgggaccaaaggggctctgggcaggttggaacatacggtctgaatacctttacaaacatggaggctcagctaattcgtcagatggagagcgaaggcatcttctcccctaacgagcttgaaactccaaatctggccgagcgagtgctcgactggctggaaaagtatggggtagagcgcttgaaaagaatggcaatctcaggagatgactgtgtggtcaagcccattgatgaccggtttgcgaccgccttaacggctctgaacgatatgggcaaagtgaggaaggacataccgcaatgggagcctagtaagggttggaatgattggcagcaggttcccttctgctctcaccattttcaccagctcatcatgaaagacgggcgcgaaattgtggtcccatgtagaaaccaagatgagcttgtgggacgggccagggtaagccagggcgcaggctggtccctgcgagaaaccgcttgcctagggaagtcatacgcccagatgtggcagctgatgtatttccatcgtagagacctccgcttggcagccaatgcgatctgtagcgctgttcctgtggattgggtccccacatctcggactacctggtccattcacgcccatcaccaatggatgacaactgaggacatgctgagtgtgtggaacagggtttggatcgaagagaatccatggatggaggacaaaaccagaataagctcgtgggaagatgtgccctaccttggagagcgcgaagaccagtggtgcggttccctgatcggcctcacggcacgggccacatgggctaccaacgtccaggtggccattaatcaagtaaggcgattaatcgggaacgagaattattctgattacatgacttcaatgaagagatttaaaaacaagagcgaacctgagggagcactgtggtga

SEQ ID NO: 14261 - RNA, 9876 nt, synthetic construct
  misc_feature 1..9876: note = derived and/or modified CDS sequence (opt3) from DENV-2__AJ968413__SS-prME
  source 1..9876: mol_type = other RNA
accgccggcatgatcattatgctgatacccacagtgatggctttccacctcactacgagaaacggggagcctcatatgatcgtcagcaggcaggaaaagggaaaatcccttctgtttaagaccgaggacggtgttaatatgtgcacattgatggcaatggatttaggcgaactgtgtgaggacactattacctacaaatgcccactactccggcaaaacgaaccggaggatatcgactgttggtgcaattctacatcaacctgggtgacttatgggacatgtaccacgactggagagcaccgccgagaaaagcgtagtgtagccctggtgccccatgtcggcatgggtcttgagaccagaacagaaacttggatgagctccgagggggcgtggaaacacgctcagaggattgagacctggatcctgcggcatcctggattcacattgatggccgcaatactcgcctacaccatcggcacgactcactttcagcgcgctctgattttcatcctgctcacagcagtggccccatctatgaccatgagatgcattggcatctcgaacagggattttgttgaaggggtgtcaggaggtagctgggtcgacatagtgttagagcacggcagttgtgtaactacaatggctaagaataagcccaccctggatttcgaacttattaaaacggaggccaagcagttggcgaccctgcggaaatattgcatcgaagcaaagctaacaaacactaccacagagtcccgctgtcctactcaaggggagccatctctcaatgaagagcaggacaaacgatttgtttgcaagcatagcatggtggatagaggatggggcaacggttgtgggctgttcggaaagggcggcattgtcacctgcgccatgtttacatgcaaaaagaatatggaagggaaaatcgtgcagcccgagaaccttgaatacaccatcgtgattactcctcactccggagaggagcatgctgtcggtaatgacacgggcaagcacgggaaagaaataaagatcacaccacagtcaagtattaccgaggccgaactgactggatatggcaccgttacaatggagtgtagcccgaggaccggtttggatttcaacgaaatggtgctcctgcaaatggagaataaagcatggttagtacaccggcagtggtttctggacctcccccttccttggctgccaggggctgatactcagggctctaactggatccagaaggagacattggtgacgttcaagaatccccatgccaaaaagcaagacgtcgtggttctaggatcccaggaaggcgcgatgcacaccgccctgactggggcaacagagatacagatgtcaagcggaaacctcctgtttaccggtcatcttaaatgccgtctgcgcatggacaagttgcaactcaaaggcatgagttactctatgtgtacagggaagttcaaggtggtcaaagaaattgctgagactcagcacggaaccatcgtggtaagagttcagtatgagggcgatggttccccttgcaagatcccattcgaaattatggacctggagaaaaggcatgtgttagggcggctgatcacggtcaaccccattgtgaccgaaaaggatagcccggtcaatatagaggccgaacctccctttggcgactcgtacgtgatcattggagttgagccaggccagctaaaactcaactggttcaagaaggggtcttccatcggacaaatgtttgagacaactatgcgaggtgctaaacgcatggccatcctgggcgataccgcatgggacttcgggtcacttggaggcgtgtttacaagtattggtaaggccttgcaccaggtattcggggctatatacggcgcggcatttagcggagtctcctggactatgaaaatcctgattggcgtgatcattacctggatcgggatgaattctagaagcacgtcactcagtgtttccctggtgcttgtcggagtggtaacactgtatttgggcgtggttgtccaggccgatagcggttgtgtggtgtcttggaagaacaaagaactcaagtgcgggtcaggaatattcatcaccgacaatgtccacacttggacagagcagtacaagtttcaacctgaaagtcccagcaaactggcttccgccattcagaaggcacatcaggagggcatctgtggtattaggtctgttacccggttagaaaacctgatgtggaaacagatcactccagagctaaatcacatactctcggagaacgaagtgaagctgaccattatgacaggcgatatcaaagggattatgcatgccggaaagcgcagccttagaccccaacctacggagttgaggtattcctggaaaacctggggcaaggctaagatcctgtcaactgaaagtcacaatcagacattcctcatagacgggccagagaccgccgaatgcccgaacacaaatcgtgcatggaactctctggaggtggaggattacggatttggcgtattcactaccaatatctggttaaaactgcgggaaaagcaggacgtcttttgtgacagcaaacttatgtccgcggctattaaggataaccgagccgtgcacgcagacatgggttattggatcgagtcagccttgaatgatacgtggaaaattgaaaaggctagcttcatcgaggttaagtcttgccattggcccaaatcccacacactctggagtaacggggtgctggagagcgaaatgataattcctaagaacttcgccggaccagtctctcagcataattacagacccggctatcacacccaaactgcaggtccttggcatctaggcaaactggagatggactttgatttctgtgaagggaccacagtggttgtgactgaggactgcggaaacaggggcccatccctccgcaccacaacggcttcagggaagctgatcaccgaatggtgctgtcggagttgcactcttcccccgttgagatacaggggagaggatggctgttggtacggtatggagatccgccctctgaaagaaaaggaggaaaatttagtaaacagcctcgtcacagccgggcacggacagattgacaatttttcgctgggcgtgcttggtatggcgctgttcttggaggaaatgctccgaacccgggtgggcactaagcacgccacactgctagtcgctgtttcctttgtgaccctgatcacggggaacatgtctttccgtgatctcggaagagtaatggtgatggtcggcgcaactatgaccgacgatattgggatgggagtgacatatctggcccttttggctgcctttaaagttaggccaaccttcgcagcgggcctgttactccgcaagctgactagcaaagagcttatgatgacaaccataggtgtggtcctgctatcacagagtacaatccccgagactattctcgaactgaccgacgccttggctctggggatgatggtgttaaagatcgttcggaaaatggagagataccaactcgccgtgacgattacagcaatcctgtgcgtccctaatgctgtaatacttcagaacgcctggaaggtgtcctgtaccatcctggcagttgtgtctgtcagccccttgctcctgacttcctcacagcagaaggccgattggattccactagctctgaccatcaaaggacttaatcctacagcgatttttctcactaccctgagcaggacgagtaagaaacgatcttggcccttgaacgaagccatcatggcagtgggcatggtatccatactggctagctcgttactcaagaatgacattccaatgacaggcccgctggtggccgggggacttctgaccgtctgctatgttttgactggtcgctcagccgacctcgagctggaaaaagctgcagatgtgcggtgggaggaccaagccgagatctctggcagttcccctatcctaagcattacaatatctgaagatgggagcatgtccatcaagaacgaggaagaggagcagaccctgactattcttatcagaacaggactcctggtgatttcaggcttgttccccgtcagtatcccaataaccgcggctgcctggtacttatgggaagtgaaaaagcagagggcaggtgttctgtgggacgtacccagccctccacccgtggggaaggccgagctcgaagatggagcttatcgtatcaaacagaagggcattctgggctactctcaaatcggggcaggagtctataaagagggtacgtttcatactatgtggcacgtgacccgcggcgccgttcttatgcataaggggaaacggattgaaccttcctgggcggacgtgaagaaggatctgatctcatacggaggcggttggaaattggagggggagtggaaggaaggagaggaagtccaggtgctagctctggagccgggcaaaaatccaagagccgtacagacaaagcccggcctcttcaaaaccaacacagggactataggagcagtcagtctggactttagccctggtacctccggctctccaattatcgataagaaggggaaagtggttggactttacggcaatggtgtggtcacgaggaacggggcctatgtgtcggctatcgcccagacagaaaagagcattgaggacaaccccgagatcgaagatgacatattccgaaaaaagcggttaactattatggatctgcaccctggagcaggcaaaaccaagcgctacctcccggctatcgttagagaggccattaagaggggcttgcggacactgatcctcgcgcccacccgagtggtcgccgcagaaatggaggaagctctgagagggcttccaatacgctatcaaactcctgccattagggctgagcataccggacgtgagatcgtggacctgatgtgtcacgcaacattcacgatgcggttgctatcacccgtaagagtgccaaattacaacctgatcattatggacgaagcccactttactgatcctgcctccatcgctgcgaggggttatattagtacccgcgttgagatgggcgaagcagccgggatattcatgacagctacccccccaggatctcgagacccgtttcctcagagcaatgcccccatcatggatgaggagagagaaattccagagcggtcctggaactcaggccatgaatgggtcactgacttcaaaggtaagacagtgtggtttgtgccctctatcaaagcagggaatgatatcgccgcttgcctcaggaagaacggaaaaaaggtcattcagttaagccgcaagaccttcgacagtgagtacgtaaaaacgcgtactaatgattgggactttgtggttacaaccgatatatccgaaatgggcgcgaacttcaaggccgagagagtgatcgaccctcggaggtgtatgaaaccagtcattctgaccgatggcgaggaacgcgtgatccttgcagggcccatgcctgttactcacagctctgctgcccaacgaagaggacggattggtaggaatccgaagaacgagaatgaccagtatatctacatgggcgaaccactggagaacgacgaagattgcgcacattggaaagaggccaagatgctcttggacaatataaacacacccgaggggatcattccttcaatgtttgaacccgagcgcgaaaaagtggatgctatcgacggagagtacagactgaggggcgaagcccggaagaccttcgtcgatctcatgcgtcgcggtgacctgccagtgtggcttgcgtataaggtagcagccgaggggattaattacgctgatcgaagatggtgttttgacggcatcaggaacaaccagatactagaggaaaatgtggaggttgaaatttggacaaaagagggagagcggaagaaactgaagcctcgctggttggatgccagaatctattccgaccccttagctctgaaagaattcaaggagttcgcagccggcaggaagagtctcactctgaaccttattacggaaatggggcggctgccaacctttatgacacagaaagctcgagatgccctcgacaatttggcagtcctgcacactgcggaggccggaggtagagcttacaaccacgccctaagcgaactgcctgagaccctcgagacacttctgttattgaccctgctcgcaactgtgacgggcgggatcttcctgtttcttatgtcgggacgcggcataggtaagatgaccctggggatgtgctgcatcattacagcttctatcctcttgtggtatgcccaaattcagccgcattggatcgcagcctccataattctggaattctttttaatcgtgctactgatccccgagccagaaaaacagaggactcctcaggataatcaactcacctacgtcgttattgctatccttacagtggtagcggccaccatggcaaacgagatgggcttcctggaaaagactaaaaaggacttgggactgggcagcataacaacgcagcagcccgagtcaaatattctcgacatcgatctgcggccagctagtgcctggaccctttatgccgtggcaactacatttgtcacccctatgctccgtcactctattgagaactccagcgtgaatgtttcactgaccgctatcgccaaccaggcgacagtgttgatggggctgggaaagggttggcccttaagtaaaatggacataggcgtcccgctactggctatcgggtgttacagccaagtaaatccaattactctcacggccgcacttctgttgctggtggcccattacgctatcattggacctggcctccaggcaaaggccaccagagaagcgcagaaaagggctgccgcaggtatcatgaagaaccccacagttgatgggattactgtgatcgacctggatccaataccctatgaccctaaattcgagaagcagcttggccaagtcatgttactggtgctctgcgtcacccaggtgttgatgatgcgcacaacctgggccctgtgtgaagctctaactctggccacgggaccgatttccacactctgggagggcaatcccgggcggttttggaacaccactatcgcagtttctatggctaatatcttccgaggaagctaccttgccggcgcgggtctgttgttttccattatgaagaacaccacaaatactagaagggggaccggaaacataggcgaaacactgggtgagaaatggaagaaccgcctcaatgccctgggcaaatcagagttccagatctataagaaatctgggattcaagaagtggatcggacgttagcaaaggagggaatcaaaagaggcgaaaccgaccaccatgctgtaagtcgtgggtcggccaagcttaggtggtttgtggagcggaacatggtcactccagagggaaaggttgtggatctgggctgcggtcgcgggggatggagctactattgtggcggtctcaaaaatgtccgagaagtgaagggcctaacaaaagggggacctggccacgaggaacccattcctatgtccacctacgggtggaacctggtaagattgcagtctggagtggacgttttcttcactccacccgagaagtgcgatacactgctctgtgacatcggcgaatcaagccctaatccaaccgtggaggcaggtaggacgcttcgggtcctgaacttggtggagaattggctgaacaataacatacagttttgcatcaaagtcctcaatccctatatgccgtccgtgattgaaaagatggaggctttacagcgcaagtacgggggagccctggttagaaaccctcttagtaggaattctacccacgaaatgtactgggtaagcaacgcctcaggcaatatcgtgtccagtgtcaacatgattagccgaatgctgatcaaccggttcacaatgaaacataagaaagcgacttatgagccagatgtggacctaggctctgggacccgtaatataggaattgaatccgaggttcccaacctcgacatcatcggtaagagaattgagaaaataaagcaagaacacgagacatcatggcattacgatcaggaccacccttataagacttgggcttaccacggcagctatgaaaccaaacagacagggtcggcatctagtatggtgaatggagtcgtgcgcctgttgaccaagccatgggatgtagtgcccatggttactcagatggccatgacggacacaaccccgtttggccaacagagggtcttcaaagagaaggtggatactcggacccaggaacctaaagagggtacaaagaagctgatgaaaatcacggctgagtggctctggaaggaacttgggaaaaagaaaacccccagaatgtgtactcgcgaggaatttacaaggaaggtgcgatccaacgccgcactgggagccattttcaccgacgagaataaatggaagagcgctcgggaggcggtcgaagattcaagattttggggcttagttgacaaggagaggaacctgcatttggaaggcaaatgcgagacttgtgtgtacaatatgatggggaagcgcgaaaaaaagctcggagagttcggtaaagccaagggctcccgtgcaatctggtatatgtggctgggggctcggtttctagagttcgaagcccttggatttctgaacgaggatcactggttctctagagaaaatagcctcagtggcgtagagggtgaagggctgcataagttgggatacattctgagggacgtgtccaaaaaggagggcggcgcaatgtacgccgatgacacagctgggtgggacacccgcatcacactcgaggatcttaaaaacgaagagatggtcactaatcacatggaaggagagcataagaaactggccgaagcgatatttaagttaacctatcagaacaaggtggttcgagtgcaacggccaacgcctagaggtaccgtcatggacatcattagcaggcgcgatcagagaggctctgggcaggtgggaacatacggcctgaatactttcaccaacatggaggcacaattgatccggcagatggagggtgaaggggtattcaaatcaattcagcacctcacagttactgaggaaatcgccgtgcagaattggctggctagggtcggacgtgagcgactaagtcgcatggccatttccggcgacgattgcgtggtgaagccccttgacgatagatttgcaagcgctctgaccgccctcaacgacatgggcaaagtccggaaggatatacaacagtgggagccatctagggggtggaacgactggacgcaggttcccttctgctcgcaccattttcacgaactgatcatgaaagatggacgcgtgttggtagtgccttgtagaaatcaggacgagttaattggtcgggctaggatctcacaaggcgccgggtggagcctgcgagaaacagcatgcctcggaaagtcctatgcgcagatgtggagtcttatgtacttccatcgtagagatctgcgcctagccgctaacgccatctgttctgcagtcccaagccactgggtgccgacctcccggactacatggtcaattcacgctaagcatgagtggatgaccactgaagacatgctgaccgtttggaatagggtgtggatacaggagaacccctggatggaggacaaaacacctgtcgaaagttgggaggaaatcccatatctcggcaagagagaggatcagtggtgcggttctttgattgggctgacgagccgcgccacctgggcaaaaaatatccaaactgccattaaccaggtgcggtcccttatcggaaatgaagagtacacagactatatgccctcaatgaagaggtttcgaagagaggaagaggaagcgggcgtactgtggtga

SEQ ID NO: 14262 - RNA, 9876 nt, synthetic construct
  misc_feature 1..9876: note = derived and/or modified CDS sequence (opt3) from DENV-2__AB543624__SS-prME
  source 1..9876: mol_type = other RNA
agcgccggaatgatcattatgctgatacccaccgtgatggctttccacctcacaactagaaatggggagcctcatatgatcgtcggcattcaggaaaagggtaaatcccttctgtttaagacggaggacggagttaatatgtgcaccttgatggcaatggatttaggggaactgtgtgaggacacaatcacttacaaatgcccactactcaggcaaaatgaaccggaggatattgactgttggtgcaattctacctcaacatgggtgacctatggaacttgtacaaccacgggcgagcaccggcgcgaaaagcgaagcgtggccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgatcggctatggtaccgtgactatggagtgtagccccagaaccgggcttgatttcaatgaaatggtcctgttgcaaatggagaacaaggcctggctcgtgcacaggcagtggtttctggacttacctctgccatggctccccggcgcagataagcaggagtctaattggatacagaaagaaacacttgttaccttcaagaaccctcatgctaaaaagcaagacgtggtcgtgctgggatccccagagggcgccatgcacactgcgttgacaggggccacggaaattcagatgtcaagcggaaatctactgtttaccggtcatctcaaatgccggctgcgtatggacaaacttcagctgaagggcatgagttactctatgtgtactgggaaattcaaggtagttaaagagatcgcagagacacaacacggaaccatcgtgattcgcgtccagtatgaaggcgatggttccccctgcaagatcccgttcgagattatggacttggagaagagatacgtgctcgggaggctgataacagtcaaccctatcgtgactgagaaggataaccccgttaatattgaagctgagccaccttttggcgacagctacatcatcattggagtggagcccggccagttaaagctgaactggttcaaaaaggggtcgtctataggacagatgtttgaaaccacgatgcggggtgccaaacgaatggctatcctaggcgataccgcctgggacttcgggtccctcggaggcgtatttacatcaattggtaaggcactgcatcaagtcttcggggccatctatggcgctgcgtttagtggagtgagctggactatgaaaattcttatcggcgttataatcacctggattgggatgaactcccgctctaccagcttgtcagtgagtctggtcctcgtgggaatcgtaactctgtaccttggcgtgatggttcaggcagattccggttgtgtcgtgagctggaagaacaaggagctgaaatgcgggtctggaattttcatcaccgacaatgtgcacacgtggacagaacagtataagtttcagccagagtcacccagtaaattggccagcgctatacaaaaggcccaggaagagggcatttgtggtatcagatccgtcaccaggctcgagaacctgatgtggaaacagattgcacctgaattaaatcacatcctggccgagaacgaagttaagctaactataatgacaggcgatatcaaagggattatgcaggctggaaagcggtctctccgcccacaaccgaccgagctgaagtactcgtggaaaacttggggcaaggccaaaatgcttagcaccgaatcctataatcagacattcttgatcgacgggcccgagacggcagagtgccctaacaccaatagagcgtggaactcactggaagtggaggattacggatttggcgtgttcactacaaatatttggctcaagctgaaagaaaggcaggacgctttttgtgacagtaagttaatgtctgccgcaatcaaggataaccgtgccgtacatgctgacatgggttattggatagagagcgccctgaatgatacctggaaaattgagaaggcatccttcatcgaagtcaaaaactgccactggccaaagtcacatacactttggagcaacggggtgttggagtctgaaatgatcattcccaaaaatctcgctggacctgtttcccagcacaactaccggccaggctaccacactcaaatcgccggtccctggcatctgggcaagctagagatggacttcgatttttgtgacgggaccacggtgattgtcacagaagattgcggaaatcgaggcccgagtctgagaaccactaccgcgagcgggaagctcataacagagtggtgctgtaggtcttgcactctgcctccacttcgctatcggggagaggacggctgttggtacggtatggaaatcagacccttgaaagagaaggaagagaacctggtaaattccttagttaccgccgggcacggacaggtggataacttctcactcggcgtactgggtatggctctttttctggaagagatgttgaggacacgcgtcggcacgaaacatgcaattctcctggtggccgtgagtttcgtcaccctaatcactgggaatatgagctttaaggacctgggacgagttgtggtaatggtgggcgctacaatggccgatgacattgggatgggagtcacctatctcgcactgcttgcggccttcaaagtgcggcctacttttgctgccggcttgctgttacgtaagctcacatcgaaggagctgatgatgaccacgatcggtatagttcttctgtcccagtctactatccccgaaaccgtgctagagctcacagatgcactggctttggggatgatggtcctgaaaattgtgagaaacatggaaaagtaccaattagccgttaccatcatggcaattctctgcgtgccaaatgccgtcatcctgcagaacgcttggaaagtaagctgtactatacttgcggtggtttcagtgagtcctctgttgctcacatcctctcagcagaagaccgactggattcccctggccctaacaatcaaaggactgaatccaactgcaatcttccttaccacgctcagcaggacaaacaagaaacgctcctggccgctgaatgaggctattatggccgtcggcatggtgtcaatattggccagcagtctgttaaagaacgacatccctatgaccggccccctcgtagctgggggactgcttactgtgtgctatgtcctgaccggtcggtctgcagatttggaactcgagagagccacagacgttaagtgggaggatcaagcggaaatttccggcagctcgccaatcctgtcaattactatctctgaggacgggagtatgtccatcaagaatgaagaggaggaacagaccctaacgatcctgattaggacaggacttctcgtgatcagcggcctgtttcccatttctatccctataaccgctgccgcatggtacttgtgggaggtgaagaaacagcgagccggtgtcttatgggatgtgccaagtccccctccgatggggaaggctgaactggaggacggagcatatcgcattaaacagaagggcatcctcggctactcccaaatcggggccggagtttacaaggaaggtactttccacacaatgtggcatgtaacccggggcgcggtgctgatgcacaaagggaagagaattgagccatcatgggctgatgtcaaaaaggaccttatcagttatggaggcggttggaaactggagggggaatggaaggagggagaagaggtgcaggttttggccctagaacccggcaagaaccctagggcagtgcagactaaaccaggcctgtttaagacaaacaatgggaccataggagccgtcagcctcgatttctctcccggtacgtccggctcacctattatcgacaaaaaggggaaagtggtaggactgtacggcaacggtgtcgtgactcgtagtggggcttatgttagcgccattgcacagaccgagaagtccatcgaggataatccggaaatagaggacgatatttttcgcaagcggagacttacaatcatggacttacaccccggagctggcaaaaccaagaggtacctgccagccatcgtgcgagaagcgattaaacggggcctccgcacattgatcctggcccctactagagtcgtggcagctgagatggaagaggccctcagggggctgcccattcggtatcaaaccccagctatacgagcagagcatacgggaagagaaatcgttgaccttatgtgtcacgccacattcactatgcgcctgttgtctcctgtgagggtccccaactacaatctaattatcatggatgaggcccatttcaccgacccagcttcgatcgcggcacgtggttatattagcacacgggtggaaatgggcgaggccgctgggatatttatgaccgccactccgcctggatcaagagatcccttcccacagtccaacgcacccatcattgacgaggaaagggagatccctgaacgcagttggaactctggccacgagtgggtaaccgattttaagggtaaaacagtgtggttcgttccaagcattaaggccgggaacgacatcgctgcgtgcctgcgaaagaatggcaaaaaggtcatacagctctccagaaaaacgtttgattcagaatacgtgaagactcggaccaacgactgggatttcgtggtcacaaccgacatctctgagatgggcgccaattttaaagcagagagggtaattgatccccgccgttgtatgaagcctgtgatcttaactgacggcgaagagagagttattctggctgggccgatgccagtgacacatagcagtgccgcacaacggaggggacgcatcggtcgaaaccccaaaaatgaaaacgaccagtacatatatatgggcgagcctcttgaaaatgatgaggactgcgcccactggaaggaggctaagatgctgctcgataacattaacacccccgaagggatcattccatccatgttcgagcctgaaagagagaaagtcgacgccatcgatggagaataccggttgaggggcgaggcgcgcaagacgtttgtggacctgatgagaaggggtgatctccccgtttggctggcatataaagtggccgctgaggggataaattacgccgaccggcgttggtgtttcgatggcatcaagaacaatcagattcttgaagagaacgtcgaagtggagatctggactaaagagggagaacgcaagaagctaaaaccacgatggctggacgctagaatttatagcgatcctttggcattaaaggagtttaaagagttcgccgctggcaggaagtctctgacactcaatctgatcaccgagatggggcggcttccgaccttcatgactcagaaaacacgcgacgccctggataacctcgcagtattgcacaccgcggaagccggaggtagagcttacaatcatgccctgtcagagctacccgagacactggaaactctccttctgttaacgttgctggcaaccgtgacaggcgggatatttctcttcctgatgtccggaaggggcattggtaagatgactcttgggatgtgctgcatcatcaccgctagtattctgctctggtatgcccaaatccagccacactggatagcagccagcattatcttggagtttttcctgattgttttactaatccctgaacccgagaagcagcggacaccacaggacaaccaactgacctacgtcgtgatagctatcctcactgtggtcgcggccacgatggcaaatgaaatgggctttcttgagaaaaccaagaaagacctgggattgggctcgattgctacacagcatcctgagtctaacatcctggatattgacctccgacccgcctccgcctggactctgtacgcagttgctaccacattcatcaccccgatgcttagacacagcattgaaaattcaagtgtgaacgtatctctcactgccatcgcgaatcaggctacagtgctgatggggttgggaaagggttggccactgtccaaaatggatataggcgtccctttactagccattgggtgttatagccaggtgaaccccatcacgctgaccgcagccctccttctgttggttgctcactacgcaatcattggaccaggcctgcaagccaaggcgactcgcgaggctcagaagagggccgcagccggtataatgaaaaatcccacagtggacgggatcaccgtcattgatctcgaccctatcccgtatgatcccaagtttgaaaaacagctgggccaggtaatgcttttaattctgtgcgtgacccaagttctcatgatgcggacaacttgggctttgtgtgaggccctgacgctagcaaccggaccaatctcacctctgtgggaaggcaaccccgggcgtttctggaatacaactatagctgtgagtatggccaacatctttagaggaagctacctcgcgggcgccggtcttctgttctccattatgaagaacaccacaaataccaggcgcgggactggaaacatcggcgagacgttgggtgagaaatggaagtctcggctgaatgcactcggcaaaagcgaatttcagatttataagaagtccgggatccaggaggtcgaccgaacactggctaaagaaggaataaagagaggcgagaccgatcatcacgccgtgtcaagggggtctgcaaaattacgctggttcgtcgagcggaacatggtgactcctgaaggaaaggttgtggaccttggctgcggtagagggggatggagttactattgtggcggtctgaaaaatgtacgtgaggtgaagggcctcaccaaagggggaccaggccatgaagaacccattcctatgtcgacatacgggtggaacctagtcaggctgcaaagcggagttgatgtgtttttcatcccacccgaaaaatgcgacactttgctgtgtgatatcggcgagtcctctccgaatcctaccgtcgaggctggtcggacactccgcgtgcttaacctggtagaaaattggttgaacaatcacacgcatttctgcattaaggtgctgaacccatacatgccctcagttctcgagaaaatggaagccttacagcgaaagtatgggggagccctggtgagaaatcctcttagcaggaactccacccacgagatgtactgggtcagtaatgcgtctggcaacatagtgagctcagtcaacatgatctcccggatgctgattaatcgctttactatgagacacaaaaaggctacatatgaaccagacgtggacctaggcagtgggaccaggaacatcggaattgagagcgagatccccaatctcgatataatcggtaagcgaattgagaaaataaagcaggaacatgaaacttcttggcactacgaccaggatcatccgtataaaacatgggcataccacggctcctatgagaccaagcaaacggggtcagccagctcgatggttaacggagtagtgcggctgttgaccaaaccttgggacgtcctgcccacagtgactcagatggctatgaccgatacaactccattcggccagcagcgtgtttttaaggaaaaggtggacaccagaacacaagagcctaaagagggtaccaagaaactcatgaagattactgccgaatggctttggaaagagctggggaagaaaaagacgccccgcatgtgtacaagggaagagttcacccggaaggtcagatctaatgcagccttaggagctatctttactgatgagaacaaatggaagagtgcgcgcgaagccgtggaggactccaggttctgggaactggtagataaagagcgaaatttgcacctcgaaggcaagtgcgagacctgtgtgtacaacatgatgggcaaacgggagaagaagctgggggaatttggaaaagcaaagggtagcagagctatttggtacatgtggctaggcgccaggttccttgagtttgaagcactggggttcctcaatgaggaccattggttttcacgcgaaaactccctgtctggagttgagggcgagggtttgcacaaactggggtatatactccgtgatgtcagcaagaaagaaggaggcgccatgtacgctgacgacacagccggctgggatacgcggatcacccttgaggacctgaagaatgaagagatggtgactaaccatatggaaggggagcacaagaaattagcggaggcaattttcaagctgacatatcagaataaagtggtcagagttcagaggccaacaccccgcggaactgtgatggatatcatcagtcgacgggaccagagaggttccggccaagtagggacatacggattgaacacctttacaaatatggaagcccagctcattaggcagatggagggcgaaggtgtgttcaagaacatacaacgcctgactgtcaccgaggaggtggctgttcataactggctagccagagtggggcgggaaaggcttagccgtatggcaatctctggagatgactgcgtcgtgaaacctctggatgaccgattcgctaatgccctcacggctctgaacgatatgggcaagattcgcaaggacatccagcagtgggagccatcaaaaggctggaatgattggacccaggtaccgttttgcagtcaccacttccatgaattgattatgaaggacgggagagttttagtggtcccctgtcggaaccaagatgagctgatcggaagggcccgcatatcccagggtgcaggctggagcctcagagaaacagcgtgccttgggaaatcttatgcccagatgtggtcgctgatgtactttcaccggagggacctacgactggctgccaatgcaatctgttcagctgtgcctagccattgggtgccaacttcccgtaccacatggagtattcacgccaagcacgagtggatgactaccgaggacatgctcacggtctggaacagagtttggatccgcgaaaatccctggatggaggataaaacacctgtggaatcttgggaggaaattccatatttgggaaagcgggaggaccagtggtgcggcagcctgatcggtcttacctccagggcaacttgggccaagaacatacaagcggctattaatcaggtaagatcactgatcgggaacgaggaatacacagattacatgcccagtatgaaacgcttccggagggaggaagaggaagccggagtgctctggtga

SEQ ID NO: 14263 - RNA, 9876 nt, synthetic construct
  misc_feature 1..9876: note = derived and/or modified CDS sequence (opt3) from DENV-2__AB189122__SS-prME
  source 1..9876: mol_type = other RNA
accgccggcgtgataattatgatgatacccacagtcatggctttccacctgactacgagaaacggggaacctcatatgatcgttagcaggcaggaaaagggaaaatccctcctttttaagaccgagaatggtgtgaacatgtgcacactgatggcaatggacttgggcgaattatgtgaggatactattacctacaattgcccactgctgcggcaaaacgaaccggaggacatcgattgttggtgcaattctacatcaacctgggtaacttatgggacatgtaccgccacgggagagcaccgccgagaaaaacgtagtgtggcgctcgctccccatgtcggcatgggtctggagactaggaccgaaacatggatgagctccgagggggcctggaagcacgcacagaggattgagacttgggtgcttcggcatcctggattcaccatcatggccgctatactggcatacacaatcggcaccacgtattttcagcgcgttttgattttcatcctcctgactgccgtggctccatctatgacaatgagatgcattggcatctcgaacagggactttgtcgaaggggtgtcaggaggtagctgggtagatatagttctggagcacggcagttgtgtgaccactatggccaaaaataagcccacactcgacttcgaattaattaagaccgaggcgaaacaccctgcaacgctgcggaagtactgcatcgaagccaaacttaccaacacaactaccgcttcccgctgtccaacacagggggagccctctttgaatgaggaacaagataagcgatttgtctgcaaacatagcatggtggacagaggatggggcaacggttgtgggctgttcggaaagggcggcattgtgacttgcgccatgtttacctgcaagaaaaatatggaggggaaggtcgttcagcctgaaaacctagagtatacaatcgtgatcaccccacactccggagaagagaatgcagtaggtaacgatactggcaaacatgggaaggagattaaagtgacgccgcagtcaagtataacagaagctgagctcaccggatacggcactgtcaccatggaatgtagccccaggacaggtctggacttcaatgagatggtgcttctgcagatggaaaacaaggcctggttggttcaccggcaatggtttctcgatctgcctttaccatggctgcccggggcggacacccagggctctaactggatccagaaagagactctcgtgacattcaagaatcctcacgccaagaaacaggatgtcgtggtacttggatcccaagagggcgcaatgcatacggctctgaccggggccactgaaattcagatgtcaagcggaaacttgctatttacaggtcacctgaagtgccgtctccgcatggacaaactgcagcttaagggcatgagttattctatgtgtaccgggaaattcaaggttgtgaaggagatcgctgaaacacaacatggaactatagtcattagagtgcagtacgagggcgacggttccccatgcaaaatccccttcgagatcatggatctggaaaagaggcacgtcttggggcggctcattaccgtgaatccgatcgttacggagaaagacagccctgtgaacattgaagccgagcccccatttggcgattcgtacataatcattggagtagaacctggccagctgaagttaaattggttcaaaaaggggtcttccatcggacagatgtttgagaccacaatgcgaggtgcaaagcgcatggccatcctgggcgacactgcttgggatttcgggtcactaggaggcgtctttaccagtattggtaaagcgctccatcaagtgttcggggcaatatatggcgccgcttttagcggagtttcctggacaatgaagatcctgattggcgtggtcatcacttggattgggatgaactctagaagcacctcacttagtgtgtccttggtactggtgggagttgtcacgctctacctgggcgtgatggtgcaggccgacagcggttgtgtcgtttcttggaaaaataaggagcttaaatgcgggtcaggaatcttcataacagataacgtgcacacctggactgaacagtataagtttcagcccgagagtccaagcaagctggcatccgccatccaaaaagctcacgaagagggcatttgtggtatcaggtctgtgacacggttggaaaatctcatgtggaagcagattacccccgagctgaaccatatcttatcggagaatgaagtaaaactgactataatgaccggcgacattaaggggatcatgcaggccggaaaacgcagcctaagacctcagccaacagagctcaagtactcctggaaagcatggggcaaggcgaagatgctgtcaacggaacttcacaaccataccttcttgattgatgggccggagactgctgaatgccccaatacaaacagggcctggaatagtctggaggtcgaggactatggatttggcgtgttcaccacaaacatctggctcaaactgaaggaacgtcaagatgtattttgtgactctaaattaatgagcgcagccataaaggacaaccgggctgtgcacgccgatatgggttactggatcgagtccgcactgaatgacacttggaaaattgaaaaggcttcattcatcgaggtcaagagctgccactggcctaaatctcataccctttggtccaacggggtgttggagagtgaaatgattatcccaaagaatttcgccggacccgttagccagcacaactatcgacctggctaccatacgcagacagcgggtccatggcacctcggcaaactggagatggattttgacttctgtgaagggaccactgtggtagtcaccgaggattgcggaaatagaggcccctctctaaggacaactaccgcctccgggaagctgataacagaatggtgctgtcgctcatgcacgctcccgcctctgcggtacagaggagaggacggctgttggtatggtatggagattaggccacttaaagaaaaggaggaaaacttggtgaatagtctggtgaccgctgggcatggacagatcgataactttagcttaggcgtcctcggtatggcactgttccttgaggaaatgctgcgcactcgagttggcacaaagcacgccatcttgctcgtggctgtatcgtttgtgaccctgattactgggaatatgtccttccgggacctaggacgtgtcatggtgatggttggcgccacaatgaccgatgacatcgggatgggagtgacgtacctggcactcctggcggcctttaaagtcagacccactttcgctgccggccttttgctgaggaagttaacctctaaagagctcatgatgacaaccattggtatagtgctgcttagccaatcaactatccctgagacaattctggaactaaccgatgcactcgctctggggatgatggttttgaagatcgtgcgcaacatggagaaatatcagctggccgtcacaattatggcaatcttatgcgtacccaatgccgtgatactccagaacgcttggaaggttagttgtactaccctggcggtggtctccgtgtctccacttctgttgacgagctcccaacagaaggccgactggatccctctcgcactgacaattaaaggactaaatcccaccgctatctttctgactaccctttcacggacaagcaagaaaagaagttggccactcaacgaagccattatggccgtaggcatggtgtctatcctggcttccagcttgctgaagaatgatataccgatgactggccctttagtcgcagggggactcctgaccgtttgctacgtgcttacgggtaggtcggccgacctggagttggaacgagcggctgacgtgcgctgggaggagcaggccgaaatttcaggctctagtcccatcctctccatcacaattagcgaggatgggtctatgagcatcaagaacgaagaggaggaacagaccctgactatcctaattcggacaggactgcttgtcatctccggcctcttcccagtgtcaattcccatcaccgcagccgcttggtatctgtgggaggttaagaaacaaagagcaggggttttgtgggacgtgcctagtccaccccctgtcgggaaggccgaattagaggatggagcgtacaggataaagcagaaaggcatcctgggctatagccagattggggtgggagtttacaaggaaggtacttttcacacaatgtggcatgtgacccgtggcgctgtcctcatgcacaaagggaagcgcatcgagccgtcttgggccgacgtgaaaaaggatctgatttcctacggaggcggttggaaacttgagggggaatggaaagagggagaagaggtacaggtcctggcattggaaccaggcaagaacccccgggccgtgcaaacgaaacctggcctattcaagactaataccgggacaatcggagctgtttcactggactttagtccaggtaccagcggctcccccatagtggataaaaaggggaaggtcgtgggactctatggcaacggtgttgtgacaagatctgggacttacgtctcggccattgcacagaccgagaaaaatatcgaggacaaccctgaaatcgaggatgacattttcaggaagaaacgactgacgatcatggatcttcatccgggagctggcaagacaaaacggtatttacccgccatagtgcgcgaagcgattaagagaggcctgaggactctcatcttggccccaacccgggtagtggcagctgagatggaagaggccctgcgagggctccctattagataccagacacccgctatccgcgcagagcacaccggaagggaaatagttgacctgatgtgtcatgccactttcaccatgcgtcttctgagcccaattcgggtccctaattataacttgatcatcatggatgaggcccactttacagaccccgcttcaattgcggcaagaggttacatctccacgagggtggaaatgggcgaggccgctgggattttcatgactgccaccccaccgggaagtcgcgacccttttccccagtctaatgcaccaataatggatgaggaacgagagatccccgaaagaagctggaactccggccacgagtgggtgacagacttcaagggtaaaaccgtctggtttgtaccttcaattaaggccgggaatgatatcgctgcgtgcctacggaaaaacggaaagaaagtgatccaactgtctaggaagactttcgacagcgaatatattaagacacgcaccaatgattgggactttgttgtgacgactgatataagtgagatgggcgccaacttcaaagcagagcgtgtcatcgacccaagacggtgtatgaagcccgtgattctcacagatggcgaagagagggttatcttagctgggcctatgccggtgacccattccagcgccgcacagcgccgaggaagagtcggtcggaatcccaagaacgaaaatgaccagtacatttacatgggcgagcccctggaaaacgatgaggactgcgcccactggaaggaggctaaaatgcttctggacaacatcaatacccctgaagggataatcccctctatgtttgagccagaaagggagaaggtggatgccattgacggagaatatcgcctcagaggcgaggcgaggaaaactttcgtagatttgatgcggcgtggtgacctgcctgtgtggctcgcataccgcgttgccgctgaggggatcaactatgccgatcgaagatggtgttttgacggcgtcaagaataaccaaattctggaagagaatgtggaagtggagatctggacaaaggagggagaaaggaagaaacttaaaccccggtggctagatgctcgcatatactcagacccactggcattgaaagagttcaaagagttcgccgctggcagaaagtccttaaccctgaacctcattacagagatggggaggctgcctacttttatgacgcagaaggcccggaatgcacttgataacctggcggtcctccataccgccgaagctggaggtcgagcctataatcacgcattgagtgagctgccggagacactagaaactctgctccttctgaccttattggctacagttaccggcgggatcttcctgtttctcatgagcggaaaaggcattggtaagatgactctggggatgtgctgcatcataacggcctcggtgcttctgtggtacgcacagatccagccccactggattgccgcttctatcattctcgagttctttttgatcgtactgttaataccagaacctgagaaacaaagaacaccacaggacaaccagctaacatatgtggtcattgcgatcctgactgtggttgccgcaaccatggctaatgaaatgggcttcctcgagaagaccaaaaaggattttggacttggctccatcgccacccagcaaccagagagcaacattctggacatcgatttgcgccctgcctcagcatggactctgtacgctgtggccacaacgttcataacccccatgctcaggcatagtattgaaaattcttccgtcaacgtaagcctgactgcgatcgctaatcaggccacagtgcttatggggctcggaaagggttggccgctgtcaaaaatggacattggcgttccattgctggcaatcgggtgttacagtcaggtgaaccctataaccttaaccgccgctctactgctccttgtcgcacactatgccatcattggacccggcctgcaggcgaaggctacacgggaggcccaaaaacgtgcagccgctggtatcatgaagaatccaactgtggacgggattacggtcatcgatttggaccccattccttacgatccgaaatttgaaaagcagctgggccaggtgatgctcctggttctttgcgtgacccaggtattaatgatgagaacaacttgggccctgtgtgaggcactcaccttggctacaggacccatcagcaccctgtgggaaggcaacccagggaggttctggaacactacgatagccgtgtccatggcgaatatttttcgcggatcttatctagccggcgcaggtctactcttcagcatcatgaagaacacagctaatacccggcgagggactggaaacaccggcgagacacttggtgagaaatggaagaatagactgaacgccttgggcaaatccgaatttcaagtctacaagaaatcagggatccaggaggttgacaggactctggcaaaggaaggaattgagcgcggcgagaccgatcatcacgctgtgtctcgggggagtgccaaactcagatggttcgtcgaacgtaatctggtgacacctgagggaaaggtagtggacttaggctgcggtagaggtgggtggtcgtattactgtggcggtcttaagaacgttaaagaagtgaagggcctgacgaaagggggacccggccatgaggaacctataccaatgagcacctatgggtggaatctcgtccggctacagtccggagtggatgtcttctttactccccctgagaagtgcgacacactgttgtgtgatatcggcgagtcttcaccaaaccccaccgtggaagccggtcgcactctgcgagttctcaatcttgtagagaactggctgaataacaatacacaattctgcattaaagtgttgaacccgtacatgcctagcgtcatcgaaaagatggaggcgctgcagagaaagtacgggggagctctcgtgaggaacccattatcccggaatagtacccacgaaatgtattgggtttctaacgcaagcggcaatattgtgtcatccgtcaacatgatcagtcgcatgctgataaatagatttacgatgaggcacaaaaaggccacctacgagcccgacgtggatcttggcagcgggacacgaaacatcggaattgagtctgaaatccctaatctggacattatcggtaaacggatagagaagattaaacaggaacatgagacttcctggcactatgatcaggaccatccatacaagacctgggcttatcacggctcatacgaaacaaagcaaactgggagcgcctcgtctatggtaaacggagtggttcgtctactcaccaaaccctgggacgtcatcccgatggtgacacagatggcaatgaccgatactacgcctttcggccagcagagagtgtttaaggagaaagtcgacacacgcacccaagagcccaaggaaggtactaaaaagctgatgaagatcaccgccgagtggttgtggaaagaactggggaagaaaaagacaccaaggatgtgtacgcgggaggagttcaccagaaaagttcgcagtaatgctgcgctcggagccatttttactgatgaaaacaagtggaaatccgcaagggaggctgtggaagacagcggcttctgggagcttgtagataaggaacgaaatctgcacttagagggcaagtgcgagacatgtgtgtataacatgatggggaaacgggaaaagaaactgggagagtttggtaaggccaaaggctcaagagcaatatggtacatgtggttgggggccaggttcctcgaatttgaggctctgggattcctaaatgaagaccattggttttcccgcgagaactctcttagcggcgtcgagggtgaagggctgcacaagctcggatacatcctgcgtgatgtgagtaagaaagagggcggcgccatgtatgcggacgataccgcagggtgggacactcggattacattggaagatctgaagaatgaggaaatggttaccaaccatatggagggagagcacaaaaagctcgccgaagctatcttcaaacttacataccagaacaaggtggtcagagtgcagaggcctactccccgcggtaccgtaatggacattatctcccgacgggaccagagaggcagcgggcaagttgtgacgtatggactgaataccttcacaaacatggaggcccagttaataaggcagatggaaggcgagggtgtctttaagtctatccaacatctgactgtgaccgaggaaattgcagtgaaaaattggttggctcgcgtcgggagagagcggctctcaaggatggccatcagtggagatgactgcgttgtgaagccactggatgaccgtttcgcttccgccctaacagcacttaacgatatgggcaaagtacgaaaggacattcagcagtgggaacccagccgcggctggaatgattggactcaggtgcctttttgctctcaccacttccatgagctgatcatgaaagacgggagagtcctcgtggttccatgtcggaaccaagatgaactgattggaagggcgcgcatatcgcagggtgccggctggtcattgagagagaccgcttgcttaggaaagagctacgcccagatgtggtccctgatgtattttcaccggagggacctccgacttgcagctaatgccatctgtagtgcagtgccgtctcattgggtccccacgagccgtacaacctggtccattcacgccactcacgagtggatgacaaccgaagatatgctgactgtgtggaacagagtatggatccaggagaatccttggatggaagacaagaccccagttgagtcatgggaagagatcccctacctaggaaaacgcgaggatcaatggtgcggcagtctgattggtctcacatctcgggcgacgtgggctaagaacatacagaccgccatcaatcaggtgaggagcttgattgggaacgaagagtatactgactacatgccttccatgaaaagattccgccgggaagaggaagaggcaggagtcctgtggtga

SEQ ID NO: 14264 - RNA, 9876 nt, synthetic construct
  misc_feature 1..9876: note = derived and/or modified CDS sequence (opt3) from DENV-2__AB189123__SS-prME
  source 1..9876: mol_type = other RNA
accgccggcgtgataattatgatgatacccacagtcatggctttccacctgactacgagaaacggggaacctcatatgatcgttagcaggcaggaaaagggaaaatccctcctttttaagaccgagaatggtgtgaacatgtgcacactgatggcaatggacttgggcgaattatgtgaggatactattacctacaattgcccactgctgcggcaaaacgaaccggaggacatcgattgttggtgcaattctacatcaacctgggtaacttatgggacatgtaccgccacgggagagcaccgccgagaaaaacgtagtgtggcgctcgctccccatgtcggcatgggtctggagactaggaccgaaacatggatgagctccgagggggcctggaagcacgcacagaggattgagacttgggtgcttcggcatcctggattcaccatcatggccgctatactggcatacacaatcggcaccacgtattttcagcgcgttttgattttcatcctcctgactgccgtggctccatctatgacaatgagatgcattggcatctcgaacagggactttgtcgaaggggtgtcaggaggtagctgggtagatatagttctggagcacggcagttgtgtgaccactatggccaaaaataagcccacactcgacttcgaattaattaagaccgaggcgaaacaccctgcaacgctgcggaagtactgcatcgaagccaaacttaccaacacaactaccgcttcccgctgtccaacacagggggagccctctttgaatgaggaacaagataagcgatttgtctgcaaacatagcatggtggacagaggatggggcaacggttgtgggctgttcggaaagggcggcattgtgacttgcgccatgtttacctgcaagaaaaatatggaggggaaggtcgttcagcctgaaaacctagagtatacaatcgtgatcaccccacactccggagaagagaatgcagtaggtaacgatactggcaaacatgggaaggagattaaagtgacgccgcagtcaagtataacagaagctgagctcaccggatacggcactgtcaccatggaatgtagccccaggacaggtctggacttcaatgagatggtgcttctgcagatggaaaacaaggcctggttggttcaccggcaatggtttctcgatctgcctttaccatggctgcccggggcggacacccagggctctaactggatccagaaagagactctcgtgacattcaagaatcctcacgccaagaaacaggatgtcgtggtacttggatcccaagagggcgcaatgcatacggctctgaccggggccactgaaattcagatgtcaagcggaaacttgctatttacaggtcacctgaagtgccgtctccgcatggacaaactgcagcttaagggcatgagttattctatgtgtaccgggaaattcaaggttgtgaaggagatcgctgaaacacaacatggaactatagtcattagagtgcagtacgagggcgacggttccccatgcaaaatccccttcgagatcatggatctggaaaagaggcacgtcttggggcggctcattaccgtgaatccgatcgttacggagaaagacagccctgtgaacattgaagccgagcccccatttggcgattcgtacataatcattggagtagaacctggccagctgaagttaaattggttcaaaaaggggtcttccatcggacagatgtttgagaccacaatgcgaggtgcaaagcgcatggccatcctgggcgacactgcttgggatttcgggtcactaggaggcgtctttaccagtattggtaaagcgctccatcaagtgttcggggcaatatatggcgccgcttttagcggagtttcctggacaatgaagatcctgattggcgtggtcatcacttggattgggatgaactctagaagcacctcacttagtgtgtccttggtactggtgggagttgtcacgctctacctgggcgtgatggtgcaggccgacagcggttgtgtcgtttcttggaaaaataaggagcttaaatgcgggtcaggaatcttcataacagataacgtgcacacctggactgaacagtataagtttcagcccgagagtccaagcaagctggcatccgccatccaaaaagctcacgaagagggcatttgtggtatcaggtctgtgacacggttggaaaatctcatgtggaagcagattacccccgagctgaaccatatcttatcggagaatgaagtaaaactgactataatgaccggcgacattaaggggatcatgcaggccggaaaacgcagcctaagacctcagccaacagagctcaagtactcctggaaagcatggggcaaggcgaagatgctgtcaacggaacttcacaaccataccttcttgattgatgggccggagactgctgaatgccccaatacaaacagggcctggaatagtctggaggtcgaggactatggatttggcgtgttcaccacaaacatctggctcaaactgaaggaacgtcaagatgtattttgtgactctaaattaatgagcgcagccataaaggacaaccgggctgtgcacgccgatatgggttactggatcgagtccgcactgaatgacacttggaaaattgaaaaggcttcattcatcgaggtcaagagctgccactggcctaaatctcataccctttggtccaacggggtgttggagagtgaaatgattatcccaaagaatttcgccggacccgttagccagcacaactatcgacctggctaccatacgcagacagcgggtccatggcacctcggcaaactggagatggattttgacttctgtgaagggaccactgtggtagtcaccgaggattgcggaaatagaggcccctctctaaggacaactaccgcctccgggaagctgataacagaatggtgctgtcgctcatgcacgctcccgcctctgcggtacagaggagaggacggctgttggtatggtatggagattaggccacttaaagaaaaggaggaaaacttggtgaatagtctggtgaccgctgggcatggacagatcgataactttagcttaggcgtcctcggtatggcactgttccttgaggaaatgctgcgcactcgagttggcacaaagcacgccatcttgctcgtggctgtatcgtttgtgaccctgattactgggaatatgtccttccgggacctaggacgtgtcatggtgatggttggcgccacaatgaccgatgacatcgggatgggagtgacgtacctggcactcctggcggcctttaaagtcagacccactttcgctgccggccttttgctgaggaagttaacctctaaagagctcatgatgacaaccattggtatagtgctgcttagccaatcaactatccctgagacaattctggaactaaccgatgcactcgctctggggatgatggttttgaagatcgtgcgcaacatggagaaatatcagctggccgtcacaattatggcaatcttatgcgtacccaatgccgtgatactccagaacgcttggaaggttagttgtactaccctggcggtggtctccgtgtctccacttctgttgacgagctcccaacagaaggccgactggatccctctcgcactgacaattaaaggactaaatcccaccgctatctttctgactaccctttcacggacaagcaagaaaagaagttggccactcaacgaagccattatggccgtaggcatggtgtctatcctggcttccagcttgctgaagaatgatataccgatgactggccctttagtcgcagggggactcctgaccgtttgctacgtgcttacgggtaggtcggccgacctggagttggaacgagcggctgacgtgcgctgggaggagcaggccgaaatttcaggctctagtcccatcctctccatcacaattagcgaggatgggtctatgagcatcaagaacgaagaggaggaacagaccctgactatcctaattcggacaggactgcttgtcatctccggcctcttcccagtgtcaattcccatcaccgcagccgcttggtatctgtgggaggttaagaaacaaagagccggtgttttgtgggacgtgcctagtccaccccctgtcgggaaggcagaattagaggatggagcgtacaggataaagcagaaaggcatcctgggctatagccagattggggctggagtgtacaaggaaggtacttttcacacaatgtggcatgttacccgtggcgccgtgctcatgcacaaagggaagcgcatcgagccgtcttgggcagacgtcaaaaaggatctgatttcctacggaggcggttggaaacttgagggggaatggaaagagggagaagaggtgcaggtactggccttggaaccaggcaagaacccccgggctgtccaaacgaaacctggcctattcaagactaataccgggacaatcggagccgtgtcactggactttagtccaggtaccagcggctcccccatagttgataaaaaggggaaggtggtcggactctatggcaacggtgtggttacaagatctgggacttacgtgtcggcaattgctcagaccgagaaaaatatcgaggacaaccctgaaatcgaggatgacattttcaggaagaaacgactgacgatcatggatcttcatccgggagccggcaagacaaaacggtatttacccgcgatagtccgcgaagccattaagagaggcctgaggactctcatcttggcaccaacccgggtggtagctgccgagatggaagaggctctgcgagggctccctattagataccagacacccgcaatccgcgccgagcacaccggaagggaaatagtggacctgatgtgtcatgccactttcaccatgcgtcttctgagcccaattcgggttcctaattataacttgatcatcatggatgaggctcactttacagaccccgcgtcaattgcagccagaggttacatctccacgagggtcgaaatgggcgaggctgccgggattttcatgactgcaaccccaccgggaagtcgcgacccttttccccagtctaatgccccaataatggatgaggaacgagagatccccgaaagaagctggaactccggccacgagtgggtgacagacttcaagggtaaaaccgtgtggtttgtcccttcaattaaggctgggaatgatatcgcggcctgcctacggaaaaacggaaagaaagtaatccaactgtctaggaagactttcgacagcgaatatattaagacacgcaccaatgattgggactttgtggttacgactgatataagtgagatgggcgcaaacttcaaagctgagcgtgtgatcgacccaagacggtgtatgaagcccgtcattctcacagatggcgaagagagggtgatcttagccgggcctatgccggttacccattccattgcagcccagcgccgaggaagagtgggtcggaatcccaagaacgaaaatgaccagtacatctacatgggcgagcccctggaaaacgatgaggactgcgctcactggaaggaggccaaaatgcttctggacaacataaatacccctgaagggatcattcccagcatgtttgagccagaaagggagaaggtcgatgcgatcgacggagaatatcgcctcagaggcgaggcaaggaaaactttcgtggatttgatgcggcgtggtgacctgcctgtatggctcgcctaccgcgtggctgccgaggggattaactatgctgatcgaagatggtgttttgacggcgttaagaataaccaaatcctggaagagaatgtcgaagtggagatatggacaaaggagggagaaaggaagaaacttaaaccccggtggctagatgcacgcatttactctgacccactggccttgaaagagttcaaagagttcgctgccggcagaaagtcattaaccctgaacctcatcacagagatggggaggctgcctacttttatgacgcagaaggcacggaatgcgcttgataacctggccgtgctccataccgctgaagccggaggtcgagcatataatcacgctttgtccgagctgccggagacactagaaactctgctccttctgaccttattggccacagtcaccggcgggattttcctgtttctcatgagtggaaaaggcatcggtaagatgactctggggatgtgctgcataatcacggcaagcgttcttctgtggtacgcccagattcagccccactggatcgctgcgtcgattatcctcgagttctttttgatagtgctgttaattccagaacctgagaaacaaagaacaccacaggacaaccagctaacatatgtagtgatcgccatcctgactgtcgtggcagctaccatggccaatgaaatgggcttcctcgagaagaccaagaaggattttggacttggctctattgccacccagcaaccagagtccaacatcctggacatagatttgcgccctgcaagcgcttggactctgtacgccgttgcgacaacgttcattacccccatgctcaggcattcaatcgaaaatagttctgtgaacgtctccctgactgctattgccaatcaggcaacagtacttatggggctcggaaagggttggccgctgagcaaaatggacatcggcgtgccattgctggccatagggtgttactcacaggttaaccctatcaccttaaccgctgcactactgctccttgtggcccactatgcgattatcggacccggcctgcaggctaaggccacacgggaggcacaaaaacgtgccgctgccggtattatgaagaatccaactgtcgacgggatcacggtgattgatttggaccccatcccttacgatccgaaatttgaaaagcagctgggccaggtcatgctcctggtgctttgcgttacccaggtgttaatgatgagaacaacttgggcactgtgtgaggctctcaccttggccacaggacccataagtaccctgtgggaaggcaacccagggaggttctggaacactacgattgcggtaagcatggccaatatctttcgcggatcctatctagcaggcgctggtctactcttctctatcatgaagaacacagccaatacccggcgagggactggaaacaccggcgagacacttggtgagaaatggaagaatagactgaacgcattgggcaaaagcgaatttcaaatttacaagaaatccgggatacaggaggtggacaggactctggctaaggaaggaatcgagcgcggcgagaccgatcatcacgccgtctcacgggggtctgccaaactcagatgcttcgttgaacgtaatctggtgacacctgagggaaaggtcgtggacttaggctgtggtagagggggatggagttattactgcggcggtcttaagaacgtaaaagaagtgaagggcctgacgaaagggggacccggccatgaggaacctattccaatgtcgacctatgggtggaatctcgttcggctacagagcggagtggatgtcttctttactccccctgagaagtgtgacacactgttgtgcgatatcggcgagtcctctccaaaccccaccgtggaagcgggtcgcactctgcgagtcctcaatcttgtggagaactggctgaaaaataacacacaattctgtattaaggttttgaatccgtacatgccttcagtaatcgaaaagatggaggctctgcagagaaaatacgggggagcactcgtgaggaacccattaagccggaactccacccacgaaatgtattgggtcagtaatgcctctggcaacatagtgagctcagttaatatgatctcccgcatgctgattaacagatttacgatgaggcacaagaaagctacctacgagcccgacgtggatcttggcagtgggacacgaaatatcggaattgagagcgaaatccctaacctggacataattggtaagcggatcgagaaaatcaagcaggaacatgagacttcttggcactatgatcaggaccatccatacaagacctgggcctatcacggctcctacgaaacaaaacaaactgggtcagcaagctcgatggtcaatggagtggtacgtctactcaccaagccctgggacgtgattccgatggttacacagatggccatgaccgatactacgcctttcggccagcagagagtctttaaagagaaggtggacacacgcacccaagagcccaaagaaggtactaagaagctgatgaaaataaccgctgagtggttgtggaaggaactggggaaaaagaaaacaccaaggatgtgcacgcgggaggagttcaccagaaaggtgcgctctaacgcggccctcggagcaatctttactgatgaaaataaatggaagagtgctagggaggccgtcgaagactccggcttctgggagcttgttgataaggaacgaaacctgcacttagagggcaaatgtgagacatgcgtgtataatatgatggggaagcgggagaaaaagctgggagagtttggtaaagcaaagggcagcagagccatttggtacatgtggttgggggctaggttcctcgaatttgaggccctgggattcctaaacgaagaccattggttttcacgcgaaaattccctttctggcgtagagggtgaagggctgcacaagctcggatacatcctgcgtgatgtgagcaaaaaggagggcggcgcgatgtatgcagacgataccgccgggtgggacactcggattacattggaagatctgaaaaacgaggaaatggtcaccaatcatatggagggagagcacaagaaactcgctgaagccatcttcaaacttacataccagaacaaggtggttagagtgcagaggcctactccccgcggtaccgtcctggacataatcagtcgacgggaccagagaggctccgggcaagtggtaacgtatggattaaacaccttcacaaatatggaggcacagctgattaggcagatggaaggcgagggtgtttttaaaagcatccaacatttgactgtgaccgaggaaattgctgtcaagaactggctcgcccgcgtggggagagagcggctgtctaggatggctatctcaggagatgactgcgtggtcaaaccactagatgaccgtttcgccagtgcacttacagcgctgaatgatatgggcaaggttcgaaaagacattcagcagtgggaaccctcccgcggctggaacgattggactcaggtgcctttttgtagccaccacttccatgagctcataatgaaggacgggagagtactggtggtcccatgccggaatcaagatgaattgatcggaagggcccgcatttctcagggtgctggctggtcgttaagagagaccgcctgtctggggaagtcatacgcacagatgtggagcctcatgtattttcaccggagggaccttcgactggctgccaacgcaatctgctccgccgtgccgagtcattgggttcccacgtctcgtacaacctggagcatccacgcgactcacgagtggatgacaaccgaagatatgctaactgtgtggaatagagtctggattcaggagaacccttggatggaagacaaaaccccagtggagtcctgggaagagataccctacctgggaaagcgcgaggatcaatggtgtggctcactcatcggtttgacaagtcgggctacgtgggccaaaaatattcagaccgcaatcaaccaggtaaggtctctgattgggaatgaagagtatactgactacatgcctagcatgaagagattccgccgggaagaggaagaggccggagttctttggtga

SEQ ID NO: 14265 - RNA, 9876 nt, synthetic construct
  misc_feature 1..9876: note = derived and/or modified CDS sequence (opt3) from DENV-2__AB189124__SS-prME
  source 1..9876: mol_type = other RNA
accgccggcgtgataattatgatgatacccacagtcatggctttccacctgactacgagaaacggggaacctcatatgatcgttagcaggcaggaaaagggaaaatccctcctttttaagaccgagaatggtgtgaacatgtgcacactgatggcaatggacttgggcgaattatgtgaggatactattacctacaattgcccactgctgcggcaaaacgaaccggaggacatcgattgttggtgcaattctacatcaacctgggtaacttatgggacatgtaccgccacgggagagcaccgccgagaaaaacgtagtgtggcgctcgctccccatgtcggcatgggtctggagactaggaccgaaacatggatgagctccgagggggcctggaagcacgcacagaggattgagacttgggtgcttcggcatcctggattcaccatcatggccgctatactggcatacacaatcggcaccacgtattttcagcgcgttttgattttcatcctcctgactgccgtggctccatctatgacaatgagatgcattggcatctcgaacagggactttgtcgaaggggtgtcaggaggtagctgggtagatatagttctggagcacggcagttgtgtgaccactatggccaaaaataagcccacactcgacttcgaattaattaagaccgaggcgaaacaccctgcaacgctgcggaagtactgcatcgaagccaaacttaccaacacaactaccgcttcccgctgtccaacacagggggagccctctttgaatgaggaacaagataagcgatttgtctgcaaacatagcatggtggacagaggatggggcaacggttgtgggctgttcggaaagggcggcattgtgacttgcgccatgtttacctgcaagaaaaatatggaggggaaggtcgttcagcctgaaaacctagagtatacaatcgtgatcaccccacactccggagaagagaatgcagtaggtaacgatactggcaaacatgggaaggagattaaagtgacgccgcagtcaagtataacagaagctgagctcaccggatacggcactgtcaccatggaatgtagccccaggacaggtctggacttcaatgagatggtgcttctgcagatggaaaacaaggcctggttggttcaccggcaatggtttctcgatctgcctttaccatggctgcccggggcggacacccagggctctaactggatccagaaagagactctcgtgacattcaagaatcctcacgccaagaaacaggatgtcgtggtacttggatcccaagagggcgcaatgcatacggctctgaccggggccactgaaattcagatgtcaagcggaaacttgctatttacaggtcacctgaagtgccgtctccgcatggacaaactgcagcttaagggcatgagttattctatgtgtaccgggaaattcaaggttgtgaaggagatcgctgaaacacaacatggaactatagtcattagagtgcagtacgagggcgacggttccccatgcaaaatccccttcgagatcatggatctggaaaagaggcacgtcttggggcggctcattaccgtgaatccgatcgttacggagaaagacagccctgtgaacattgaagccgagcccccatttggcgattcgtacataatcattggagtagaacctggccagctgaagttaaattggttcaaaaaggggtcttccatcggacagatgtttgagaccacaatgcgaggtgcaaagcgcatggccatcctgggcgacactgcttgggatttcgggtcactaggaggcgtctttaccagtattggtaaagcgctccatcaagtgttcggggcaatatatggcgccgcttttagcggagtttcctggacaatgaagatcctgattggcgtggtcatcacttggattgggatgaactctagaagcacctcacttagtgtgtccttggtactggtgggagttgtcacgctctacctgggcgtgatggtgcaggccgacagcggttgtgtcgtttcttggaaaaataaggagcttaaatgcgggtcaggaatcttcataacagataacgtgcacacctggactgaacagtataagtttcagcccgagagtccaagcaagctggcatccgccatccaaaaagctcacgaagagggcatttgtggtatcaggtctgtgacacggttggaaaatctcatgtggaagcagattacccccgagctgaaccatatcttatcggagaatgaagtaaaactgactataatgaccggcgacattaaggggatcatgcaggccggaaaacgcagcctaagacctcagccaacagagctcaagtactcctggaaagcatggggcaaggcgaagatgctgtcaacggaacttcacaaccataccttcttgattgatgggccggagactgctgaatgccccaatacaaacagggcctggaatagtctggaggtcgaggactatggatttggcgtgttcaccacaaacatctggctcaaactgaaggaacgtcaagatgtattttgtgactctaaattaatgagcgcagccataaaggacaaccgggctgtgcacgccgatatgggttactggatcgagtccgcactgaatgacacttggaaaattgaaaaggcttcattcatcgaggtcaagagctgccactggcctaaatctcataccctttggtccaacggggtgttggagagtgaaatgattatcccaaagaatttcgccggacccgttagccagcacaactatcgacctggctaccatacgcagacagcgggtccatggcacctcggcaaactggagatggattttgacttctgtgaagggaccactgtggtagtcaccgaggattgcggaaatagaggcccctctctaaggacaactaccgcctccgggaagctgataacagaatggtgctgtcgctcatgcacgctcccgcctctgcggtacagaggagaggacggctgttggtatggtatggagattaggccacttaaagaaaaggaggaaaacttggtgaatagtctggtgaccgctgggcatggacagatcgataactttagcttaggcgtcctcggtatggcactgttccttgaggaaatgctgcgcactcgagttggcacaaagcacgccatcttgctcgtggctgtatcgtttgtgaccctgattactgggaatatgtccttccgggacctaggacgtgtcatggtgatggttggcgccacaatgaccgatgacatcgggatgggagtgacgtacctggcactcctggcggcctttaaagtcagacccactttcgctgccggccttttgctgaggaagttaacctctaaagagctcatgatgacaaccattggtatagtgctgcttagccaatcaactatccctgagacaattctggaactaaccgatgcactcgctctggggatgatggttttgaagatcgtgcgcaacatggagaaatatcagctggccgtcacaattatggcaatcttatgcgtacccaatgccgtgatactccagaacgcttggaaggttagttgtactaccctggcggtggtctccgtgtctccacttctgttgacgagctcccaacagaaggccgactggatccctctcgcactgacaattaaaggactaaatcccaccgctatctttctgactaccctttcacggacaagcaagaaaagaagttggccactcaacgaagccattatggccgtaggcatggtgtctatcctggcttccagcttgctgaagaatgatataccgatgactggccctttagtcgcagggggactcctgaccgtttgctacgtgcttacgggtaggtcggccgacctggagttggaacgagcggctgacgtgcgctgggaggagcaggccgaaatttcaggctctagtcccatcctctccatcacaattagcgaggatgggtctatgagcatcaagaacgaagaggaggaacagaccctgactatcctaattcggacaggactgcttgtcatctccggcctcttcccagtgtcaattcccatcaccgcagccgcttggtatctgtgggaggttaagaaacaaagagcaggggttttgtgggacgtgcctagtccaccccctgtcgggaaggccgaattagaggatggagcgtacaggataaagcagaaaggcatcctgggctatagccagattggggctggagtgtacaaggaaggtacttttcacacaatgtggcatgttacccgtggcgccgtgctcatgcacaaagggaagcgcatcgagccgtcttgggcagacgtcaaaaaggatctgatttcctacggaggcggttggaaacttgagggggaatggaaagagggagaagaggtgcaggtactggccttggaaccaggcaagaacccccgggctgtccaaacgaaacctggcctattcaagactaataccgggacaatcggagccgtgtcactggactttagtccaggtaccagcggctcccccatagttgataaaaaggggaaggtggtcggactctatggcaacggtgtggttacaagatctgggacttacgtgtcggcaattgctcagaccgagaaaaatatcgaggacaaccctgaaatcgaggatgacattttcaggaagaaacgactgacgatcatggatcttcatccgggagccggcaagacaaaacggtatttacccgcgatagtccgcgaagccattaagagaggcctgaggactctcatcttggcaccaacccgggtggtagctgccgagatggaagaggctctgcgagggctccctattagataccagacacccgcaatccgcgccgagcacaccggaagggaaatagtggacctgatgtgtcatgccactttcaccatgcgtcttctgagcccaattcgggttcctaattataacttgatcatcatggatgaggctcactttacagaccccgcgtcaattgcagccagaggttacatctccacgagggtcgaaatgggcgaggctgccgggattttcatgactgcaaccccaccgggaagtcgcgacccttttccccagtctaatgccccaataatggatgaggaacgagagatccccgaaagaagctggaactccggccacgagtgggtgacagacttcaagggtaaaaccgtgtggtttgtcccttcaattaaggctgggaatgatatcgcggcctgcctacggaaaaacggaaagaaagtaatccaactgtctaggaagactttcgacagcgaatatattaagacacgcaccaatgattgggactttgtggttacgactgatataagtgagatgggcgcaaacttcaaagctgagcgtgtgatcgacccaagacggtgtatgaagcccgtcattctcacagatggcgaagagagggtgatcttagccgggcctatgccggttacccattccagcgcagcccagcgccgaggaagagtgggtcggaatcccaagaacgaaaatgaccagtacatttacatgggcgagcccctggaaaacgatgaggactgcgctcactggaaggaggccaaaatgcttctggacaacatcaatacccctgaagggataatcccctctatgtttgagccagaaagggagaaggtcgatgcgattgacggagaatatcgcctcagaggcgaggcaaggaaaactttcgtggatttgatgcggcgtggtgacctgcctgtatggctcgcctaccgcgtggctgccgaggggatcaactatgctgatcgaagatggtgttttgacggcgttaagaataaccaaattctggaagagaatgtcgaagtggagatctggacaaaggagggagaaaggaagaaacttaaaccccggtggctagatgcacgcatatactcagacccactggccttgaaagagttcaaagagttcgctgccggcagaaagtccttaaccctgaacctcattacagagatggggaggctgcctacttttatgacgcagaaggcacggaatgcgcttgataacctggccgtgctccataccgctgaagccggaggtcgagcatataatcacgctttgagtgagctgccggagacactagaaactctgctccttctgaccttattggccacagtcaccggcgggatcttcctgtttctcatgagcggaaaaggcattggtaagatgactctggggatgtgctgcatcataacggcatcggttcttctgtggtacgcccagatccagccccactggattgctgcgtctatcattctcgagttctttttgatcgtgctgttaataccagaacctgagaaacaaagaacaccacaggacaaccagctaacatatgtagtgattgccatcctgactgtcgtggcagctaccatggccaatgaaatgggcttcctcgagaagaccaagaaggattttggacttggctccatcgccacccagcaaccagagagcaacattctggacatcgatttgcgccctgcatcagcttggactctgtacgccgttgcgacaacgttcataacccccatgctcaggcatagtattgaaaattcttccgtgaacgtcagcctgactgctatcgccaatcaggcaacagtacttatggggctcggaaagggttggccgctgtcaaaaatggacattggcgtgccattgctggccatcgggtgttacagtcaggttaaccctataaccttaaccgctgcactactgctccttgtggcccactatgcgatcattggacccggcctgcaggctaaggccacacgggaggcacaaaaacgtgccgctgccggtatcatgaagaatccaactgtcgacgggattacggtgatcgatttggaccccattccttacgatccgaaatttgaaaagcagctgggccaggtcatgctcctggtgctttgcgttacccaggtgttaatgatgagaacaacttgggcactgtgtgaggctctcaccttggccacaggacccatcagcaccctgtgggaaggcaacccagggaggttctggaacactacgatagcggtatccatggccaatatttttcgcggatcttatctagcaggcgctggtctactcttcagcatcatgaagaacacagccaatacccggcgagggactggaaacaccggcgagacacttggtgagaaatggaagaatagactgaacgcattgggcaaatccgaatttcaaatctacaagaaatcagggattcaggaggtggacaggactctggctaaggaaggaatagagcgcggcgagaccgatcatcacgccgtctctcgggggagtgccaaactcagatggttcgttgaacgtaatctggtgacacctgagggaaaggtcgtggacttaggctgcggtagaggtgggtggtcgtattactgtggcggtcttaagaacgtaaaagaagtgaagggcctgacgaaagggggacccggccatgaggaacctatcccaatgagcacctatgggtggaatctcgttcggctacagtccggagtggatgtcttctttactccccctgagaagtgcgacacactgttgtgtgatattggcgagtcttcaccaaaccccaccgtggaagcgggtcgcactctgcgagtcctcaatcttgtggagaactggctgaaaaataacacacaattctgcatcaaggttttgaatccgtacatgcctagcgtaattgaaaagatggaggctctgcagagaaaatacgggggagcactcgtgaggaacccattatcccggaacagtacccacgaaatgtattgggtctctaatgccagcggcaacatcgtgtcatccgttaatatgataagtcgcatgctgatcaacagatttacgatgaggcacaagaaagctacctacgagcccgacgtggatcttggcagcgggacacgaaatattggaatcgagtctgaaattcctaacctggacatcataggtaagcggattgagaaaatcaagcaggaacatgagacttcctggcactatgatcaggaccatccatacaagacctgggcctatcacggctcatacgaaacaaaacaaactgggagcgcatcgtctatggtcaatggagtggtacgtctactcaccaagccctgggacgtgatcccgatggttacacagatggccatgaccgatactacgcctttcggccagcagagagtctttaaagagaaggtggacacacgcacccaagagcccaaagaaggtactaagaagctgatgaaaattaccgctgagtggttgtggaaggaactggggaaaaagaaaacaccaaggatgtgtacgcgggaggagttcaccagaaaggtgcgcagtaacgcggccctcggagcaatatttactgatgaaaataaatggaagtccgctagggaggccgtcgaagacagcggcttctgggagcttgttgataaggaacgaaacctgcacttagagggcaaatgcgagacatgtgtgtataatatgatggggaagcgggagaaaaagctgggagagtttggtaaagcaaagggctcaagagccatctggtacatgtggttgggggctaggttcctcgaatttgaggccctgggattcctaaacgaagaccattggttttcccgcgaaaattctcttagcggcgtagagggtgaagggctgcacaagctcggatacattctgcgtgatgtgagtaaaaaggagggcggcgcgatgtatgcagacgataccgccgggtgggacactcggatcacattggaagatctgaaaaacgaggaaatggtcaccaatcatatggagggagagcacaagaaactcgctgaagccattttcaaacttacataccagaacaaggtggttagagtgcagaggcctactccccgcggtaccgtcatggacatcatatcccgacgggaccagagaggcagcgggcaagtggtaacgtatggactgaacaccttcacaaatatggaggcacagttaatcaggcagatggaaggcgagggtgtttttaaatctattcaacatctgactgtgaccgaggaaatcgctgtcaagaactggttggcccgcgtggggagagagcggctctcaaggatggctattagtggagatgactgcgtggtcaaaccactggatgaccgtttcgcctccgcactaacagcgcttaatgatatgggcaaggttcgaaaagacatccagcagtgggaacccagccgcggctggaacgattggactcaggtgcctttttgctctcaccacttccatgagctgattatgaaggacgggagagtactcgtggtcccatgtcggaatcaagatgaactgataggaagggcccgcatctcgcagggtgctggctggtcattgagagagaccgcctgcttaggaaagagctacgcacagatgtggtccctgatgtattttcaccggagggacctccgacttgctgccaacgcaatttgtagtgccgtgccgtctcattgggttcccacgagccgtacaacctggtccatccacgcgactcacgagtggatgacaaccgaagatatgctgactgtgtggaatagagtctggatccaggagaacccttggatggaagacaaaaccccagtggagtcatgggaagagattccctacctaggaaagcgcgaggatcaatggtgcggcagtctgataggtctcacatctcgggctacgtgggccaaaaatatccagaccgcaattaaccaggtaaggagcttgatcgggaatgaagagtatactgactacatgccttccatgaagagattccgccgggaagaggaagaggccggagttctgtggtga

SEQ ID NO: 14266 - RNA, 9876 nt, synthetic construct
  misc_feature 1..9876: note = derived and/or modified CDS sequence (opt3) from DENV-2__AB122020__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataagcttcaactgaaagggatgagctacagtatgtgtactggaaagttcaagatcgtcaaagaaatcgctgagacccagcacggcacgattgtgatcagagtacagtatgagggtgacgggtctccatgcaagattcccttcgaaataaccgatttggagaaaaggcatgttctcggccggctgatcacagtgaacccgattgtcactgaaaaggactcccctgtgaacatcgaggccgaacccccatttggagatagctacatcattgtcggcgtggagcctgggcagttaaaactgaattggttcaagaagggatcgtctataggtcaaatgtttgagaccacaatgcgaggcgctaaacgcatggccatcctaggggacactgcatgggatttcggatccctcggcggtgtttttacctcaattgggaaggccctgcaccaggtgttcggcgctatctacggagcggcatttagtggcgtaagctggacgatgaaaattcttatcggggtcataatcacatggattggaatgaactccagatctaccagcttgtcagtgagtctggttctcgtgggcgtcgtgactctgtatcttggtgccatggtacaggctgactccgggtgtatcgtgagctggaagaataaagaactgaagtgcggatctggcattttcatcacagataacgttcacacctggactgagcagtacaagtttcaacccgaatcaccaagtaaattggccagcgcaatacagaaggcccatgaggaaggtatttgtggcatcaggtccgtcacccggctcgagaatctgatgtggaaacagattacacccgagttaaaccacatcctgtctgaaaatgaggtgaagctaacgataatgaccggggacatcaaaggaattatgcaggctggcaagcgctcgctcagacctcaaccaactgaactgaaatatagctggaagacatgggggaaggccaaaatgctttccaccgagtcacataaccagacattcttgatcgatggaccggaaactgcagagtgccccaataccaacagggcgtggaatagtctggaggtggaagactacggctttggtgtcttcacgacaaacatttggctcaagctgcgtgagaaacaggacgttttttgtgattctaagttaatgagcgctgccatcaaagacaatcgggcagtgcacgccgatatggggtattggatagaatccgctctgaacgacacctggaagatggagaaggcctcattcattgaggtgaaaagctgccactggcctaagtctcatactctttggtccaatggagtattggaaagtgagatgatcatcccaaaaaacttcgcaggccccgtcagccagcacaactaccgacctggttatcatacccaaacagctggcccatggcacctcgggaagctggaaatggattttgacttctgtgagggaactaccgtggttgtgacagaagattgcggcaatagagggccctctctaaggacgaccactgcctccggaaaactgattacagagtggtgctgtcgctcatgcaccctcccgcctctgcggtacagaggcgaggacggttgttggtacgggatggaaatcaggccacttaaggagaaggaagagaacttggtcaatagtctggtgactgcgggacatggccagattgataactttagcttaggtgttctcggcatggccctgttccttgaagagatgctgcgcacacgagtggggaccaaacacgctatattgctcgtagcactgtcgtttgtcacgctaatcactggaaatatgtccttccgggacctgggccgtgtgatggtgatggtcggggccaccatgacagatgacattggaatgggcgttacctatctcgctctgcttgccgcatttaaggtgagacccactttcgcggccggtttgctgttaaggaaactcacatctaaggagctgatgatggctaccatcgggattgcccttctgagccagtcaacactacctgaaactatcctcgagctgaccgatgcattggctctgggaatgatggtattaaaaatagtgcgcaacatggaaaagtaccaactcgccgtcacgatcatggcaattagttgcgtgcccaatgccgttatcctgcagaacgcttggaaggtgtcctgtacaattcttgcggccgtctctgtgagcccactgttgctcacctcctcacagcagaaagcagactggatccctctggctctaactataaagggcctgaatcccaccgccatttttcttacaactctcagccggaccagtaaaaagagatcttggccactgaacgaggccatcatggctgttggcatggtgtccatcttggcaagctcgctgttaaaaaatgacattccgatgacggggcctctcgtcgccggaggtctgcttacagtatgctatgtgctgaccggcaggtcagcggatttggaactcgagcgagctgccgacgttaagtgggaggatcaagcagaaatatctgggagttcccccatcctgagcattactatctctgaggacggaagcatgtccattaaaaacgaagaggaggaacagacactaaccatcctgatacgcactggccttctcgtgatctcaggtgtcttcccagtgagtattcccatcacagccgctgcatggtacctgtgggaggtaaagaagcagcgggccggggtgttgtgggatgtccctagcccaccccctgttggaaaagcggaattagaggacggcgcttatagaattaagcagaggggcatcctggggtactctcaaataggagccggtgtgtataaagaaggcacctttcacacgatgtggcatgtgactcgtggggcagtcctcatgcaccgcggaaagcggattgagccgtcctgggccgatgtgaaaaaggacctgatctcatacggcggtgggtggaagcttgagggagaatggaaagagggcgaagaggttcaggtactggctttggaaccaggcaagaatcccagagccgtgcagaccaaacctgggatcttcaagacaaacaccggaacaattggtgcagtcagtctagattttagcccaggcacttccgggtctcccatcgtggacaggaaaggaaaggttgtgggcctgtacggtaatggggtcgtgacccgatcgggagcttatgtaagcgccatagcgcagacggagaagtcaattgaggataaccctgaaatcgaggacgatattttccggaaaaagcgcctcacaatcatggacctgcatccgggcgccggcaaaactaagagataccttcccgcaatagtcagggaagctattaaacgggggttacgaaccctgatcctcgccccaacaagagtggttgctgcagagatggaagaggccttgcgcggactgcctatcaggtatcaaacccccgccattcgtgctgagcacactggtcgggaaatcgtggacctcatgtgtcatgcgaccttcacaatgagactgctttccccagtcagggtgcctaactacaatctgattataatggatgaggcacactttacggaccccgccagtatcgctgcccgcggctatatttctactcgagttgaaatgggggaggcagccggaatcttcatgaccgctacaccaccgggcagcagagatccttttccccagtccaacgcgccaatcatggacgaggaacgggagattcccgaaaggtcatggaattctggtcacgagtgggtgaccgatttcaaggggaagactgtctggtttgtgcctagcataaaagccggaaacgacatcgcagcttgcttgcgcaagaatggcaaaaaggtaattcagctaagtcgtaaaacattcgattccgaatacgtgaagaccagagccaacgactgggattttgttgtcacgactgacatcagcgagatgggcgcaaatttcaaggccgagcgggtgattgatccaaggcgctgtatgaaacccgtgatcctgacagacggggaagagcgagtcatactcgctggacctatgccggtaacccattcttcagccgcgcaaagacggggtaggatcggccgcaacccaaagaatgaaaacgaccagtatatttacatgggggagcccttagaaaatgatgaggactgcgcacactggaaagaggccaagatgctgcttgataacatcaatacccctgaaggaattatcccctccatgtttgagccagaaagagagaaagtggacgctatagatggcgaatacaggctgcggggtgaggcccgtaagactttcgttgacctcatgcgccgaggggatttgcctgtgtggctggcttataaagtcgcagccgagggcattaactacgctgacagaaagtggtgttttgatggaatcaagaataaccagattctcgaagagaacgtggaagttgagatctggacaaaagagggcgaaaggaagaaactgaagccccggtggcttgacgcccgcatatatagtgatccactagcactgaaagagttcaaggaattcgcggccgggagaaagagcttgaccttaaatctgatcacagagatgggaaggctccctacttttatgacgcagaaagctcggaacgccctggacaatcttgcagtgctgcataccgctgaagtcggtggccgagcctacaaccacgcactctcggagttgccggagacactggaaactctactgctccttaccctgttagccacagtgaccgggggaattttcttgtttctgatgtctggcaagggtatcgggaaaatgactctcggcatgtgctgcattatcacggcttccatactgctttggtatgcgcaaattcagccccactggatcgccgcaagcatcattctggagttctttctcatcgtattgctgataccagaacctgagaagcagagaaccccccaggataatcaattaacatacgtggttattgctatcctaactgtcgtggccgccaccatggcaaacgaaatgggattcctggagaaaacaaagaaggacctcggctttgggtcaattaccactcaggagagtgaatctaatatccttgacatagatctgcgcccagcttccgcctggacattgtatgcggtggctacgaccttcgtcactcctatgctgaggcatagcatcgagaactcaagtgttaatgtgagcctcacagccattgcaaaccaggccaccgtactgatgggacttggtaaaggctggcccctctccaagatggacatcggggtgccgctgttggctattggatgttactctcaggtcaatccaatcaccctgacagcagccttactactgctcgtggcgcactacgctattatcggccctggtcttcaagccaaagcaactcgggaagcccagaagcgtgctgccgcagggataatgaaaaaccccacggttgatggcattaccgtgatcgacctggagccaatcccctatgatcctaagtttgaaaagcagttgggacaggtcatgctgctcattctgtgcgtaacacaagtgcttatgatgagaactacctgggctttatgtgaggccctgacactcgcgaccggcccgataagcactttgtgggaggggaatcccggaaggttctggaacacgacaatcgccgtttccatggcaaatatttttcgcggctcatacctggctggtgccgggctactgttctctatcatgaaaaacaccactaatacccggcgaggaacaggcaacgtgggtgaaactctcggcgagaagtggaaaagtagacttaacgcactggggaagtcggaatttcagatttataaaaagagcggaatccaggaggtcgacaggaccttggctaaagagggcataaagcgcggggaaacagatcatcacgccgtgtcccggggatctgccaagctgagatggttcgtcgagcgtaatatggtgacgccagaaggcaaagttgtggacctcggttgcgggaggggaggctggtcatactattgtggtggcctgaagaacgtacgggaggtgaaagggttaaccaagggaggccctgggcatgaagagcccatccctatgagcacttacggatggaatcttgtccgcctgcaatccggcgttgatgtgttctttacaccacccgagaaatgcgacaccctcctatgtgatattggtgaaagttctcctaacccaactatcgaggcggggcgaacactgagagtcttgaatctggtggaaaactggctcaataacaatacccagttctgcattaaggtacttaacccctatatgccgagcgtgatcgagaagatggaaacgctgcagaggaaatacggaggcgctttggttcggaatcctctgtcacgcaactccacccacgagatgtactgggtgagtaatgcaacaggcaacatagtcagctctgtgaatatgatttccagaatgctcatcaacaggtttactatgaagcacaaaaaggccacctatgagccagacgtcgatttagggtcaggaacacgaaacatcggtattgaaagcgagatacccaatctggacatcattggcaaacggatcgaaaagattaagcaggagcatgaaacttcgtggcactacgaccaagatcatccttataaaacctgggcttaccacgggtcttatgagacaaagcagaccggaagtgcctccagcatggtgaacggcgttgtacgtcttctgactaaaccatgggacgtggtccccatggtgacgcagatggcaatgacagataccactccgttcggtcagcaaagagtttttaaggagaaagtggacacccgcacacaggaacctaaggaggggacgaagaaactaatgaagatcaccgccgaatggctctggaaagagctgggaaaggagaaaactcccaggatgtgtacacgggaagagttcaccagaaaggtccgctcaaatgctgcgttgggcgccatatttactgatgaaaacaaatggaagtccgcaagggaggctgtggaagacggccgattctgggagctggtagatcgggagagaaatctccaccttgaagggaagtgcgagacatgtgtgtacaacatgatgggaaaaagggaaaagaaactgggtgagtttggcaaggccaaagggtctcgcgcaatctggtatatgtggttaggagcccgtttcctggaatttgaggctttgggcttcctcaatgaggaccattggtttagccggggtaacagtctgtccggggttgaaggagagggcctacacagacttggctacattctgagggaagtcgggaagaaggagggaggtgccatgtacgcggatgacaccgcaggctgggatacacgcatcactctcgaagacctgaaaaatgaggagatggtgaccaaccatatgaagggggaacacaaaaagttggccgaggctattttcaaactgacgtatcagaataaggtggtccgagttcagcggccaacccctagaggaacagtgatggacatcattagcaggaaggatcaacgcggctctggtcaggtagggacttacggactcaacaccttcacaaatatggaagcccagcttataagacaaatggagggcgagggcatctttaaatcaattcagcatctgactgcaaccgaagagatcgctgtgcagaactggttagcccgggtcgggagggaacgtctgagtcgaatggctatctccggagacgattgcgtggttaagcccattgacgatcgcttcgccagcgcattgacggcgctcaatgacatgggtaaagtgagaaaggatatacagcaatgggagccatctcggggctggaacgactggacacaggtccccttttgctcgcaccacttccatgaactggtgatgaaagatgggagggtactagttgtgccttgtcgcaaccaggacgagcttatcggaagagcccggatttcacagggcgctggttggagcctgaaggagaccgcctgcctcgggaagtcctatgcacaaatgtggactctgatgtactttcacaggcgagatttgcgtttagctgccaatgcaatctgtagtgccgtcccatctcattgggtgccgacaagcagaaccacttggtccattcacgcgaaacacgaatggatgaccacagaggacatgctggctgtgtggaaccgcgtctggatccaggaaaatccctggatggaggataagacgcctgttgaatcatgggaggaggtgccatatctcggaaaacgggaagaccagtggtgcggcagtcttataggcctgacctctagggccacttgggcaaagaacatccagacagccattaatcaagtaagaagcctaatcgggaacgaggaatacaccgactatatgccctccatgaaacgcttccggagggaggaagaggaggctggagtgctgtggtga

SEQ ID NO: 14267 - RNA, 9876 nt, synthetic construct
  misc_feature 1..9876: note = derived and/or modified CDS sequence (opt3) from DENV-2__LC121816__SS-prME
  source 1..9876: mol_type = other RNA
accgtgggcatgatcattatgctgatacccacagccatggctttccacctcactacgagaaacggggagcctcatatgatcgtcagcaggcaggaaaagggaaaatcccttctgtttaagaccgaggacggtgttaatatgtgcacattgatggcaatggatttaggcgaactgtgtgaggacactgtgacctacaactgcccactactccggcaaaatgaaccggaggatattgactgttggtgcaactctacatcaacctgggtaacttatgggacatgtaccgccacgggagagcaccgccgagaaaaacgtagtgtggcgctggtcccccatgtgggcatgggtcttgagactagaaccgaaacatggatgagctccgagggggcttggaagcacgcccagaggatcgagacttggattctgcggcatcctggattcaccatcatggcagccatattggctcacacaatcggcaccacgtactttcagcgcgttctcattttcatcctgctgactgcagtggccccatctatgacaatgagatgcattggcatctcgaatagggattttgtcgaaggggtgtcaggaggtagctgggtagacatagttctcgagcacggcagttgtgtgaccactatggctaaaaacaagcccacattagatttcgaactgattaagaccgaggccaaacagcctgcgacgcttcggaagtattgcatcgaagcaaaattgaccaatacaactaccgcctcccgctgtccaacacaaggggagccctctctgaacgaggaacaggacaagcgatttgtctgcaaacatagcatggtggatagaggatggggcaatggttgtgggctattcggaaagggcggcattgtgacttgcgctatgtttacctgcaagaaaaacatggaggggaagatcgtccagcctgaaaatctcgagtacacaatcgttattaccccacactccggagaagagaacgccgtgggtaatgacactggcaaacatgggaaggaggtaaaagtgacgccgcagtcaagtataacagaagcagagctgaccggatatggcactgtcaccatggaatgtagccccaggacaggtcttgatttcaacgagatggtgctgttgcaaatggaaaataaggcttggctcgttcaccggcagtggtttctggacttacctctgccatggctccccggggccgatacccagggctctaactggatccagaaagagactcttgtgacattcaagaaccctcacgcgaagaaacaagacgtcgtggtactgggatcccaggagggcgccatgcatacggcattgaccggggctactgaaattcagatgtcaagcggaaatctactgtttacaggtcacctcaagtgccgtctgcgcatggacaaacttcaactgaagggcatgagttactctatgtgtaccgggaaattcaaggttgtgaaggagatcgccgaaacacagcatggaactatagtcattagagtgcagtatgagggcgatggttccccatgcaaaatccccttcgagatcatggacttggaaaagaggcacgtcctcgggcggctgattaccgtgaacccgatcgttacggagcgagatagccctgtgaatattgaagctgagcccccatttggcgactcgtacataatcattggagtagaacctggccagttaaaactgtcttggttcaagaaagggtcctcaatcggacaaatgtttgagaccacaatgcgcggtgccaagagaatggcaatcctaggcgatactgcctgggacttcgggagtctcggaggcgtctttaccagcattggtaaggctctgcatcaggtgttcggggcgatatacggcgcagccttttccggagtttcttggacaatgaaaatccttattggcgtggtcatcacttggattgggatgaacagcaggtcaaccagtttgtccgtgagcctggtactcgtgggagttgtcacgctgtatcttggcgtgatggtgcaggctgattctggttgtgtcgtttcatggaagaataaagagctgaagtgcgggagtggaatcttcataacagacaacgtgcacacctggactgaacagtacaaatttcaacccgagagcccatccaagttggcctctgcaatccagaaggcctatgaagagggcatttgtggtatccggtcggtgacacgcctcgaaaatctgatgtggaaacagattacccccgagttaaaccacatcctgagcgagaatgaagtaaagctaactataatgaccggcgatattaaagggatcatgcaggctggaaagagatccctcaggcctcaaccaacagagctgaaatactcatggaagacgtggggcaaagccaagatgcttagtaccgaacatcacaaccagactttgctgattgacgggccggagacagcagaatgccccaataccaaccgtgcgtggaattctctcgaggtcgaggattatggattcggcgtgtttacaactaacatctggctgaagttaaaagaacggcaggacgttttctgtgacagcaagctgatgtccgctgccataaaagataatcgagcagtgcatgccgacatgggttactggatcgagtcagctcttaacgatacctggaagattgaaaaagccagctttatcgaggtcaagtcttgccactggcctaagtcccacacgttgtggagtaacggggtgctcgagagcgaaatgattatcccaaaaaatttcgcaggacccgtttctcagcataactatagacctggctaccacacacaaaccgctggtccatggcatctgggcaagctagagatggacttcgatttttgtgaagggactaccgtggtagtcacagaggactgcggaaataggggcccctccctgcgcactaccacagcctcagggaaactcataacggaatggtgctgtcggagttgcaccctgccgcctcttagatacaggggagaggatggctgttggtatggtatggagattcgcccattgaaggaaaaagaggaaaacctggtgaatagcttagtgactgcggggcacggacagatcgacaacttctcgctcggcgtcctgggtatggccctttttctggaggaaatgttgcgaacacgggttggcaccaagcatgctctcctgctagtggcagtatccttcatgactctgatcacagggaatatgtcttttcgtgatctcggaagagtgatggtcatggtgggcgccgctatgaccgacgatattgggatgggagttacgtacctggcccttttggcagcgttcaaggtgaggcccacttttgccgctggcctgttactccgcaaactgaccagcaaggagcttatgatgacaaccatcggtattgtcctgctatcacagagtactatacctgagacaatcctcgaactgaccgacgccttggcactggggatgatgattttaaaaatcgtgcggaacatggagaagtatcaactcgctgttacaattatggccatcctgtgcgtgcccaatgcagtcatacttcagaacgcctggaaagtatcctgtactatcctggctgtggtttctgtgaccccattgctcctgacgagctccagacagaaggcggattggattcctctagccctgacaatcaagggacttaatcccaccgcaattttcctcactaccctgtcaaggacaaacaaaaagcgaagctggccattgaatgaagctatcatggccgtcggcatggtgagtatactggcctcttccttactcaaaaacgacattccgatgactggccctctggtagctgggggacttctgaccgtgtgctacgtcttgacgggtcgcagcgcagacctcgagctggaacgggccgcggatgttagatgggaggaccaggctgagatctcgggctcatctcccatcctaagtattacaatatccgaagatgggagcatgtctatcaagaatgaggaagaggagcaaaccctgactattcttatcaggacaggactcctggtgattagcggcttgtttccagtgtccatccccataaccgccgcagcctggtatttatgggaagtcaaaaagcagcgtgctggtgtgctgtgggacgttccttcaccaccccctgtagggaaagcagagctcgaagatggagcctaccgcatcaagcagaagggcattctgggctatagtcagatcggggcgggagtgtacaaagagggtactttccacacaatgtggcacgtcacccggggcgctgtgcttatgcataaggggaaaagaattgaaccgagctgggccgacgttaggaaggatctgatctcttacggaggcggttggaaattggagggggagtggaaggaaggagaggaagtgcaagtcctagcactggagccaggcaagaacccccgagccgtgcagacgaaacctggcctctttaagactgacaccgggacaataggagctgtatccctggatttctcaccaggtaccagtggcagccccattgtcgacaaaaaggggaaagtggttggactttatggcaacggtgtggtcacacggtccgggacttacgtgtctgccatcgcacagaccgaaaagtcgatcgaggataatcctgagattgaagacgatatctttcgcaagagaaggttaacgataatggacctgcacccgggagctggcaaaacaaagcggtatctccccgccattgttcgagaggcgatcaaaagaggcttgcgcactctgattctcgccccaaccagggtggtcgcagctgaaatggaggaagccctgcgtgggcttcctatccggtaccagacacccgctataagagcagagcataccggaagggagattgtggacctgatgtgtcacgccactttcaccatgcgcttgctaagcccagtacgagtgcctaactataatctgatcatcatggatgaagcccatttcacagaccccgcttcaattgcggcaagaggttacatctccacgcgggttgagatgggcgaagccgctgggatttttatgactgccaccccaccgggaagtagggatcctttcccccaatctaacgcaccaataatggacgaggagcgcgaaatccccgagcgtagctggaattccggccacgaatgggtcacagattttaagggtaaaaccgtgtggttcgtgccttcaattaaggccgggaacgacatcgctgcgtgcctcagaaagaatggaaaaaaggtcatccagttatctcggaaaacttttgatagcgagtatattaagacaaggaccaacgactgggatttcgtagtgacgactgacataagtgaaatgggcgccaattttaaagcagagcgcgttatcgatccacgaagatgtatgaagcccgtgattctgacagacggcgaggaacgggtcatccttgctgggcctatgccggtgacccactccagcgccgcacagaggcgcggaagaattggtaggaacccaaagaatgagaacgaccaatacatctacatgggcgaacccctggagaatgatgaagactgcgcccattggaaagaggctaagatgctcttggataacataaatacccctgaggggatcattccctctatgttcgaaccagagcgggaaaaagttgacgccatcgatggagagtatcgtctgcgcggcgaagcgcgaaagacttttgtggacctcatgagaaggggtgatctgcctgtctggcttgcataccgggtggccgctgaggggattaactatgccgaccgcagatggtgtttcgatggcgtaaaaaacaatcagatcctagaggaaaacgtggaggttgaaatatggacaaaggagggagagaggaaaaagctgaagccccggtggttggacgctcgaatttactcagatccattagcactgaaagaatttaaggagttcgccgctggcagaaaatccctcaccctgaatcttatcacagaaatggggcgcctgcctactttcatgacgcagaaggccaggaacgcactcgacaatttggcggtcctgcacaccgccgaggctggaggtcgggcctataaccatgcactaagtgaactgccggagacactcgagactcttctgttattgaccctgctcgctacagtgaccggcgggatttttctgttccttatgagcggaaaaggcatcggtaagatgactctggggatgtgctgcataatcacggcctcgattctcttgtggtacgcacagatccaaccccactggattgccgcttctatcatactggaatttttcttaattgtgctactgatcccagagcctgaaaagcagcgtaccccccaggataatcagctcacatatgtcgttatcgcgattcttactgtggtagccgcaaccatggctaacgagatgggctttctggaaaaaacaaagaaagacttcggattgggctccatcgccacccaacagccagagagcaatatactggacattgatctcagacctgcctcagcatggactctgtacgctgtggccacaacgtttatcacccccatgcttaggcacagtattgagaactcttccgtcaatgtgagcctcactgcgatcgctaaccaggccacagttctgatggggttgggaaagggttggccgctgtcaaaaatggacataggcgtgccattactagcaatcgggtgttacagtcaggtcaatcctattaccctgaccgccgctctccttctgttggtagcacattatgccatcattggacccggcctgcaagcgaaggctacacgcgaagcccagaagcgggcagccgctggtatcatgaaaaacccaactgtggatgggattacggttatcgacctcgatcccataccttacgacccgaagttcgagaaacagctgggccaggtgatgcttttagtcctgtgcgtgacccaagtcctcatgatgcgaacaacttgggccttgtgtgaagcactgaccctagctacaggacccattagcaccctgtgggagggcaatccagggagattttggaacactacgatcgccgtgtccatggcgaatatcttcaggggatcttatctcgccggcgcaggtcttctgtttagcattatgaagaacacaaccaacactcgccgggggaccggaaatacaggcgaaactttgggtgagaaatggaagaacagactgaatgctctcggcaagtccgagttccagacctacaaaaagtcagggatacaggaagttgatcgtacactggccaaagagggaatcaagaggggcgaaacggaccaccatgcagtgtctcgggggagtgctaaattacgctggtttgtagagcgaaaccttgtgacccctgagggaaaggtcgttgatctgggctgcggtagagggggatggtcgtattactgtggcggtctcaaaaatgtgagggaagtcaagggcctaactaaggggggacccggccacgaggaacctattccaatgagcacatatgggtggaacctggtgcggttgcaatccggagtagacgtgttcttcaccccccctgagaaatgcgatactctgctctgtgacatcggcgaatcttcaccaaatcccacagttgaggccggtcgcacccttagagtgctgaacttggtcgagaattggctgaacaataacacgcagttttgcattaaggtgctcaatccgtacatgcctagcgtcatcgaaaaaatggaggccttacagaggaagtacgggggagcgctggtgcgaaacccactttcccggaatagtacccatgaaatgtattgggtttctaacgctagcggcaacatagtatcatccgtgaatatgatcagtcgtatgctgattaacagattcacaatgcgccacaaaaaggcaacttacgagcccgatgtcgacctaggcagcgggaccaggaatatcggaattgaatctgagacacctaacctcgacatcataggtaagcggattgagaaaatcagacaggaacacgagacttcctggcattatgatcaagaccacccatacaagacctgggcctatcatggctcatacgaaacaaaacagaccgggagcgcttcgtctatggtgaatggagttgtgcgcctgttgactaagccctgggatgtcatcccgatggtgacgcagatggccatgacagacaccactccttttggccagcaaagggtattcaaagagaaggtggatacccgaacacaggaacccaaggagggtacgaaaaagctgatgaaaattaccgcaaagtggctctggaaagagcttgggaagaagaaaactccacggatgtgtacaagagaagagtttaccaggaaggttcgcagtaacgccgctctgggagcgatattcactgacgaaaataaatggaagtccgcccgtgaggcagtcgaggatagccggttttgggaattagtggacaaagagagaaacctgcacttggaaggcaagtgcgagacatgtgtgtataatatgatgggcaaaagggaaaagaagctcggggagttcggaaaagctaagggttcacgcgccatctggtacatgtggctgggcgcacgatttctagagttcgaagcccttgggtttctgaacgaggatcactggttctcccgggaaaattctctcagcggagtcgagggcgaaggtctgcataaattggggtacattctgagagacgttagtaagaaagagggaggcgctatgtatgccgatgacaccgcgggctgggacacaaggatcactctcgaggatcttaagaacgaagagatggtgaccaatcacatggaaggggagcataagaaactggcagaagccatttttaagttaacgtaccagaacaaagtagtgcgcgtccagagacctaccccccggggaacagtgatggacatcatatccaggcgtgatcaacgaggtagcggccaggttgggacttatggactgaataccttcacaaacatgggcgctcagttgatccgccaaatggagggtgagggggtgttcaagtctattcagcacctcactgccaccgaagagatcgcagtccaggactggctggctagagtgggacgggaaaggctatcacgcatggccattagtggcgatgactgcgtagttaaaccacttgatgacagatttgcttccgccctgacggcactcaacgatatgggcaaggtgcggaaggacatccagcaatgggagcccagcagggggtggaatgattggacacaggtccctttctgctctcatcactttcacgagctgattatgaaagacggacgagtgttggtggtcccatgtcgtaaccaggatgaattaataggtagagcgcgcatctcgcagggcgccgggtggtcactgcgggagaccgcttgcctcggaaagagctacgcccaaatgtggtcccttatgtatttccataggagagacctgcgcctagcagctaatgccatttgtagtgcagttccgtctcactgggtgcccactagccggacaacctggtccatccatgccaaacacgaatggatgactaccgaggacatgctgacagtatggaacagggtgtggatccaggaaaatccttggatggaggataagacgccagtcgagtcatgggaagagattccctacctcggcaaacgagaagaccagtggtgcggtagtttgatagggctgacctctagagcgacttgggctaagaacatccagacagccattaatcaagtgcggagccttatcggaaacgaggaatataccgattacatgccttccatgaagaggtttcgccgtgaggaggaagaggcaggcgttctgtggtga

SEQ ID NO: 14268 - RNA, 9876 nt, synthetic construct
  misc_feature 1..9876: note = derived and/or modified CDS sequence (opt3) from DENV-2__LC111438__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgcactttcagcgcgttttgatcttcattctcctgactgcagtggccccatctatgacaatgagatgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaacatcctgcgacgctgcggaagtattgcattgaagcaaaacttaccaacacaactaccgcctcccgctgtccaacacagggggagccctctttgaatgaggaacaagataagcgatttgtctgcaaacacagcatggtggacagaggatggggcaacggttgtgggctgttcggaaagggcggcatcgtgacttgcgctatgtttacctgcaagaaaaatatggaggggaaggtcgttcagcctgaaaacctagagtacacaatcgtgattaccccacattccggagaagagaatgccgtaggtaacgatactggcaaacacgggaaggagataaaagtgacgccgcagtcaagtatcacagaagcagagctcaccggatatggcactgtcaccatggaatgtagccccaggacaggtctggacttcaatgagatggtgcttctgcagatggaaaacaaggcttggttggttcaccggcaatggtttctcgatctgcctttaccatggctgcccggggccgacacccagggctctaactggattcagaaagagactctcgtgacattcaagaatcctcatgcgaagaaacaggatgtcgtggtacttggatcccaagagggcgccatgcacacggcactgaccggggctactgaaatccagatgtcaagcggaaacttgctatttacaggtcatctgaagtgccgtctccgcatggacaaactgcagcttaagggcatgagttactctatgtgtaccgggaaattcaaggttgtgaaggagatagccgaaacacaacacggaactattgtcatcagagtgcagtatgagggcgacggttccccatgcaaaatccccttcgagattatggatctggaaaagaggcatgtcttggggcggctcatcaccgtgaatccgattgttacggagaaagacagccctgtgaacatagaagctgagcccccatttggcgattcgtacatcattatcggagtagaacctggccagctgaagttatcttggttcaaaaaggggtcctcaatcggacagatgtttgagaccacaatgcgaggtgccaagcgcatggcaattctgggcgacactgcctgggatttcgggagtctaggaggcgtctttaccagcataggtaaagctctccaccaagtgttcggggcgatctacggcgcagccttttccggagtttcttggacaatgaagattctgatcggcgtggtcattacttggatcgggatgaatagcagatcaaccagtctttccgtgagcttggtactggtgggagttgtcacgctctatctgggcgtgatggtgcaggctgactctggttgtgtcgtttcatggaaaaacaaggagcttaaatgcgggagtggaatattcatcacagataatgtgcacacctggactgaacagtacaagtttcagcccgagagcccacccaagctggcctccgcaattcaaaaagcccatgaagagggcatctgtggtattaggtctgtgacacggttggaaaacctcatgtggaagcagatcacccctgagctgaatcacatattatcggagaacgaagtaaaactgactattatgaccggcgacatcaaggggattatgcaggctggaaaacgcagcctaagaccacagccgacagagctcaagtattcctggaaagcctggggcaaggcaaagatgctgtcaacggaacttcataatcacaccttcttgatcgatgggcccgagactgcggaatgccctaacacaaatagggcttggaacagtctggaggtcgaggactacggatttggcgtgttcaccacaaatatatggctcaaactgaaggaaaaacaagatgttttttgtgactctaagttaatgagcgccgcaatcaaagacaaccgtgccgtgcacgctgatatgggttattggattgagtccgccctgaacgacacttggaagatcgaaaaggcatcattcattgaggtcaaaagctgccattggccaaagtctcacaccctttggtccaatggggtgttggagagtgaaatgatcatacccaaaaacttcgctggacctgttagccagcataattaccggccaggctatcacacgcagacagccggtccctggcatctcggctctctggagatggattttgacttctgtgaagggaccactgtggtagtcaccgaggattgcggaaaccgaggcccgtccctaagaacaactaccgcgtcagggaagctgattacagaatggtgctgtaggagttgcacgctccctccactgcgctaccggggagaggacggctgttggtacggtatggagatcagaccccttaaagaaaaggaggaaaatttggtgaacagcctggtgaccgccgggcacggacagatcgataatttttcgttaggcgtcctcggtatggctctgttccttgaggaaatgctgaggactcgcgttggcacaaagcacgcaattttgctcgtggccgtatcctttgtgaccctgatcactgggaacatgtctttccgagacctaggacgggtcatggtgatggttggcgctacaatgaccgatgacattgggatgggagtgacgtatctggccctcctggcagcgtttaaaatacgtcctactttcgccgctggccttttgctgagaaagttaaccagcaaagagctcatgatgacaaccatcggtattgtcctgctttcacaaagtactatccccgagacaattctggaactaaccgatgccctcgcactggggatgatggtgttgaagatcgttaggaatatggagaaataccagctggctgtgacaataatggccatcttatgcgtcccaaacgcagtaattctccagaatgcctggaaggtgtcctgtactaccctggctgttgtgtctgtcagccctcttctgttgacgtcctcacaacagaaggcggactggatccccctcgccctgacaattaaaggactaaacccaaccgcaatctttctgactacccttagccgcacaagtaagaaacggtcttggccgctcaatgaagctataatggccgtgggcatggtatccattctggccagctcgttgctgaagaacgatatccctatgactggccccttagtggctgggggactcctgaccgtctgctatgttcttacgggtagatcagcagacctggagttggaaagggccgcggacgtgcgatgggaggagcaggctgaaatctctggcagttccccaattctcagcataacaatctctgaggatgggagcatgtccattaaaaatgaagaggaggaacagaccctgactatcctaattcgcacaggactgcttgtgatctcaggcctcttccccgtcagtatacctatcaccgccgcagcctggtacctgtgggaggtgaagaaacaacgggctggtgttttgtgggacgtaccaagcccccctccggtggggaaggcagaattagaggatggagcctatagaattaagcagaaaggcatcctgggctactctcagattggggcgggagtctataaggaaggtacttttcatacaatgtggcacgtgaccaggggcgctgttctcatgcataaagggaagcgtatcgagccatcctgggccgacgtgaaaaaggatctgatatcatacggaggcggttggaagcttgagggggaatggaaagagggagaagaggtccaggtgctggcattggaacccggcaagaaccctcgcgccgtacaaacgaaaccaggcctattcaagactaacaccgggacaattggagctgtcagtctggactttagccccggtacctccggctctcctatcgtggataaaaaggggaaggttgtgggactctacggcaatggtgtcgtgacacggtcggggacttatgttagcgccatcgcacagaccgagaaatcaattgaggacaacccggaaatcgaggatgacatattcagaaagaaaaggctgacgattatggatcttcaccccggagctggcaagacaaaacgatacttaccagccatcgtgcgggaagcgattaagcgcggcctgagaactctcatcttggcccctaccagggtcgtggcagctgagatggaagaggccctgcgggggctccccatacgatatcagacaccagctattagagcagagcataccggacgcgaaatcgtagacctgatgtgtcacgccactttcaccatgaggcttctgtcccctatccgtgtgcccaattacaacttgattatcatggatgaggcccactttacagacccagctagtattgcggcacggggttatatatctacgagagttgaaatgggcgaggccgctgggatcttcatgactgccaccccgcctggaagcagggacccctttccacagtccaatgcacccattatggatgaggaacgcgagatccctgaacgatcatggaactctggccatgagtgggtcacagacttcaagggtaaaaccgtgtggtttgtgccaagcatcaaggccgggaatgatattgctgcgtgcctaagaaaaaacggaaagaaagtcatacaactgagtcggaagactttcgactccgaatacatcaagacaaggaccaatgattgggactttgtagtgacgactgatattagcgagatgggcgccaacttcaaagcagagcgcgttatcgacccccgtagatgtatgaagcctgtgattctcacagatggcgaagagcgggtcatcttagctgggccgatgccagtgacccactcttcagccgcacagaggcgcggacgagttggtagaaatcccaaaaacgaaaatgaccagtatatatacatgggcgagcctctggaaaacgatgaggactgcgcccattggaaggaggctaaaatgcttctggacaatatcaacacccccgaagggattatcccatccatgtttgagcctgaacgggagaaggtggatgccattgacggagaatacaggctccgcggcgaggcgagaaaaactttcgtcgatttgatgaggcggggtgacctgcccgtgtggctcgcatatcgtgtagccgctgaggggatcaactacgccgatcgccgatggtgttttgacggcgtgaagaataaccaaatactggaagagaatgttgaagtcgagatttggacaaaggagggagaaagaaaaaagcttaaaccaaggtggctagatgctcggatctatagtgaccctctggcattgaaggagttcaaagaattcgccgctggccgcaagagcttagccctgaacctcattaccgagatggggagactgccgacatttatgactcagaaggcaaggaatgcgcttgataacctggccgtgctccacacggctgaagccggaggtcgggcatacaatcacgctttgtcggagctgcccgagaccctagaaacactgctccttctgactttattggccaccgtgacaggcgggatcttcctgtttctcatgtctggaaaaggcataggtaagatgaccatggggatgtgctgcatcattactgcatccatcctgctttggtatgcccagattcagccacattggatcgctgcgagcataattctggagttctttctcatcgtcttgctgatccctgaacccgagaaacaacgaacgccacaggacaaccagttaacctacgttgtgattgccatcctaacagtagtggcagctactatggccaatgaaatgggcttcctggagaagaccaaaaaggattttggactcggctcaatagccacacagcaacctgagagtaacattcttgacatcgatctgagacccgcatctgcttggaccttgtatgccgtcgcgactacattcattacgccgatgctgcgccactccatcgaaaatagctcagtgaacgttagtctcaccgctatagccaatcaggcaactgtgctgatggggcttggaaagggttggccactcagcaaaatggacatcggcgtccctctgttggccattgggtgttactcccaggtaaaccccatcacactgatggctgcattactactgctcgtggcccattacgcgattatcggaccaggccttcaggctaaggccaccagggaggcacaaaaacgggccgctgccggtattatgaagaatcccaccgttgacgggatcacagtgatagatctggaccctattccgtatgatcccaaatttgaaaagcagttgggccaggtcatgctgctcgtgctgtgcgtcactcaggtgcttatgatgcgtacgacctgggcattatgtgaggctctgacactcgccactggaccaatctctaccttgtgggaaggcaaccctgggagattctggaatacaaccatcgcggttagcatggccaacatttttaggggatcctacctggcaggcgctggtctactgttctcaataatgaagaacactgccaatacgcgccgggggacaggaaacaccggcgagactctcggtgagaaatggaagaatcgacttaacgcactgggcaaatctgaatttcaaatctataagaaaagtgggattcaggaggtggacagaaccttggctaaggaaggaatcaaaaggggcgagacagatcaccatgccgtatcgcgcgggagcgccaagctgcggtggttcgtggagagaaatctcgtcactcccgaaggaaaggttgtggacctgggctgcggtcgtgggggatggtcctactattgtggcggtttaaaaaacgtcaaggaggtgaaaggccttaccaaggggggacctggccacgaagagccaattcccatgtctacatacgggtggaatctggtaaggctccagtcaggagtggatgttttctttacgcctccagaaaaatgcgacaccctactgtgtgatatcggcgagagctcccccaacccgactgtggaggcgggtcggacattgcgcgtcctgaatctcgtggaaaactggcttaataacaatacccaattctgcataaaggtcctgaacccttatatgccaagtgtgatcgagaagatggaagctttgcagcgaaaatacgggggagcactggttagaaatcccctctctaggaacagcactcacgagatgtactgggtatcaaacgcctccggcaatattgtgagtagcgtcaacatgatctctcggatgttaattaatcgctttacaatgagacataagaaagctacctatgaacctgacgtggatctgggctccgggacgaggaacatcggaatagagtcagagaccccaaatcttgacattatcggtaagcgaatcgaaaaaattaagcaggagcacgaaacaagctggcattacgatcaggaccacccctataagacttgggcctaccacggctcgtatgagaccaaacaaacagggtctgcaagttccatggttaacggagtggtccggctgctaactaagccgtgggacgtgatacctatggtaacccagatggccatgacagataccactcccttcggccagcagcgtgtgtttaaagaaaaggttgacacgagaacacaagagccaaaagagggtaccaagaagctcatgaaaatcactgctaagtggctgtggaaagaattggggaagaaaaagacccctcgcatgtgtacaagggaggaattcacgcggaaagtcagaagcaatgcggccctgggagcaatttttaccgatgagaacaagtggaagtcagctcgcgaggccgtggaagactccggcttctgggagctcgtggataaagaaaggaatcttcatctggagggcaagtgcgaaacttgtgtctacaacatgatggggaaacgagagaagaaattaggagagtttggtaaggcaaagggctctcgggccatctggtatatgtggctgggggctagattcttggaatttgaggccctcggattcctgaatgaagaccactggtttagcagggagaacagtctatccggcgttgaaggtgaggggcttcataaactgggatacattctccgcgatgtgagcaagaaagagggcggcgcgatgtacgcagacgatacagccgggtgggacacccgtatcactctggaagatttgaagaatgaggaaatagtaacaaactatatggagggagaacacaaaaagctggctgaggccatcttcaagctcacctaccagaataaagtggtccgggtgcagagacccacaccaaggggtactgttatggacattatctctcgccgagaccagcggggctcagggcaagtggtcacctatggacttaacacgttcaccaacatggaggcacagctgattagacagatggaaggcgagggtgtgtttaagagtatccaacatttaacagtaactgaagagattgctgttgagaattggctggtgagggtcgggcgcgaaagattgtcccggatggccataagcggagatgactgcgtggtgaaacccctcgatgacaggttcgcttctgccctgaccgcactaaacgatatgggcaaggtccgtaaagacatccagcagtgggagccttcgcgaggctggaatgattggacacaggttccattttgctcacaccacttccatgaacttattatgaaggacgggcgcgtgctggtagtgccgtgtagaaaccaagatgagctcatcggacgggcgaggatcagccagggtgccggctggtccctgcgcgaaactgcttgcttggggaagagttacgcccagatgtggtctttaatgtattttcacagacgggacctgaggctcgcagctaatgccatttgtagcgcagtcccctcccattgggtgcctacctcacgaacgacatggagtatacacgccacccacgagtggatgactacagaggatatgcttaccgtttggaaccgtgtgtggatccaggaaaatccatggatggaggacaaaactcccgtcgaatcttgggaggaaattccttacctgggaaagagagaggatcaatggtgcggcagcctaatcggtctgacctcccgcgcgacatgggctaaaaacattcagacggccatcaatcaggtgcggtcactcatagggaacgaggaatataccgactacatgccaagcatgaagaggttcagacgcgaggaagaggaagcaggagtattgtggtga

SEQ ID NO: 14269 - RNA, 9876 nt, synthetic construct
  misc_feature 1..9876: note = derived and/or modified CDS sequence (opt3) from DENV-2__KF744400__SS-prME
  source 1..9876: mol_type = other RNA
accgcaggcatgatcattatgctgatacccactgtgatggctttccacctcactacgagaaatggggaacctcatatgatcgtcagcaggcaggaaaagggaaagtcccttctgtttaagaccgaaaatggtgttaatatgtgcacattgatggcaatggacttaggcgaactgtgtgaggatactattacctacaaatgcccactactccggcaaaatgaaccggaggacatcgattgttggtgcaactctacatcaacctgggtgacttatgggacatgtaccacgactggagagcaccgccgagaaaagcgtagtgtcgccctggtgccccatgtcggcatgggtcttgagaccagaacagaaacttggatgagctccgagggggcgtggaaacacgctcagaggattgagacctggatcctgcggcatcctggattcacattgatggccgcaatactcgcctacaccatcggcacgactcactttcagcgcgctctgattttcatcctgctcacagcagtggccccatctatgaccatgagatgcattggcatctcgaatagggactttgttgaaggggtgtcaggaggtagctgggtcgatatagtgttagagcacggcagttgtgtaactacaatggctaagaacaagcccaccctggacttcgaacttattaaaacggaggccaaggaacctgcgaccttgcggaaatattgcatcgaggcaaagctgacaaatactaccacagagtcccgctgtccaactcagggggaaccctctctaaacgaggaacaagataaacgatttgtttgcaagcatagcatggtggacagaggatggggcaatggttgtggactcttcggaaagggcggcattgtaacctgcgccatgtttacatgcaaaaagaacatggaggggaaaatcgtgcagcctgaaaatctggagtacaccatcgtgattactccacactccggagaggaacatgctgtcggtaacgatacgggcaagcacgggaaagagataaagatcacaccgcagtcaagtaccactgaagccgagcttaccggatatggcacagttaccatggaatgtagccccaggactggtctggacttcaatgagatggtgttgctccagatggagaacaaagcatggctggtacaccggcaatggtttttagatctgcctctcccatggcttcccggggctgacacacagggctctaattggattcagaaggaaacgctggtgaccttcaagaaccctcatgccaaaaagcaggatgtcgtggttttgggatcccaagagggcgcgatgcacactgccctaacaggggcaaccgacatccagatgtcaagcggaaacctgctctttacaggtcatctgaaatgccgtcttcgcatggacaagctgcagttgaaaggcatgagttactctatgtgtactgggaagttcaaggtggtcaaagaaatagctgagacccaacacggaacgattgtggtaagagttcagtatgagggcgatggttccccatgcaagatccccttcgaaatcatggacctcgagaaaaggcatgtgctggggcggttaattaccgtcaatccgatcgtgacagaaaaggatagccctgtcaacattgaggccgaacccccatttggcgactcgtacgtgataatcggagttgagcctggccagctgaaactaaattggttcaagaaggggtcttccattggacagatgtttgagactaccatgcgaggtgctaaacgcatggccatcctcggcgatacagcatgggacttcgggtcactgggaggcgtgtttacaagcatcggtaaggcccttcaccaagtattcggggctatttacggcgcggcatttagcggagtctcctggaccatgaaaatattgatcggcgtgattatcacgtggattgggatgaactctagaagcacatcactgagtgtttccctcgtgctggtcggagtggtaaccctttatctgggcgtggttgtccaggccgatagcggttgtgtggtgtcttggaagaataaagaattgaagtgcgggtcaggaatcttcataactgacaacgtccacacatggaccgagcagtacaagtttcagcccgaaagtccaagcaaactcgcttccgccatccaaaaggcacatcaggagggcatttgtggtatcaggtctgttactcggctggaaaatttaatgtggaaacagattacccccgagctgaaccacatcctatcggagaatgaagtgaagctcacaataatgacgggcgatattaaagggatcatgcatgccggaaagcgcagcctgagacctcagccaaccgagcttaggtattcctggaaaacttggggcaaggctaagattttgtcaacagaaagtcacaaccaaaccttcctgatcgacgggccggagacagccgaatgccccaatactaaccgtgcatggaactctctcgaggtggaggattacggatttggcgtattcaccacgaacatatggctgaaattacgggaaaagcaggacgcgttttgtgaccctaaactgatgagcgctgccatcaaggataatcgagcagtccacgccgacatgggttattggattgagtccgctcttaacgatacatggaaaatcgaaaaggcctcattcattgaggtgaagaactgccattggccaaaaagccacaccttgtggtctaatggggttctcgagtccgaaatgatcatacccaagaacttcgcaggacctgtgagtcagcataattacagaccaggctatcacactcagaccgctggtccctggcatctgggcaaactagagctggactttgatttctgtgaagggacaactgtcgtggttaccgaggactgcggaaacaggggcccgagcctccgcacaacgaccgcctctgggaagctgattactgaatggtgctgtcggtcctgcacacttcctccattgagatacaaaggagaggatggctgttggtacggtatggagatcaggcccctgaaggaaaaggaggaaaatttagtgtcaagtctcgtaaccgcggggcacggacaaatcgacaactttagcctgggcgtccttggtatggccctgttcttggaggaaatgctccgcactcgagtgggcatgaaacacgctattctgctagtggcagtctcgtttgttacactgatcaccgggaatatgtccttccgggatctcggacgtgtgatggtaatggtgggcgccacgatgactgacgatattgggatgggagtcacctatctggctcttttggccgcatttaaggtgagacctacattcgcggccggcctgttactcaggaaactgacctctaaggagcttatgatgactacaataggtatcgttctgctaagccagtcaaccattcccgagacaatcctcgaactgactgacgctttggccctggggatgatggtgttaaaaattgtccgcaagatggagcggtaccagctcgcagtgaccatcatggctatactgtgcgttccaaacagtgtgatccttcaaaatgcctggaaggtctcctgtacgattctggcagtagtgtctgttagccctttgctcctgacatcctcacagcagaaagccgattggatccccctagctctgaccattaagggacttaacccaactgcgatctttctcaccacactgagcagaacaagtaaaaagaggtcttggccgttgaatgaagccataatggcagtgggcatggtctccattctggctagctcgttactcaaaaacgacatccctatgaccggccccctggtggccgggggacttctgacggtatgctatgtgttgacaggtcgatcagccgacctcgagctggaaaaggctgcagatgtccgctgggaggaccaggccgagatctctggcagttccccaattctaagcgttatagtgtctgaagatgggagcatgtccatcaaaaatgaggaagaggagcaaattctgaccatccttattcggactggactcctggtgatctcaggcttgttccccgtcagtatacctatcacagcggctgcctggtacttatgggaagtgaagaagcagagagccggtgttctgtgggacgtaccaagtccccctccggtggggaaagccgagctcgaagatggagcttataggattaagcagaaaggcatcctgggctactctcagattggggcaggagtctataaggagggtacctttcatactatgtggcacgtgacacgtggcgccgttcttatgcataaagggaagcgcatcgaaccatcctgggcggacgtgaagaaagatctgatatcatacggaggcggttggaagttggagggggagtggaaagaaggagaggaagtccaagtgctagctctggagcccggcaagaaccctcgggccgtacagaccaaaccaggcctcttcaagacgaatgcagggactattggagccgtcagtctggactttagccccggtacctccggctctcctatcatcgataagaaagggaaggtggttggactttacggcaacggtgtggtcacaagaaacgggtcgtatgtgagcgctattgcccagaccgaaaaatcaatcgaggacaatccggagatagaagatgacattttcaggaagaaacgattaacaatcatggatctgcaccccggagcaggcaagactaagcggtacctcccagctattgttcgcgaggccatcaaaagaggcttgaggaccctgatactcgcgcctacgcgggtggtcgccgcagaaatggaggaagctctgcgagggcttcccattagatatcagacaccagccatccgcgctgagcatactggaagggagatcgtggacctgatgtgtcacgcaaccttcacaatgcgtttgctatcccctattcgggtacccaactacaatctgatcattatggacgaagcccactttaccgatccagccagtatagctgcgagaggttatatctctactagggtggagatgggcgaagcagccgggattttcatgaccgctacaccgcctggaagccgcgacccctttccacaatccaacgcccccatcatggatgaggagcgagaaatccctgagagatcatggaactctggccatgaatgggttacggacttcaagggtaaaactgtctggtttgtgccaagcattaaggcagggaacgatatagccgcttgcctccggaaaaatggaaagaaggtgatccagttaagtaggaaaaccttcgactccgagtacgtcaagacacgcaccaacgattgggactttgtagtgactacagatattagcgaaatgggcgcgaatttcaaagccgagcgtgttatcgaccccagacggtgtatgaagcctgtgattctgaccgatggcgaggaaagggtcatccttgcagggccgatgccagtgacgcactcttcagctgcccagcgccgaggaagaataggtcggaaccccaaaaatgagaacgaccaatatatctacatgggcgaacctctggagaatgacgaagattgcgcacattggaaggaggccaaaatgctcttggacaacattaatactcccgaggggatcattccatccatgtttgaacctgagagggaaaaggttgatgctatcgacggagagtaccgcctgagaggcgaagccaggaagacattcgtggatctcatgcggcgtggtgacctgcccgtctggcttgcgtataaagtggcagccgaggggataaactacgctgatcgccgatggtgttttgacggcattagaaacaatcagatcctagaggaaaacgtagaggtggaaatttggaccaaggagggagagaggaaaaagctgaaaccacggtggttggatgcccgcatctatagtgaccctttagctctgaaggagttcaaggagttcgcagccggcagaaaaagcctcaccctgaatcttataactgaaatggggaggctgccgacatttatgacccagaaggctcgggatgccctcgacaacttggcagttctgcacacagcggaggccggaggtcgagcttacaatcacgccctatcggaactgcccgagactctcgagacgcttctgttattgaccctgctcgcaacagtcactggcgggatcttcctgtttcttatgtctggaagaggcattggtaaaatgaccctggggatgtgctgcatcattacagcttccatcctcttgtggtatgcccagatacaaccacattggattgcagccagcatcatcctggagttctttttaattgtgctactgatccctgagcccgaaaagcagcgcaccccacaggataaccagctcacttacgtggtcatagctattcttacggttgtggcggccaccatggcaaatgagatgggcttcctggaaaagactaagaaggacttgggactgggctcaatcgctactcaacagcctgagagtaacattctcgacatcgatctgaggcccgcctctgcctggaccctttatgcagtagctacaacctttataactccgatgctccggcactccatcgagaatagctcagtgaacgtcagtctgacagccattgcgaatcaggctacggtgttgatggggctgggaaaaggttggccattaagcaagatggacatcggcgttcctctactggccattgggtgttactcccaggtgaaccccatcaccctcactgcagcccttctgttgctggtcgctcattacgcaattatcggaccaggcctccaagccaaagcgacacgtgaagctcagaagagagccgcagccggtataatgaaaaatcccaccgtagatgggattaccgctatcgacctggatcctatcccgtatgaccccaagttcgagaagcagcttggccaggtgatgttactggttctctgcgtgacacaagtcttgatgatgaggactacgtgggccctgtgtgaagcactaaccctggctacaggaccaatttctactctctgggagggcaaccctgggcgcttttggaataccacaatagccgtgagcatggcgaacatcttccggggatcctaccttgccggcgcaggtctgttgttttcaattatgaaaaataccactaacacgcgaagagggacaggaaacatcggcgaaaccctgggtgagaagtggaaatctaggctcaatgctctgggcaagagtgagttccagatttataaaaagtcggggatccaggaagtcgatcgcactttagccaaagagggaataaagcggggcgaaaccgaccaccatgcagtgagcagagggtccgctaaacttcgttggtttgttgagaggaacatggtgacacccgagggaaaagtagtggatctgggctgcggtcgcgggggatggtcttactattgtggcggtctcaagaatgtccgggaagttaaaggcctaactaaaggcgggcctgggcacgaggaaccaatccccatgtcaacctacgggtggaacctggtgcgattgcaaagcggagtcgacgtgttcttcacacctccagagaaatgcgatacgctgctctgtgacattggcgaatccagtcccaatccgaccgtagaggccggtagaactcttagggtgctgaacttggttgagaattggctgaacaataacacacagttttgcatcaaggtgctcaatccttatatgccatctgtcattgaaaagatggaggccttacagcggaaatacgggggagcgctggtgcgcaacccccttagcagaaattcaacccacgaaatgtactgggtctccaacgctagtggcaatatcgtgagctctgttaacatgatatccaggatgctgattaaccgattcactatgaagcataaaaaggcaacatatgagcctgatgtagacctaggctcagggacctgtaatatcggaatcgaaagcgaggtgccaaacctcgacattataggtaaacggatcgagaagattaagcaggaacacgagacgtcgtggcattacgatcaagaccacccctataaaacctgggcctaccacggctcttatgaagctaagcagacagggagtgcctccagcatggtcaatggagtggttcgtctgttgactaaaccgtgggatgtgatccctatggtcacccagatggcaatgacagacactaccccctttggccagcaaagagtgttcaaggagaaagtagatacacgcacccaggaaccaaaggagggtactaagaaactgatgaagattacggccgagtggctctggaaagaacttgggaagaaaaagacacctaggatgtgcacccgggaggaatttactagaaaagtgcgctcaaacgctgcgctgggagccatcttcaccgacgagaataagtggaagtccgcaagggaggctgttgaagattctcgattttgggagttagtcgacaaagaacggaacctgcatttggagggcaagtgtgaaacatgcgtgtacaatatgatgggcaaaagagagaagaaactcggggagttcggaaaggccaagggtagcagggcaatatggtatatgtggctgggcgcccgctttctagagttcgaggctcttgggtttctgaacgaagatcactggttcagtcgtgaaaattccctcagcggagtggaaggcgagggtctgtacaaattggggtacatcctgcgggacgtctctaagaaagagggaggcgccatgtatgcggatgacacggcaggctgggacaccagaattactctcgaagatcttaagaacgaggaaatggttacaaatcatatggagggggaacacaaaaagctggccgaggctatctttaagttaacctaccagaacaaagtggtaagggtgcagcgccccactccacgaggaacagtcatggacattatctcacggagagatcaaaggggtagtggccaggtggggacctatggactgaatacattcactaacatggaggcccagttgattcgccaaatggaaggcgagggtatattcaagtccatccagcatctcaccgcaacggaagagattgctgttcagaattggctgaccagagtggggcgggagaggctaagccgtatggccatctctggagacgattgcgtcgtgaaaccccttgacgatcgatttgcttcggccctgacagcactcaacgacatgggcaaggtacgcaaagatatccagcaatgggaaccttcaagaggctggaacgactggactcaggttccattctgtagccaccactttcatgagctgattatgaaggatgggcgggtgttggtcgtgccgtgcaggaatcaggacgaattaataggacgcgcgagaatctcccagggtgccggctggagtctgcgggagaccgcttgtctcgggaagtcttacgcccaaatgtggagccttatgtatttccacaggcgagatctgcgtctagcagctaacgccatttgctccgcagtgccctcacattgggtccctacaagtagaactacctggtctatccacgccaaacacgaatggatgacgacagaggacatgctgaccgtttggaatcgcgtgtggattcaggagaacccatggatggaagacaagactcccgtagagagctgggaagagatcccttacctcggaaaacgggaagatcagtggtgtggctccttgataggtctgacatcaagggcgacctgggctaagaatatccagactgccattaaccaagtgagaagccttatcgggaatgaggagtataccgactacatgccatctatgaaacgctttcggagggaagaggaagaggcaggagtcctgtggtga

SEQ ID NO: 14270 - RNA, 9876 nt, synthetic construct
  misc_feature 1..9876: note = derived and/or modified CDS sequence (opt3) from DENV-2__KF744401__SS-prME
  source 1..9876: mol_type = other RNA
accgcaggaatgatcattatgctgatacccactgtgatggctttccacctcactacgagaaatggggaacctcatatgatcgtcagcaggcaggaaaagggaaagtcccttctgtttaagaccgaaaatggtgttaatatgtgcactttgatggcaatggacttaggcgaactgtgtgaagatactattacctacaaatgcccactactccggcaaaatgaaccggaggacatcgattgttggtgcaactctacttcaacctgggtgacttatgggacatgtaccacgactggagagcaccgccgagaaaagcgtagtgtcgccctggtgccccatgtcggcatgggtcttgagaccagaacagaaacttggatgagctccgagggggcgtggaaacacgctcagaggattgagacctggatcctgcggcatcctggattcacattgatggccgcaatactcgcctacaccatcggcacgactcactttcagcgcgctctgattttcatcctgctcacagcagtggccccatctatgaccatgagatgcattggcatctcgaatagggactttgttgaaggggtgtcaggaggtagctgggtcgatatagtgttagagcacggcagttgtgtaactacaatggctaagaacaagcccaccctggacttcgaacttattaaaacggaggccaaggaacctgcgaccttgcggaaatattgcatcgaggcaaagctgacaaatactaccacagagtcccgctgtccaactcagggggaaccctctctaaacgaggaacaagataaacgatttgtttgcaagcatagcatggtggacagaggatggggcaatggttgtggactcttcggaaagggcggcattgtaacctgcgccatgtttacatgcaaaaagaacatggaggggaaaatcgtgcagcctgaaaatctggagtacaccatcgtgattactccacactccggagaggaacatgctgtcggtaacgatacgggcaagcacgggaaagagataaagatcacaccgcagtcaagtaccactgaagccgagcttaccggatatggcacagttaccatggaatgtagccccaggactggtctggacttcaatgagatggtgttgctccagatggagaacaaagcatggctggtacaccggcaatggtttttagatctgcctctcccatggcttcccggggctgacacacagggctctaattggattcagaaggaaacgctggtgaccttcaagaaccctcatgccaaaaagcaggatgtcgtggttttgggatcccaagagggcgcgatgcacactgccctaacaggggcaaccgaaatccagatgtcaagcggaaacctgctctttacaggtcatctgaaatgccgtcttcgcatggacaagctgcagttgaaaggcatgagttactctatgtgtactgggaagttcaaggtggtcaaagagatagctgagacccaacacggaacgattgtggtaagagttcagtatgaaggcgacggttccccatgcaagatccccttcgagatcatggatctcgagaagaggcatgtgctggggcggttaattaccgtcaatccgatcgtgacagagaaggacagccctgtcaacattgaagccgagcccccatttggcgattcgtacgtgataatcggagttgagcctggccagctgaaactaaattggttcaagaaggggtcttccattggacagatgtttgaaactaccatgcgaggtgctaaacgcatggccatcctcggcgacacagcatgggatttcgggtcactgggaggcgtgtttacaagcatcggtaaggcccttcaccaagtattcggggctatttacggcgcggcatttagcggagtctcctggaccatgaaaatattgatcggcgtgattatcacgtggattgggatgaactctagaagcacatcactgagtgtttccctcgtgctggtcggagtggtaaccctttatctgggcgtggttgtccaggccgacagcggttgtgtggtgtcttggaagaataaagagttgaagtgcgggtcaggaatcttcataactgataacgtccacacatggaccgaacagtacaagtttcagcccgagagtccaagcaaactcgcttccgccatccaaaaggcacatcaggaaggcatttgtggtatcaggtctgttactcggctggagaatttaatgtggaaacagattacccccgagctgaaccacatcctatcggaaaatgaggtgaagctcacaataatgacgggcgacattaaagggatcatgcatgccggaaagcgcagcctgagacctcagccaaccgaacttaggtattcctggaaaacttggggcaaggctaagattttgtcaacagagagtcacaaccaaaccttcctgatcgatgggccggaaacagccgagtgccccaatactaaccgtgcatggaactctctcgaggtggaagactacggatttggcgtattcaccacgaacatatggctgaaattacgggagaagcaggatgcgttttgtgaccctaaactgatgagcgctgccatcaaggacaatcgagcagtccacgccgatatgggttattggattgaatccgctcttaacgacacatggaaaatcgagaaggcctcattcattgaggtgaagaactgccattggccaaaaagccacaccttgtggtctaatggggttctcgaatccgagatgatcatacccaagaacttcgcaggacctgtgagtcagcataattacagaccaggctatcacactcagaccgctggtccctggcatctgggcaaactagaactggattttgacttctgtgaggggacaactgtcgtggttaccgaagattgcggaaacaggggcccgagcctccgcacaacgaccgcctctgggaagctgattactgagtggtgctgtcggtcctgcacacttcctccattgagatacaaaggagaggacggctgttggtacggtatggaaatcaggcccctgaaggagaaggaagagaatttagtgtcaagtctcgtaaccgcggggcacggacaaatcgataactttagcctgggcgtccttggtatggccctgttcttggaagagatgctccgcactcgagtgggcatgaaacacgctattctgctagtggcagtctcgtttgttacactgatcaccgggaatatgtccttccgggacctcggacgtgtgatggtaatggtgggcgccacgatgactgatgacattgggatgggagtcacctatctggctcttttggccgcatttaaggtgagacctacattcgcggccggcctgttactcaggaaactgacctctaaggagcttatgatgactacaataggtatcgttctgctaagccagtcaaccattcccgaaacaatcctcgagctgactgatgctttggccctggggatgatggtgttaaaaattgtccgcaagatggaacggtaccagctcgcagtgaccatcatggctatactgtgcgttccaaacagtgtgatccttcaaaatgcctggaaggtctcctgtacgattctggcagtagtgtctgttagccctttgctcctgacatcctcacagcagaaagccgactggatccccctagctctgaccattaagggacttaacccaactgcgatctttctcaccacactgagcagaacaagtaaaaagaggtcttggccgttgaatgaggccataatggcagtgggcatggtctccattctggctagctcgttactcaaaaacgatatccctatgaccggccccctggtggccgggggacttctgacggtatgctatgtgttgacaggtcgatcagccgacctcgaactggagaaggctgcagacgtccgctgggaggatcaggccgaaatctctggcagttccccaattctaagcgttatagtgtctgaggacgggagcatgtccatcaaaaatgaagaggaggaacaaaccctgactattcttatccggacaggactcctggtgatttcaggcttgttccccgtcagtatccctataaccgcggctgcctggtacttatgggaggtgaagaagcagagagccggtgttctgtgggatgtaccaagtccccctccggtggggaaagccgaactcgaggacggagcttataggatcaagcagaaaggcattctgggctactctcagatcggggcaggagtctataaggaaggtacttttcatacaatgtggcacgtgacccgtggcgccgttcttatgcataaagggaagcgcattgagccatcctgggcggatgtgaagaaagacctgatctcatacggaggcggttggaagttggagggggaatggaaagagggagaagaggtccaagtgctagctctggaacccggcaagaaccctcgggccgtacagacgaaaccaggcctcttcaagactaatgcagggaccataggagccgtcagtctggattttagccccggtacatccggctctcctattatcgacaagaaagggaaggtggttggactttacggcaacggtgtggtcaccagaaacgggtcgtatgtgagcgctatcgcccagacagagaaatcaattgaggataatccggaaatcgaggacgatatattcaggaagaaacgattaactattatggacctgcaccccggagcaggcaagaccaagcggtacctcccagctatcgttcgcgaagccattaaaagaggcttgaggacgctgatcctcgcgcctacacgggtggtcgccgcagagatggaagaggctctgcgagggcttcccataagatatcagactccagccattcgcgctgagcataccggaagggaaatcgtggatctgatgtgtcacgcaacattcaccatgcgtttgctatcccctatccgggtacccaactacaatctgattatcatggacgaggcccactttactgacccagccagtattgctgcgagaggttatatatctaccagggtggaaatgggcgaggcagccgggatcttcatgacagctacgccgcctggaagccgcgatccctttccacaatccaacgcccccattatggacgaggaacgagagatccctgaaagatcatggaactctggccatgagtgggttactgatttcaagggtaaaaccgtctggtttgtgccaagcatcaaggcagggaacgacattgccgcttgcctccggaaaaatggaaagaaggtgatacagttaagtaggaaaacattcgattccgaatacgtcaagacccgcactaacgactgggattttgtagtgacaaccgacatcagcgagatgggcgcgaatttcaaagccgagcgtgttattgatcccagacggtgtatgaagcctgtgatcctgacggacggcgaagagagggtcattcttgcagggccgatgccagtgactcactcttcagctgcccagcgccgaggaagaatcggtcggaaccccaaaaatgaaaacgatcaatatatatacatgggcgagcctctggaaaatgacgaggactgcgcacattggaaggaggccaaaatgctcttggataacatcaatacacccgaagggattatcccatccatgtttgagcctgaaagggagaaggttgacgctattgatggagaataccgcctgagaggcgaggccaggaagaccttcgtggacctcatgcggcgtggtgatctgcccgtctggcttgcgtataaagtggcagccgaggggatcaactacgctgaccgccgatggtgttttgatggcataagaaacaatcagattctagaagagaacgtagaagtggagatctggaccaaggagggagaaaggaaaaagctgaaaccacggtggttggacgcccgcatttatagtgatcctttagctctgaaggagttcaaggagttcgcagccggcagaaaaagcctcactctgaatcttatcacagagatggggaggctgccgacctttatgacacagaaggctcgggacgccctcgataacttggcagttctgcacactgcggaagccggaggtcgagcttacaatcacgccctatcggagctgcccgagacgctcgaaacccttctgttattgacactgctcgcaactgtcaccggcgggatattcctgtttcttatgtctggaagaggcatcggtaaaatgacactggggatgtgctgcattatcaccgcttccattctcttgtggtatgcccagatccaaccacattggatagcagccagcattatcctggagttctttttaatcgtgctactgattcctgaacccgagaagcagcgcactccacaggacaaccagctcacgtacgtggtcatcgctatacttaccgttgtggcggccacaatggcaaatgaaatgggcttcctggagaaaactaagaaggatttgggactgggctcaattgctacccaacagcctgagagtaacatcctcgacattgacctgaggcccgcctctgcctggacactttatgcagtagctaccacttttatcacaccgatgctccggcactccatagaaaatagctcagtgaacgtcagtctgacggccatcgcgaatcaggctaccgtgttgatggggctgggaaaaggttggccattaagcaagatggatattggcgttcctctactggccatcgggtgttactcccaggtgaaccccattactctcacagcagcccttctgttgctggtcgctcattacgcaatcattggaccaggcctccaagccaaagcgacccgtgaggctcagaagagagccgcagccggtatcatgaaaaatcccaccgtagacgggataacagctattgatctggaccctatcccgtatgatcccaagttcgaaaagcagcttggccaggtgatgttactggttctctgcgtgactcaagtcttggtgatgaggacgacctgggccctgtgtgaggcactaacactggctactggaccaatctctaccctctgggaaggcaaccctgggcgcttttggaatacaaccattgccgtcagcatggcgaacatattccggggatcctaccttgccggcgcaggtctgttgttttcaatcatgaaaaatactacgaacacacgaagagggaccggaaacattggcgagactctgggtgagaagtggaaatctaggctcaatgctctgggcaagagtgagttccagatctataaaaagtcggggattcaggaggtggaccgcaccttagccaaagaaggaatcaagcggggcgagacagatcaccatgcagttagcagagggtccgctaaacttcgttggtttgtggagaggaacatggtaactcccgaaggaaaagtggtcgacctgggctgcggtcgcgggggatggtcttactattgtggcggtctcaagaatgttcgggaggtgaaaggcctaaccaaaggcgggcctgggcacgaagaaccaatacccatgtcaacatacgggtggaacctggtccgattgcaaagcggagtggatgtattcttcacgcctccagaaaaatgcgacaccctgctctgtgatatcggcgagtccagtcccaatccgactgtggaggccggtagaacacttagggttctgaacttggtggaaaattggctgaacaataacacccagttttgcattaaggtcctcaatccttatatgccatctgtgatcgagaagatggaagccttacagcggaaatacgggggagcgctggtccgcaacccccttagcagaaattcaactcacgagatgtactgggtgtccaacgctagtggcaatattgttagctctgtaaacatgatctccaggatgctgataaaccgattcacaatgaagcataaaaaggcaacctatgaacctgacgtggatctaggctcagggacgcggaatattggaatcgagagcgaggtcccaaacctcgacatcattggtaaacgtatagaaaagatcaagcaggagcacgaaacctcgtggcattacgaccaagatcacccctataaaacatgggcctaccacggctcttatgaggctaagcagactgggagtgcctccagcatggtgaatggagttgtgagactgttgaccaaaccgtgggacgtcattcctatggtgacacagatggcaatgactgataccacaccctttggccagcaacgcgtattcaaggaaaaagtggacaccaggactcaggagccaaaggagggtacgaagaaactgatgaagatcacagccgaatggctctggaaagagcttgggaagaaaaagacccctcggatgtgtactagagaagagtttacccgcaaagttaggtcaaacgctgcgctgggagccattttcacagatgagaataagtggaagtccgcacgagaagctgtcgaggactctcggttttgggaattagtggataaagagagaaacctgcatttggaaggcaagtgcgagacgtgtgtgtacaatatgatgggcaaaagggagaagaaactcggggagttcggaaaggccaagggtagccgcgcaatctggtatatgtggctgggcgcccgttttctagagttcgaagctcttgggtttctgaacgaggaccactggttcagtcgggaaaattccctcagcggagtcgagggcgagggtctgtacaaattggggtacatactgagagatgtttctaagaaagaaggaggcgccatgtatgcggacgataccgcaggctgggacactaggatcacactcgaggaccttaagaacgaagagatggtgaccaatcatatggaaggggagcacaaaaagctggccgaggctatttttaagttaacttaccagaacaaagtagtgcgcgtccagcgacccacaccacggggaaccgtgatggatatcatttcaagaagggaccaacgcggtagtggccaggttgggacatatggactgaatactttcaccaacatggaagcccagttgatcagacaaatggagggcgaaggtattttcaagtccatacagcatctcacggcaaccgaggagatcgctgtgcagaattggctgacacgggtcgggagggaacgtctaagccgaatggccatttctggagatgactgcgtggtaaaaccccttgatgaccgctttgcttcggccctgactgcactcaacgatatgggcaaggttagaaaagacatccagcaatgggagccttcacggggctggaacgattggacccaggtgccattctgcagccaccactttcatgaactgatcatgaaggacgggagggtcttggtggtgccgtgtcgcaatcaggatgagttaattggcagagcgcggatatcccagggtgccggctggagtctgagggaaacagcttgcctcgggaagtcttacgcccaaatgtggagccttatgtatttccaccgacgtgacctgagactagcagctaacgccatctgttccgcagtcccctcacattgggttcctacaagtcgcaccacgtggtctattcacgccaaacacgagtggatgacaaccgaggatatgctgactgtgtggaatcgggtatggatccaggaaaacccatggatggaggacaagacacccgtggaaagctgggaggaaattccttacctcggaaaaagggaggaccagtggtgcggctccttgatcggtctgacctcaagagcgacttgggctaagaatatacagaccgccatcaaccaagtccgcagccttattgggaatgaggaatatacagattacatgccatctatgaaacggtttaggcgagaggaagaggaagcaggagtgctgtggtga

SEQ ID NO: 14271 - RNA, 9876 nt, synthetic construct
  misc_feature 1..9876: note = derived and/or modified CDS sequence (opt3) from DENV-2__KF744402__SS-prME
  source 1..9876: mol_type = other RNA
accgccggcatgatcattatgctgatacccaccgtgatggctttccacctcactacgcgaaatggggaacctcatatgatcgtcagcaggcaggaaaaggggaaatcccttctgtttaagaccgaagacggtgttaatatgtgcacattgatggcaatggatttaggcgaactgtgtgaggacactattacctacaaatgcccactactccggcaaaatgaaccggaggatatcgactgttggtgcaattctacatcaacctgggtgacttatgggacatgtaccacgactggagagcaccgccgagaaaagcgtagtgtcgccctggtgccccatgtcggcatgggtcttgagaccagaacagaaacttggatgagctccgagggggcgtggaaacacgctcagaggattgagacctggatcctgcggcatcctggattcacattgatggccgcaatactcgcctacaccatcggcacgactaactttcagcgcgctctgattttcatcctgctcacagcagtggccccatctatgaccatgagatgcattggcatctcgaatagggattttgttgaaggggtgtcaggaggtagctgggtcgacatagtgttagagcacggcagttgtgtaactacaatggctaagaacaagcccaccctggatttcgaacttattaaaacggaggccaagcaccctgcgaccttgcggaaatattgcatcgaagcaaagctgacaaatactaccacagagtcccgctgtccaactcagggggagccctctctaaacgaagaacaagacaaacgatttgtttgcaagcatagcatggtggatagaggatggggcaatggttgtggactcttcggaaagggcggcattgtaacctgcgccatgtttacatgcaaaaagaacatggaagggaaaatcgtgcagcctgagaatctggaatacaccatcgtgattactccacactccggagaggagcatgctgtcggtaacgacacgggcaagcacgggaaagaaataaaggttacaccgcagtcaagtatcaccgaggccgaacttactggatatggcaccgtgacaatggagtgtagccccaggaccggtctggatttcaatgaaatggtattgctccagatggagaacaaagcatggctggtgcaccggcaatggtttttagacctgcctctcccatggcttcccggggctgatactcagggctctaattggattcagaaggagacactggtcacgttcaagaaccctcatgccaaaaagcaggacgtggttgtgttgggatcccaagaaggcgcgatgcacaccgccctaactggggcaacagagatccagatgtcaagcggaaacctgctctttaccggtcatctgaaatgccgtcttcgcatggacaagctgcagttgaaaggcatgagttactctatgtgtacagggaagttcaaggtcgtgaaagaaatagctgagactcaacacggaaccattgtagttagagtgcagtatgagggcgatggttccccatgcaagatccccttcgaaatcatggacctcgagaaaaggcatgtcctggggcggttaattacggtgaatccgatcgtcaccgaaaaggatagccctgtgaacattgaggccgaacccccatttggcgactcgtacgttataatcggagtggagcctggccagctgaaactaaattggttcaagaaggggtcttccattggacagatgtttgagacaactatgcgaggtgctaaacgcatggccatcctcggcgataccgcatgggacttcgggtcactgggaggcgtatttacaagtatcggtaaggcccttcaccaagtcttcggggctatttacggcgcggcatttagcggagtgtcctggactatgaaaatattgatcggcgttattatcacctggattgggatgaactctagaagcacgtcactgagtgtgtccctcatcctggtcggagtggtaacactttatctgggcgtggttgtccaggccgatagcggttgtgtggtgtcttggaggaataaggaattgaaatgcgggtcaggaatattcatcaccgacaacgtccacacttggacagagcagtacaagtttcagcccgaaagtccaagcaagctcgcttccgccattcaaaaagcacatcaggagggcatctgtggtattcggtctgttacccgcctggaaaatttaatgtggaagcagatcactcccgagctgaaccacatactatcggagaatgaagtgaaactcaccattatgacaggcgatatcaaggggattatgcatgccggaaaaagaagcctgaggcctcagccaacggagcttcgttattcctggaagacctggggccgggctaaaatcttgtcaactgaaagtcacaaccaaacattcctgatagacgggccggagaccgccgaatgccccaatacaaaccgagcatggaactctctcgaggtggaggattacggatttggcgtattcactaccaacatctggctgaagttaaaggaaagacaggacgtcttttgtgacagcaaactgatgtccgcggctattaaggataatagggccgtgcacgcagacatgggttattggatcgagtcagcccttaacgatacgtggaaaattgaaaaggctagcttcatcgaggttaaatcttgccattggcctaagtcccacacattgtggagtaacggggtgctcgagagcgaaatgataattccaaagaatttcgccggacccgtctctcagcataactaccgccctggctatcacacccagactgcaggtccatggcatctgggcaaactagagatggactttgatttctgtgaagggaccacagtggttgtgactgaggactgcggaaatcggggcccctccctgagaaccacaacggcttcagggaagctcatcaccgaatggtgctgtaggagttgcactctgccgcctcttcgctaccgaggagaggatggctgttggtacggtatggagatccggccattgaaagaaaaggaggaaaacctggtaaatagcttagtcacagccgggcacggacaaattgacaacttttcgctcggcgtgctgggtatggcgcttttcctggaggaaatgttgcgtaccagagtgggcactaaacacacaatcctcctggtcgccgtttcctttgtgaccctaattacggggaatatgtctttcagggatctgggacgcgtaatggtgatggtcggcgctactatgaccgacaacatagggatgggagtgacatatctcgcactgcttgccgcttttaaggttcggcccaccttcgccgcaggcttgctgttaagaaagctcactagcaaagagctgatgatgacaaccatcggtattgtgcttctgtcacagagtacaatccctgagactattctagaactcaccgatgcgctggccttggggatgatggtcctgaagatcgtgaggaatatggagaaataccagttagctgttacgataatggccatcctctgcgtgcccaacgcagtcattctgcaaaatgcttggaaggtatcctgtacaatccttgccgtggtttctgtgagcccactgttgctcacctcctcacagcagaaagcagactggattcctctggccctaactatcaagggactgaaccccaccgctatatttcttacaactctcagccgaaccagtaagaaacgctcttggccactgaatgaagcgattatggccgtcggcatggtgtccatcttggcaagctcgctgttaaagaacgatatcccgattacgggccctctcgtagctgggggactgcttacagtgtgctatgtcctgaccggtcggtcagccgacttggagctcgaaagagccgctgacgttaggtgggaggagcaggcagaaatatctggcagttcccccatcctgagcattatcatttctgaggatgggagcatgtccatcaaaaatgaagaggaggaacaaactctaacaatactgatccgtaccggacttctcgtgatttcaggcctgttcccagtgagtatccccattactgccgcggcttggtacttgtgggaggtcaagaaacagcgcgccggtgtgttatgggacgttcctagcccaccccctgtagggaaggcagaactggaggatggagcctatcggatcaaacagaagggcatactcggctactctcagattggggctggagtgtataaggaaggtacatttcataccatgtggcacgtcacgagaggcgcagtgctgatgcataaagggaagaggatcgagccgtcctgggccgacgttaaaaaggatcttatctcatacggaggcggttggaaactggagggggaatggaaggagggagaagaggtgcaagtcttggcgctagaaccaggcaagaacccccgagctgtgcagactaaacctggcctgttcaagaccaacgccgggacaattggagcagtaagtctcgactttagcccaggtacctccggctctcccatcatagataaaaaggggaaagtcgtgggactgtacggcaatggtgttgtgacacggaacgggtcgtatgtcagcgccattgctcagactggaaagtcaatcgaggacaatcctgagattgaagatgacatcttccgcaagaaaagacttaccataatggatttacacccgggcgccggcaagacgaaaaggtacctgcccgcaattgtgcgggaggctatcaagcgagggctcagaacattgatcctggccccaactcgcgttgtggcggccgaaatggaggaagcactcaggggactgcctattcgttatcagacccccgctatccgggccgagcatacaggtagagagattgtcgaccttatgtgtcacgctaccttcactatgaggctgttgtccccaatacgcgtgcctaactacaatctaatcattatggatgaagcacactttaccgaccccgccagtatcgccgctcgaggctatatctctacaagagtagagatgggggaagcggcaggaattttcatgacggccactccaccgggcagccgggacccttttccccaatccaacgctccaataatggatgaggagagggaaatccccgagcgctcatggaactctggtcatgaatgggtgaccgacttcaaagggaagacagtttggtttgtccctagcattaaggccggaaacgatatcgcagcctgcctgcgtaaaaatggcaagaaagtgattcagctcagtagaaagaccttcgactccgagtacgtgaaaactcggacaaacgattgggactttgtcgtaaccacggatatcagcgaaatgggcgctaatttcaaggcggagagggtgatagacccacgccgatgtatgaagcccgttatcttaactgatggggaggaaagagtgattctggccggacctatgccggtcacacactcttcagcagctcagcggaggggtcgcatcggcagaaaccccaaaaatgagaacgaccaatatatttacatgggggaaccccttgagaatgatgaagaccatgcccactggaaggaggcaaaaatgctgctcgacaacatcaacacccctgagggaataattccctccatgtttgaaccagagagggaaaaggtggatgccatcgacggcgagtaccggttgcgtggtgaagctcgcaaaaccttcgttgatctgatgcgaagaggggacctccctgtgtggctggcctataaggtcgcggcagagggcattaattacgccgataggcggtggtgctttgacggaatccgcaacaatcagatacttgaggaaaacgtggaggtagaaatctggactaaagagggcgagagaaagaagctaaaacccaggtggctggatgctcggatttatagtgacccattggccttaaaggagttcaaagagttcgctgcagggcgaaagagcctgacactcaatctgatcaccgaaatgggaagacttcctacatttatgactcagaaagcccgcgatgctctggacaacctcgccgtgttgcacacggcagaggcgggtggcagggcctacaatcatgctctgtcggaactaccggagaccctggagacactccttctgttaactttgctggccaccgttacagggggaattttcctctttctgatgtctggcaagggtatcgggaagatgacccttggcatgtgttgcataattactgcatccgtcctgctctggtatgctcagatccaaccccactggatcgccgcaagcattatcttggagttctttctgatagtgttactaattccagagcctgaaaaacagcggacgccccaggataaccagctgacctacgtggtcatcgccattctcacagttgtggctgcgactatggccaatgagatgggattccttgaaaagaccaaaaaggactttggcctggggtcaatcgcaacacaacagccagagagtaacatattggatatcgacctgcgtcctgcttctgcctggaccctctatgccgtagcaactacattcattacgcccatgctgagacattccatcgagaatagctcagtgaacgtcagtcttaccgctattgccaatcaggcgactgtgctcatgggactgggtaaaggctggccgttgagcaagatggacatcggggttccactgttagctattggatgctactcccaggtgaaccctatcacactaaccgccgcactgctccttctggtcgcccactacgctataattggccccggtttgcaagcaaaggccaccagggaagcgcagaaacgcgctgccgcagggatcatgaagaatccaacagtagatggcatcactgtgattgacctggatcccataccttatgacccgaaatttgagaagcagctcggacaggttatgctgcttgtgttatgtgtcacgcaagtgctgatgatgcggaccacatgggccctctgcgaggctttgactctggccaccggccccatctctacactatgggaggggaacccaggacgattctggaataccactattgcagtcagcatggctaacatctttagaggctcctacctggccggtgcggggctccttttctcaattatgaaaaacacgacaaataccaggcgcggaactggcaacatcggtgaaaccctgggcgagaagtggaagtctcggttgaatgccctggggaaaagtgagtttcagatatataagaaatcgggaatccaggaagtggatagaacactcgcaaaggagggcattaaacgtggggaaactgaccatcacgctgttagcaggggatccgccaagctgcggtggttcgtggagcgcaacatggtaacccctgagggcaaagtggtcgatttaggttgtgggcgaggaggctggtcttactattgcggtggccttaagaatgttagagaagtgaaggggctgacaaaaggaggccccgggcacgaggaacctatcccaatgtcaacgtacggatggaacctcgtcaggctacaaagcggcgtggacgtattctttacaccacctgagaagtgtgatactctgttgtgcgacattggtgaatccagtccaaatcccacagtggaggcagggcggaccctgcgcgttctcaaccttgtggagaattggctgaacaataacactcagttctgtatcaaagtcttgaatccgtatatgccttctgtgatagaaaagatggaggctctgcagagaaaatacggaggcgccctcgtcaggaacccattaagccgaaattcaacacatgaaatgtactgggtgtccaacgccagtggcaacattgttagctctgtaaatatgatctcccggatgctgatcaaccgttttaccatgagacacaagaaggcgacgtatgagcccgatgtggaccttgggtcaggaacccgcaatattggtatagaaagcgaggtccctaacctggatatcattggcaaaaggatcgagaagattaaacaggaacatgagacatcgtggcactacgaccaagaccacccatataagacttgggcttaccatgggtcttatgaaaccaaacagacaggaagtgcatccagcatggtgaatggcgttgtgcggctactcactaagccctgggatgtcatcccgatggtgacccagatggccatgacagacaccactcctttcggtcagcaaagagtatttaaggagaaagtggatacgcgcacacaggaacccaaggaggggaccaaaaagctgatgaaaataactgctgagtggttgtggaaggaactgggaaagaaaaagaccccaaggatgtgcacacgagaggagttcacgcggaaagttagatcaaacgccgcactcggcgccatctttaccgacgagaataagtggaaatccgctagggaggcggtcgaagattctcgcttctgggagcttgtggacaaggaacgtaacctgcacttagagggcaaatgtgaaacttgcgtgtacaatatgatggggaagcgggagaagaaactgggagagtttggtaaggccaaaggcagcagagcaatttggtatatgtggttgggggctaggttcctcgaatttgaggccctgggattcctaaacgaagatcattggtttagtcgcgaaaattcccttagcggcgtcgaaggtgaggggctgcacaagctcggatacatcctgcgagacgtttctaaaaaggagggcggcgcaatgtacgccgatgacacagctgggtgggatacccggattactttggaagacctgaagaacgaggaaatggtgacaaatcatatggagggagaacacaaaaagctcgccgaggcgatcttcaaacttacctatcagaacaaggtagtgagagtccagaggcctacaccccgcggtactgtgatggacattatatcaagacgggatcaaaggggcagtgggcaggttggaacctacggcctgaatacgttcaccaacatggaggcacagttaatccgtcaaatggaaggtgagggggtgtttaaatccattcagcacctgacagccactgaagagatcgctgtccagaactggttggcccgagtgggacgcgagagactcagccggatggcaatctctggcgacgattgtgtagttaagccactggacgataggttcgcttcggccctaaccgctcttaatgacatgggcaaggtgcgcaaagatattcagcaatgggaaccctcaagagggtggaacgactggacacaggtccctttttgcagccatcacttccatgagctgataatgaaggatggacgggtgctcgtggtcccatgcaggaatcaggacgaactgatcggtcgagcccgtatttcccagggcgcagggtggagtttgagagagactgcgtgtttaggaaaatcttatgcccaaatgtggagcctgatgtactttcaccgccgggatctcaggcttgctgccaacgcaatctgctccgctgttccgtcacactgggtgcccaccagtagaacgacatggtctattcatgccaagcacgaatggatgaccactgaggacatgctgacagtatggaatcgcgtgtggatccaggagaacccttggatggaagataaaaccccagtcgagagctgggaagagataccctatctaggcaagcgggaagaccagtggtgtggttccctgatcgggctcacttcaagggcaacctgggccaagaatattcagacagcgatcaaccaagtgcggagcttgattggaaatgaggagtacacggactatatgccttctatgaaaagattcagaagggaagaggaagaggctggcgttctgtggtga

SEQ ID NO: 14272 - RNA, 9876 nt, synthetic construct
  misc_feature 1..9876: note = derived and/or modified CDS sequence (opt3) from DENV-2__KF744408__SS-prME
  source 1..9876: mol_type = other RNA
accgccggaatgatcattatgctgatacccacagtgatggctttccacctcactacgcggaacggggaacctcatatgatcgtctcaaggcaggaaaaggggaaatcccttctgtttaagaccgaagacggtgttaatatgtgcaccttgatggctatggatttaggagaactgtgtgaggacactattacctacaaatgcccattactccggcaaaacgaaccggaggatatcgactgttggtgcaattctacatcaacctgggtgacttatgggacatgtaccacgactggagagcaccgccgagaaaagcgtagtgtggccctggtgccccatgtcggcatgggtcttgagaccaggacagaaacttggatgagctccgagggggcgtggaaacacgctcagaggattgagacctggatcctgcggcatcctggattcacattgatggccgcaatactcgcctacaccatcggcacgactaactttcagcgcgctctgattttcatcctgctcacagcagtggccccatctatgaccatgagatgcattggcatctcgaatagggattttgttgaaggggtgtcaggaggtagctgggtcgacatagtgttagagcacggcagttgtgtcactacaatggctaagaacaagcccaccctggatttcgaacttattaaaacggaggccaagcaccctgcgaccttgcggaaatattgcatcgaagcaaagctgacaaatactaccacagcctcccgctgtccaactcagggggagccctctctaaacgaggaacaagacaaacgatttgtttgcaagcatagcatggtggatagaggatggggcaatggttgtggactcttcggaaagggcggcattgtaacctgcgctatgtttacatgcaaaaagaacatggaggggaaaatcgtgcagcctgaaaatctggagtacaccatcgtgattactccacactccggagaagaacatgccgtcggtaacgacacgggcaagcacgggaaagagataaagatcacaccgcagtcaagtattaccgaagcagagcttactggatatggcaccgttacaatggaatgtagccccaggaccggtctggggttcaatgagatggtgttgctccagatggaagataaggcttggctggtacaccggcaatggtttttagacctgcctctcccatggcttcccggcgccgatactcagggatctaactggatccagaaggagacactggtgacgttcaagaatcctcatgcgaaaaagcaggacgtcgtggttttgggctcccaagagggggccatgcacaccgcactaactggagctacagaaatacagatgtcaagcggtaacctgctctttaccggccatctgaaatgccgtcttcgcatggacaagctgcagttgaaagggatgagttactctatgtgtacaggaaagttcaaggtggtcaaagagattgccgaaactcaacacggcaccatcgtggtaagagttcagtatgagggtgatgggtccccatgcaagatccccttcgagattatggacctcgagaaaaggcatgtgctgggccggttaatcacggtcaacccgattgtgaccgagaaggatagccctgtcaatatagaagctgagcccccatttggagactcgtacgtgatcattggcgttgaacctgggcagctgaaactatcttggttcaagaagggatcctcaatcggtcagatgtttgagacaactatgcgaggcgccaaacgcatggcaatcctcggggataccgcctgggacttcggaagtctgggcggtgtgtttacaagcattgggaaggcacttcaccaagtattcggcgcgatatacggagcagccttttccggcgtctcttggactatgaaaatcttgattggggtgatcattacctggatcggaatgaacagcagatcaacgagtctgtccgttagcctcgtgctggtcggcgtggtaacactttatctgggtgtggttgtccaggctgattctgggtgtgtggtgtcatggaggaataaggagttgaaatgcggaagtggcatattcatcaccgacaacgtccacacttggacagaacagtacaagtttcagcccgagagcccatccaagctcgcctctgcaattcaaaaagcccatcaggaaggtatctgtggcattcggtcggttacccgcctggagaatttaatgtggaagcagatcactcccgaactgaaccacatactaagcgagaatgaggtgaaactcaccattatgacaggggatatcaagggaattatgcaggctggcaaaagatccctgaggcctcaaccaacggaacttcgttattcatggaagacctgggggaaagccaagatcttgagtactgagtctcataaccagacattcctgatagacggaccggaaaccgcagagtgccccaatacaaaccgggcgtggaatagcctcgaagtggaggattacggctttggtgtattcactaccaacatctggctgcgattaagagagaagcaggacgctttttgtgactccaaactgatgtcagccgcaattaaggataatagggccgtccacgctgacatggggtattggatcgaaagcgcccttaacgatacgtggaaaattgagaaggcatctttcatcgaagtgaaatcctgccactggcctaagagtcatacattgtggagcaatggagttctcgagtctgagatgataattccaaagaacttcgctggccccgtgtcccagcacaactaccgccctggttatcatacccaaactgccggcccatggcacctggggaaactagaaatggactttgatttctgtaagggaaccacagtcgtggttactgaggactgcggcaatcgggggccctcactgagaaccacaacggcgagtggaaaactcatcaccgaatggtgctgtaggagctgcactctgccgcctcttcgctaccgaggcgaggatggttgttggtacgggatggaaatccggccattgaaggagaaagaggaaaacctggtaaattcgttagtaacagccggacatggccagattgacaacttttccctcggtgtcctgggcatggctcttttcctggaggaaatgttgcgtaccagagtggggactaagcacgcaatcctcctggtggccgtctcttttgttacactaattaccggaaatatgagcttcagggatctgggccgcgtgatggtaatggtgggggctacgatgactgacgatataggaatgggcgtcacctatctcgccctgcttgcagcgtttaaggtgcggcccacattcgccgctggtttgctgttaagaaaactcacctcaaaggagctgatgatgactacaatcgggattgttcttctgagtcagtccaccatccctgaaacaattctagagctcactgacgccctggcattgggaatgatggtgctgaaaatcgtcaggaacatggagaagtaccaattagctgtgaccataatggccatcctctgcgttcccaatgcagtgattctgcagaacgcctggaaagtctcttgtacgatccttgctgtagtgagcgtttccccactgttgctcacatcaagccagcagaaggcggattggattcctctggccctaaccatcaagggcctgaatcccactgcaatatttcttaccacactcagtcgaacttctaaaaagcgctcctggccactgaacgaagctattatggccgtgggcatggtcagcatcttggcctcgtcactgctcaaaaatgacatcccgatgaccgggcctctagtggctggaggtctgcttacggtatgctatgtgctgacaggccggtctgcagacttggagctcgaaaaggccgcggatgtcagatgggaggaccaagctgaaattagtgggtccagccccatactgtctatcattatcagcgaggatggatccatgtcaattaaaaacgaggaagaggaacagaccctaactatcctgataaggacaggccttctcgttatcagtggtctgttcccagtgagcattcccatcaccgccgcagcctggtacttgtgggaggtgaagaaacagcgtgctggggtcttatgggacgtgccttctccaccccctgttggaaaggcagagctggaagatggcgcctatcgcattaagcagaaaggcatcctcgggtactcccaaataggagcgggtgtatataaggagggcacttttcacacaatgtggcatgtgaccagaggggctgtcctgatgcacaaaggaaagagaattgaaccgtcatgggccgacgtgaaaaaggatcttatcagttacggcggtgggtggaagctggagggagaatggaaagagggcgaggaagttcaggtgttggcactagagccaggcaagaatcccagggccgtccagacgaaacctgggctgttcaagactaacgctggaaccatcggtgccgtgagcctcgacttttccccaggcacatctgggtcgcccattatcgataaaaagggaaaggtagtcggcctgtacggtaatggggtggttacccgaaacggaagctatgtgtcagcaatagctcagacagaaaaatccattgaggacaaccctgaaatcgaggatgacattttccggaagaaacgccttactatcatggatttacatccgggcgccggcaagaccaaaagatacctgcccgcgatagtcagggaggccattaagcgggggctccgaacgttgatcctggcaccaacaagagtggttgctgccgaaatggaggaagctctccgcggactgcctatcaggtatcaaactcccgcaattcgtgccgagcacaccggtcgggaaatcgtggaccttatgtgtcatgccacattcaccatgagactgttgagtccaattagggtccctaattacaacctaataatcatggacgaggctcactttactgatcccgcgtctattgcagcccgcggctatatcagcacccgagtggagatgggggaagctgccggaatcttcatgacagcaacgccaccgggctccagagacccttttccccagtcaaatgccccaattatggatgaggaacgggagatacccgagaggtcttggaacagcggtcacgaatgggtaactgacttcaaggggaaaaccgtgtggtttgttcctagtatcaaggctggaaatgatattgcggcctgcctgcgcaaaaacggcaagaaagtcatccagctctcccgtaagacattcgacagcgagtacgtgaagaccagaactaatgattgggactttgtggtcacaaccgatatttctgaaatgggcgcaaacttcaaagctgagcgggtaatcgacccaaggcgctgtatgaagcccgtgatattaacggatggggaagaacgagttatcctggccggacctatgccggtgactcattcatccgcagcccaaagacggggtaggattggccgcaatcccaaaaacgagaatgaccagtatatctacatgggggaaccacttgagaacgacgaagattgcgctcactggaaggaggccaaaatgctgctcgacaatattaacacacctgaaggaatcatacccagtatgtttgagccagagagagaaaaggtcgatgcgattgacggcgagtacaggttgcggggtgaagcacgtaaaaccttcgtggatctgatgcgccgaggggacctccctgtttggctggcctataaggtggctgccgagggcatcaattacgctgatagaaggtggtgttttgacggcattcggaacaaccagatccttgaagagaatgtcgaggtggaaatatggaccaaggagggcgaacgcaaaaagctaaaacccagatggctggatgcaaggatctatagcgacccattggccttaaaggagttcaaagagttcgctgccgggcggaagtcgctgactctcaacctgattacagaaatgggacgacttcctacctttatgacacagaaggcaagaaatgcgctggataacctcgccgtattgcatactgctgaggccggtggccgcgcatacaatcacgctctgtctgaactaccggagacgctggaaaccctccttctgttaacattgctggccactgtgaccgggggaatcttcctctttctgatgtccggcaaaggtattgggaagatgacacttggcatgtgctgcatcataaccgcaagcgttctgctctggtatgcccaaattcagccccactggatcgctgcgtcaatcattttggagttctttctgatcgtcttactaataccagagcctgaaaaacagaggactccccaggacaaccaactgacgtacgtggtgattgccatcctcaccgtcgttgcagctacaatggccaatgagatgggattccttgaaaagactaaaaaggatctgggcttggggagtattaccacacagcagccagagtctaacatcctggacatagacctccggcctgcctccgcatggaccctgtatgctgtggccactacatttatcacgcccatgcttcgtcatagcattgaaaattcaagtgtaaacgtgagcctcaccgcgatcgctaatcaggccactgtcctgatgggattgggtaagggctggccgctgtccaaaatggatattggggtgccattactagcaatcggatgttactctcaagttaaccctattacactgaccgccgctctccttctgttggtggcacactacgccatcataggccccggtctgcaggcgaaggctaccagagaggcccagaaaagggcagccgctgggattatgaagaatccaacagtcgacggcatcactgtaatcgatctcgaccccattccttatgatccgaaattcgagaagcagctgggacaagtgatgcttttagttctgtgcgtgacgcaggtcctcatgatgcgcaccacatgggccttgtgtgaagcactgactctagctaccggccccataagcacactgtgggaggggaacccaggacggttttggaataccactatcgccgtgtccatggcgaacattttccgaggctcatacctcgccggtgcagggcttctgttttctatcatgaagaatacgacaaacaccagaaggggaactggcaacattggtgaaaccttgggcgagaaatggaagagtcgcctgaatgctctcgggaaatcggagttccagatctataagaaaagcggaatacaagaggtcgaccggacactggccaaggagggcatcaaaagaggggaaactgatcatcacgcagtgtcccgtggatctgctaagttaaggtggtttgttgagcggaacatgattacccctgaaggcaaggtggtagaccttggttgcgggcgcggaggctggtcatactattgtggtggcctgaaaaatgtgcgagaggtcaaggggctcacaaaaggaggccccgggcatgaggaacctatcccaatgagcacgtacggatggaacctagttagactgcagtccggcgtggatgtcttcttcacaccccctgagaagtgcgacactttgctgtgtgatattggtgaaagttctccaaatcccacagtggaggccgggaggaccctccgggtacttaacctggtggaaaattggttgaacaataacactcagttttgcatcaaagttctgaatccgtatatgcctagcgtgatagagaagatggaggccctccagcgcaagtacggaggcgcgttagtcagaaacccactgtcaagaaattccacacacgaaatgtactgggtgagtaacgctagcggcaatattgtctcttccgtgaacatgatctcacgaatgcttatcaaccggttcaccatgaaacacaagaaagcaacgtatgagcccgacgttgatctggggagcggaacccgtaatattggtatagaatcggaggtacctaacctagacatcattggcaagagaatcgagaaaattaagcaagagcatgagacatcttggcactacgaccaggatcatccatataagacttgggcctaccacgggagttatgaaaccaaacagacaggatccgctagctcaatggtgaatggcgtcgtgcgcctcctgactaagccctgggacgttatcccgatggtgacccagatggccatgacagataccactccttttggtcaacagagggtcttcaaagagaaggtggacacgcggacacaggaacccaaagaggggaccaagaagttgatgaaaataactgcagaatggctgtggaaggagctcggcaaaaagaaaaccccaagaatgtgtacacgcgaggaatttacgaggaaagtacgatccaacgccgctcttggcgcgatcttcaccgatgagaataaatggaagtctgcccgggaagcagtggaggacagcagattttgggagctggttgataaggaaaggaacttacacctggagggcaaatgcgaaacttgtgtctacaatatgatggggaagcgcgagaaaaagttgggagagttcggtaaagctaagggcagtcgtgccatttggtatatgtggctcggggcacggtttctggagttcgaggccctaggatttcttaacgaagaccattggttctccagagagaatagcctgtctggcgtggaaggtgaggggctccacaagctgggatacatcttgagggatgtgagcaaaaaggaaggcggcgctatgtacgccgacgatacagcggggtgggacacccgcattactctggaggacctcaaaaacgaggaaatggtcacaaatcatatggagggagaacacaagaaacttgcagaggccatctttaagctgacctatcagaacaaggttgtgcgagtacaacggcctacacccagaggtactgtgatggatattataagtaggcgcgaccagagaggctccgggcaggtcggaacctacggcttaaatacgttcaccaacatggaagctcaactgatccggcagatggagggtgagggggtgttcaaaagcattcagcatttgacagccactgaagagatcgcagttcagaattggctcgctagggtgggacgtgaacgactgtctcgcatggccatctcgggcgatgactgcgtcgtgaagccactagatgacagatttgcttcagcccttaccgcactgaacgatatgggcaaagtacggaaggacattcaacagtgggagcccagcaaagggtggaacgattggacacaggttcctttctgctcccaccactttcatgagctcataatgaaggacggaagggtgctggtcgtgccatgtcgcaatcaggatgaattgatcggtagagcgcggattagtcaaggcgccgggtggtctttaagggagactgcttgcctgggaaagagctatgcccagatgtggtccctcatgtacttccaccgacgtgaccttagactggcagctaacgccatctgttcagcagtgccgagtcattgggtccccacctctcgcacgacatggagcattcacgccaaacacgaatggatgaccactgaggatatgctaacagtttggaatcgggtgtggatccaggaaaacccttggatggaggacaagaccccagtagagtcctgggaagagataccctatctgggcaaaagggaagaccagtggtgcggttcactcatcgggttgactagcagagcgacctgggctaagaatattcaaacagccatcaaccaggtgcgctctctgattggaaatgaggaatacacggattatatgccttccatgaaacggtttaggcgagaggaggaagaggcaggcgtcctttggtga

SEQ ID NO: 14273 - RNA, 9876 nt, synthetic construct
  misc_feature 1..9876: note = derived and/or modified CDS sequence (opt3) from DENV-2__JX669476__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagagcgagaacctcgaatacaccatagtcatcactcctcactccggtgaggagcatgctgttggcaatgacacggggaagcacggaaaagaaattaagatcacaccacagtcaagtaccactgaggccgaactgaccggctatggtacagtgaccatggagtgtagcccgaggactgggcttgatttcaacgaaatggtactgttgcaaatggaggacaaagcatggctcgtgcaccggcagtggtttctggatttacccctgccttggctcccaggcgctgacacacagggatctaattggatacagaaggagacgcttgtcaccttcaagaacccccatgccaaaaagcaagacgtggttgtgctgggctcccaggaaggggcgatgcacactgccttgacaggagcaaccgagattcagatgtcaagcggtaatctactgtttacaggccatctcaaatgccgtctgcgcatggataagcttcaactgaaagggatgagttactctatgtgtactggaaagttcaagatcgtcaaagaaatcgctgagacccagcacggcacgattgtgatcagagtacagtatgagggtgacgggtccccttgcaagattccattcgaaataaccgatttggagaaaaggcatgttctcggccggctgatcacagtgaaccccattgtcactgaaaaggacagcccggtgaacatcgaggccgaacctccctttggagattcgtacatcattgtcggcgtggagccagggcagttaaaactgaattggttcaagaagggatcttccataggtcaaatgtttgagaccacaatgcgaggcgctaaacgcatggccatcctaggggacactgcatgggatttcggatcactcggcggtgtttttaccagtattgggaaggccctgcaccaggtgttcggcgctatctacggagcggcatttagcggcgtatcctggacgatgaaaattcttatcggggtcataatcacatggattggaatgaactctagaagcacctcattgagtgtgtccctggttctcgtgggcgtcgtgactctgtatcttggtgccatggtacaggctgacagcgggtgtatcgtgtcttggaagaataaagaactgaagtgcggatcaggcattttcatcacagataacgttcacacctggactgagcagtacaagtttcaacctgaattccccagtaaattggccagcgcaatacagaaggcccatgaggaaggtatttgtggcatcaggtccgtcacccggctcgagaatctgatgtggaaacagattacaccagagttaaaccacatcctgtctgaaaatgaggtgaagctaacgataatgaccggggacatcaaaggaattatgcaggctggcaagcgctcgctcagaccccaacctactgaactgaaatatagctggaagacatgggggaaggccaaaatgctttccaccgagtcacataaccagacatttttgatcgatggaccagaaactgcagagtgcccgaataccaacagggcgtggaatagtctggaggtggaagactacggcttcggtgtctttacgacaaacatttggctcaagctgcgtgagaaacaggacgttttctgtgattctaagttaatgagcgctgccatcaaagacaatcgggcagtgcacgccgatatggggtattggatagaatccgctctgaacgacacctggaaggtggagaaggcctcattcattgaggtaaaaagctgccactggcccaagtctcatactctttggtccaatggagtcttggaaagtgagatgatcatccctaaaaactttgcaggcccagtgagccagcacaactaccgacccggttatcatacccaaacagctggcccttggcacctcgggaagctggaaatggatttcgacttttgtgagggaactaccgttgtggtcacagaagattgcggcaatagagggccatctctaaggacgaccactgcctccggaaaactgattacagagtggtgctgtcgctcatgcaccctccccccgctgcggtacagaggcgaggacggttgttggtacgggatggaaatcaggcctcttaaggagaaggaagagaacttggtgaatagtctggttactgcgggacatggccagattgataacttcagcttaggtgtgctcggcatggccctgtttcttgaagagatgctgcgcacacgagtagggaccaaacacgctatattgctcgtcgcactgtcgttcgtgacgctaatcactggaaatatgtcctttcgggacctgggccgtgtgatggtcatggttggggccaccatgacagatgacattggaatgggcgtgacctatctcgctctgcttgccgcattcaaggtaagaccaacttttgcggccggtttgctgttaaggaaactcacatctaaggagctgatgatggctaccatcgggattgcccttctgagccagtcaacactacccgaaactatcctcgagctgaccgatgcattggctctgggaatgatggccttaaaaatagtgcgcaacatggaaaagtaccaactcgcagtcacgatcatggccattagttgcgtgcctaatgctgttatcctgcagaacgcgtggaaggtgtcctgtacaattcttgccgcagtctctgtgagccccctgttgctcacctcctcacagcagaaaactgactggatcccactggctctaaccataaagggcctgaatcctacagccattttccttactaccctcagccggacgagtaaaaagagatcttggcccctgaacgaggccatcatggctgttggcatggtgtccatcttggcaagctcgctgttaaaaaatgacattccaatgacagggccgctcgtcgccggaggtctgcttaccgtatgctatgtgctgactggcaggtcagcggatttggaactcgagcgagctgccgacgttaagtgggaggatcaagcagaaatatctgggagttcccctatcctgagcattacaatctctgaggacggaagcatgtccattaaaaacgaagaggaggaacagaccctaactatcctgatacgcacaggccttctcgtgatctcaggtgtctttcccgtgagtattccaatcaccgccgctgcatggtacctgtgggaggtaaagaagcagcgggccggggtgttgtgggatgtccccagccctccacccgttgaaaaagcggagttagaagacggagcttatagaattaagcagaggggcatcctgggctactctcaaataggggccggagtgtataaagagggtacgttccacactatgtggcatgtgacccgtggcgcagtcctcatgcaccgcgggaagcggattgagccttcctgggccgatgtgaaaaaggacctgatctcatacggaggcggttggaagcttgaaggggagtggaaagaaggagaggaagttcaggtactggctttggagccgggcaagaatccaagagccgtgcagacaaaacccggcatctttaagaccaacacagggactattggagcagtcagtctagatttcagccctggtacctccggctctccaatcgtggacaggaaagggaaggttgtgggactgtacggcaatggtgtcgtgacgcgatcgggggcttatgtaagcgccatagcgcagacagagaagtcaattgaagataaccccgagatcgaagacgatattttccggaaaaagcgcctcactatcatggacctgcatcctggagccggcaaaaccaagagataccttccggcaatagtcagggaggctattaaacggggcttacgaacactgatcctcgcccccaccagagtggttgctgcagaaatggaggaggccttgcgcgggctgccaatcaggtatcaaactcctgccattcgtgctgaacacaccggacgggagatcgtggacctcatgtgtcatgcgacatttacgatgagactgctttcccccgtcagggtgccaaactacaatctgattataatggatgaagcacacttcactgaccctgccagtatcgctgcccgcggttatatttctacccgagttgagatgggcgaggcagccgggatctttatgacagctacccccccaggaagcagagatccgttccctcagtccaacgcgcccatcatggacgaagagcgggaaattccagagaggtcatggaattctggccacgaatgggtgactgattttaagggtaagacagtctggttcgtgcccagcataaaagccgggaacgacatcgcagcttgcttgcgcaagaatggaaaaaaggtaattcagctaagtcgtaaaacctttgattccgagtacgtgaagacgagagccaacgactgggatttcgttgtcactacagacatcagcgagatgggcgcaaattttaaggccgaacgggtgattgatcctaggcgctgtatgaaaccagtgatcctgaccgacggcgaggaacgagtcatactcgctgggcccatgcctgtaacccattcttcagccgcgcaaagacggggaaggatcggtcgcaacccgaagaatgagaacgaccagtatatttacatgggcgaaccattagagaatgatgaggactgcgcacactggaaagaagccaagatgctgcttgataacatcaatactcccgaggggattatcccttccatgttcgaacccgagagagaaaaagtggacgctatagatggagagtacaggctgcggggcgaggcccgtaagacatttgttgacctcatgcgccgaggtgatttgccagtgtggctggcttataaagtcgcagccgaagggattaactacgctgacagaaagtggtgtttcgatggcatcaagaataaccagattctcgaggaaaacgtggaggttgagatctggaccaaagaaggagagaggaagaaactgaagcctcggtggcttgacgcccgcatatatagtgatcccctagcactgaaagaattcaaggagtttgcggccggcagaaagagcttgacattaaatctgatcactgaaatggggaggctcccaacgttcatgacccagaaagctcggaacgccctggacaatcttgcagtgctgcatacagctgaggtcggaggtcgagcctacactcacgcactctcggagttgcctgaaaccctggagacactactgctccttaccctgttagccgctgtgactggcgggatttttttgttcctgatgtctggaaagggcatcggtaaaatgacgctcgggatgtgctgcattatcaccgcgtccatactgctttggtatgcccaaattcagccgcactggatcgcagctagcatcattctggaatttttcctcatcgtattgctgatacccgagccagaaaagcagagaacacctcaggataaccaattaacttacgtggttattgccatcctaaccgtcgtggccgcaacaatggctaatgagatgggctttctggagaaaaccaagaaggacctcggattcggctcaattactacacaggaaagtgagtctaacatccttgacatagatctgcgccccgcctccgcgtggacgttgtatgctgtggccaccacttttgtcacaccaatgctgaggcatagcatcgaaaattcaagtgttaacgtgagcctcaccgcaattgccaatcaggctaccgtactgatggggcttggaaaaggttggcctctctccaagatggacatcggcgtgcccctgttggcaattgggtgttactctcaggtcaacccgatcacactgactgccgcgttactactgctcgtggctcactacgccattatcggaccaggccttcaagcaaaagccacgcgggaggctcagaagcgtgccgcagctggtataatgaaaaatcctaccgttgatgggattacagtgatcgacctggaacccatcccatatgatcccaagttcgagaagcagttgggccaggtcatgctgctcattctgtgcgtaactcaagtgcttatgatgagaaccacatgggccttatgtgaggcgctgaccctcgccactggacctataagcacgttgtgggaaggcaacccggggaggttttggaatacaaccatcgcagtttccatggctaacattttccgcggatcatacctggccggcgcaggtctactgttttctatcatgaaaaatactaccaacacacggcgagggactggaaatgtgggcgagaccctcggtgaaaagtggaaaagtagacttaacgctctgggcaagtcggagttccagatttataaaaagagcgggatccaggaggtcgacaggacattggccaaagaaggaataaagcgcggcgagacggatcatcacgccgtgtcccgggggtctgcgaagctgagatggttcgtcgaacgtaacatggtgacccccgagggaaaagttgtggacctcggctgcggtagggggggatggtcatactattgtggcggtctgaagaatgtacgggaagtgaaaggcttaactaaggggggaccaggccatgaggagcctatccccatgagcacatacgggtggaaccttgtccgcctgcaatccggagttgatgtgtttttcacccctccagaaaaatgcgacactctcctatgtgatattggcgagagttctcccaatcctacaatcgaagctggtcgaaccctgagagtcttgaacctggtggagaattggctcaacaataacacgcagttttgcattaaggtacttaatccatatatgcccagcgtgatcgaaaagatggagaccctgcagaggaaatacgggggagcattggttcggaacccgctgtcacgcaattccacacacgagatgtactgggtgagtaacgccactggcaatatagtcagctctgtgaacatgatttccagaatgctcatcaataggttcaccatgaagcacaaaaaggctacatatgaacctgacgtcgatttaggctcagggactcgaaacatcggaattgagagcgaaataccaaacctggacatcattggtaaacggatcgagaagattaagcaggaacatgagatctcgtggcactacgaccaagatcatccctataaaacctgggcctaccacggctcttatgagacaaagcagaccgggagtgcatccagcatggtgaatggagttgtacgtcttctgactaaaccttgggacgtggtcccaatggtgacgcagatggccatgacagataccactccctttggccagcaaagagttttcaaggaaaaagtggacacccgcacacaggagccgaaggaaggtacgaagaaactaatgaagataaccgctgagtggctctggaaagagctggggaaggaaaaaactcctaggatgtgtacacgggaggaatttaccagaaaggtccgctcaaacgcggccttgggagcagtgttcactgatgagaataaatggaagtccgctagggaagccgtagaggacgatcgattttgggagctggtggaccgggaaagaaacctccaccttgagggcaagtgcgaaacatgtgtttacaatatgatgggcaaaagggagaagaaactgggggaattcggaaaggcaaaaggttctcgcgccatctggtatatgtggttaggcgctcgttttctggagttcgaggccttggggtttctcaacgaagatcattggttcagccggggaaatagtctgtccggcgtcgagggtgaagggctacacagacttggatacattctgagggaggtgggcaagaaggaaggcggggcgatgtacgcagacgataccgccggatgggacacacgcatcactctcgaggacctgaaaaacgaggaaatggtgaccaatcatatgaagggtgagcacaaaaagttggctgaagccattttcaaactgacgtatcagaacaaggtcgttcgagtgcagcggcccaccccaagaggcacagtaatggatatcattagcaggaaggaccaacgcgggtctggacaggtgggcacttacggtctcaatacctttacaaacatggaggcacagcttataagacaaatggagggggaaggaatcttcaaatcaattcagcatctgactgctaccgaggaaatcgccgtccagaattggttagctcgggtgggcagggagcgtctgagtcgaatggccatctccggcgatgactgcgttgtgaagcctattgatgaccgctttgcaagcgcgttgacggccctcaacgatatggggaaagtcagaaaggacatacagcaatgggaaccctctcggggatggaatgattggacacaggtgccattctgctcgcaccactttcatgagctggtaatgaaagacggtagggttctagtggtcccctgtcgcaaccaggatgagcttatcggcagagctcggatttcacagggggccggatggagcctgaaggaaaccgcatgcctcggcaagtcctatgctcaaatgtggactctgatgtacttccacaggcgagacttgcgtttagccgcaaacgccatctgtagtgcggtgccttctcattgggtgccaacaagcagaaccacttggtccattcacgctaaacacgagtggatgaccacagaagatatgctgacggtctggaatcgcgtttggatccaggagaacccgtggatggaagacaagacccccgtggagtcatgggaggaagtaccttatctcggtaaacgggaggaccagtggtgcgggagtcttataggactgacttctagggccacatgggcaaagaatatccagaccgccattaaccaagtgagaagcctaatcggcaatgaaggctacactgattatatgccatccatgaaacgctttcggagggaggaagaggaggctggggtcctgtggtga

SEQ ID NO: 14274 - RNA, 9876 nt, synthetic construct
  misc_feature 1..9876: note = derived and/or modified CDS sequence (opt3) from DENV-2__JX475906__SS-prME
  source 1..9876: mol_type = other RNA
accgtgggcatgatcattatgctgatacccacagccatggctttccacctcactacgagaaatggggaacctcatatgatcgtcagcaggcaggaaaagggaaagtcccttctgtttaagaccgaagacggtgttaatatgtgcacattgatggcaatggatttaggcgaactgtgtgaagacactgtgacctacaactgcccactactccggcaaaatgaaccggaggatattgactgttggtgcaactctacatcaacctgggttacttatgggacatgtaccgccacgggagagcaccgccgagaaaaacgtagtgtggcgctggtcccccatgtgggcatgggtcttgagactagaaccgaaacatggatgagctccgagggggcttggaagcacgcccagaggatcgagacttggattctgcggcatcctggattcaccatcatggcagccatattggcttacacaatcggcaccacgtattttcagcgcgttctcattttcatcctgctgactgcagtggccccatctatgacaatgagatgcattggcatctcgaatagggattttgtcgaaggggtgtcaggaggtagctgggtagacatagttctcgagcacggcagttgtgtgaccactatggctaaaaacaagcccacattagatttcgaactgattaagaccgaggccaaacagcctgcgacgcttcggaagtactgcatcgaagcaaaattgaccaatacaactaccgcctcccgctgtccaacacaaggggagccctctctgaacgaggaacaggacaagcgatttgtctgcaaacacagcatggtggatagaggatggggcaatggttgtgggctattcggaaagggcggcattgtgacttgcgctatgtttacctgcaagaaaaacatggaggggaagatcgtccagcctgaaaatctcgagtatacaatcgttattaccccacattccggagaagagaacgccgtgggtaatgacactggcaaacacgggaaggaggtaaaagtgacgccgcagtcaagtataacagaagcagagctgaccggatacggcactgtcaccatggaatgtagccccaggacaggtcttgatttcaacgagatggtgctgttgcaaatggaaaataaggcttggctcgttcatcggcagtggtttctggacttacctctgccatggctccccggggccgatacccagggctctaactggatccagaaagagactcttgtgacattcaagaaccctcacgcgaagaaacaagacgtcgtggtactgggatcccaggagggcgccatgcacacggcattgaccggggctactgaaattcagatgtcaagcggaaatctactgtttacaggtcatctcaagtgccgtctgcgcatggacaaacttcaactgaagggcatgagttattctatgtgtaccgggaaattcaaggttgtgaaggagatcgccgaaacacagcacggaactatagtcattagagtgcagtacgagggcgatggttccccatgcaaaatccccttcgagatcatggacttggaaaagaggcatgtcctcgggcggctgattaccgtgaacccgatcgttacggagaaagatagccctgtgaatattgaagctgagcccccatttggcgactcgtacataatcattggagtagaacctggccagttaaagctgtcttggttcaaaaaggggtcctcaatcggacaaatgtttgagaccacaatgcgaggtgccaagcgcatggcaatcctaggcgatactgcctgggacttcgggagtctcggaggcgtctttaccagcattggtaaagctctgcaccaggtgttcggggcgatatatggcgcagccttttccggagtttcttggacaatgaagatccttattggcgtggtcatcacttggattgggatgaacagcagatcaaccagtttgtccgtgagcctggtactcgtgggagttgtcacgctgtaccttggcgtgatggtgcaggctgattctggttgtgtcgtttcatggaaaaataaggagctgaaatgcgggagtggaatcttcataacagacaacgtgcatacctggactgaacagtataagtttcaacccgagagcccatccaagttggcctctgcaatccagaaagcccacgaagagggcatttgtggtatcaggtcggtgacacggctcgaaaatctgatgtggaagcagattacccccgagttaaaccacatcctgagcgagaatgaagtaaaactaactataatgaccggcgatattaaggggatcatgcaggctggaaaacgctccctcagacctcaaccaacagagctgaagtactcatggaaaacgtggggcaaggccaagatgcttagtaccgaaccgcataaccagactttcttgattgacgggcccgagacagcagaatgccctaataccaacagggcgtggaactctctggaggtcgaggattatggatttggcgtgttcacaactaacatctggctcaaactgaaggaacgtcaggacgtattttgtgacagcaaattaatgtccgctgccataaaggataatcgggcagtgcacgccgacatgggttactggatcgagtcagctctgaacgatacctggaaaattgaaaaggccagcttcatcgaggtcaagtcttgccattggccaaaatcccacacgctttggagtaacggggtgttggagagcgaaatgattatccccaagaatttcgcaggacctgtttctcagcacaactatcgaccaggctaccatacacaaaccgctggtccctggcacctcggcaaactggagatggactttgatttctgtgaagggactaccgtggtagtcacagaggactgcggaaatagaggcccgtccctaaggactaccacagcctcagggaagctgataacggaatggtgctgtcgcagttgcaccctccctccactgcggtacagaggagaggatggctgttggtatggtatggagattaggccccttaaagaaaaggaggaaaacttggtgaatagcctggtgactgcggggcatggacagatcgacaacttttcgttaggcgtcctcggtatggccctgttccttgaggaaatgctgcgcacacgagttggcaccaagcacgctttgctcctggtggcagtatcctttatgactctaatcacagggaatatgtctttccgggatctgggacgtgtgatggtcatggtgggcgccgctatgaccgacgatattgggatgggagttacgtacctcgccctgcttgcagcgtttaaagtgagacctactttcgccgctggcttgctgttaaggaagctcaccagcaaagagctgatgatgacaaccatcggtattgtccttctgtcacagagtactatacccgagacaatcctagaactcaccgacgccctggcattggggatgatgattctgaagatcgtgcgcaacatggagaaatatcaattagctgttacaattatggccatcctctgcgtgccaaatgcagtcatactgcagaacgcctggaaggtatcctgtactatccttgctgtggtttctgtgagccctctgttgctcacctcctcacggcagaaggcggattggattcccctggccctaacgatcaaaggactgaatccaacagcaatttttcttaccactctcagcagaaccaacaagaaaaggagttggccgctgaatgaagctatcatggccgtcggcatggtgtctatattggcctccagcctgttaaagaacgacattcctatgacaggccccctcgtagctgggggactgcttactgtgtgctacgtcctgaccggtcgatcggcagacttggagctcgaacgcgccgcggatgttcggtgggaggaccaggctgagatctcaggctctagtccaatcctgtccattacgataagcgaagatgggtctatgagcatcaaaaatgaggaagaggagcaaacactaaccattctgatcagaactggacttctcgtgatttccggcctgttccccgtgtcaatccctataacagccgcagcctggtatttgtgggaagtcaagaaacagagggctggtgtgttatgggacgttccaagtccccctccggtagggaaggcagagctggaagatggagcctaccgtatcaagcagaaaggcattctcggctatagccagatcggggcgggagtgtacaaggagggtacctttcatactatgtggcacgtcacacgcggcgctgtgctgatgcacaaagggaagcggattgaaccatcttgggccgacgttagaaaagatcttatctcctacggaggcggttggaagctggagggggagtggaaggaaggagaggaagtgcaagtcttggcactagagcccggcaaaaaccctagggccgtgcagaccaagccaggcctgttcaaaacgaacactgggaccataggagctgtatcactcgactttagtcccggtacaagcggctcccctattgtcgataagaaagggaaggtggttggactgtatggcaatggtgtggtcacccgatctgggacatacgtgtcggccatcgcacaggctgaaaagagcatcgaggacaacccggagattgaagatgacatcttccggaaacgcagacttactataatggatttacatcccggagccggcaagaccaaaaggtatctgccagcgattgttcgggaggccatcaagcgaggcctcagaacgttgattctggcacctacacgcgtggtcgctgccgaaatggaggaagctctcagggggctgcccatccgttaccagactccagcaatacgggccgagcacaccggaagagagattgtggaccttatgtgtcatgccacattcaccatgaggctgttgtcacctgtacgcgtgcccaattataacctaatcatcatggacgaagctcactttactgatccagcgtccattgcagcccgaggttacatcagtaccagagttgagatgggcgaagctgccgggattttcatgacagcaacgccgcctggatctcgggacccctttccacaaagcaatgcccccataatggatgaggagagggaaatccctgagcgctcctggaactcaggccatgaatgggtcactgacttcaaaggtaagaccgtgtggtttgtgccatctattaaggctgggaatgatatcgcggcctgcctgcgtaaaaacggaaagaaagtcatccagctcagcagaaagacattcgacagtgagtatattaaaacccggactaatgattgggactttgtagtgacaaccgatatatccgaaatgggcgcaaacttcaaggctgagagggttatcgacccccgccgatgtatgaagcctgtgattttaacggatggcgaggaaagagtcatcctggccgggccgatgccagtgactcacagctctgcagcccagcggaggggacgcattggtagaaatcccaaaaacgagaatgaccaatacatctacatgggcgaacctcttgagaacgacgaagattgcgctcactggaaggaggccaaaatgctgctcgacaatataaacacacccgaggggatcattccatcaatgtttgaacctgagagggaaaaggttgatgcgatcgacggagagtatcggttgcgtggcgaagcacgcaaaaccttcgtggatctgatgcgaagaggtgacctccccgtctggctggcctacagggtggctgccgaggggattaactatgctgatcggcgctggtgttttgacggcgtaaagaataaccagatccttgaggaaaatgtggaggttgaaatatggaccaaagagggagagagaaagaagctaaaaccaaggtggctggatgcacggatttactccgaccctttggccttaaaggagttcaaagagttcgctgccggccgaaagagtctgactctcaacctgatcacagaaatggggagacttccgacctttatgacacagaaagcacgcaatgcgctggataacctcgccgtcttgcatactgctgaggccggaggtagggcatataatcacgctctgagcgaactacccgagacgctggagaccctccttctgttaacattgctggccactgtgaccggcgggattttcctctttctgatgtcgggaaagggcatcggtaagatgacacttgggatgtgctgcataatcaccgcatctattctgctctggtacgcccagatccaaccacattggattgctgcgtccatcatattggagttctttctgattgtgttactaatccctgagcccgaaaaacagcggactccacaggacaaccagctgacgtatgtcgttatcgccattctcaccgtggtagcagctacaatggccaatgagatgggcttccttgaaaagactaaaaaggattttggactgggcagcatcgccacccaacagcctgagtcaaacatattggacattgacctgcgtcccgcaagtgcttggacactctacgccgtggcgaccactttcatcacaccgatgctgagacactctattgaaaattccagcgtcaacgtgtcacttacggctatcgccaatcaggcaaccgttctcatggggctgggaaaaggttggccattgagtaagatggatataggcgtgcctctgttagccatcgggtgttacagccaggtcaaccccattactctaacagctgcactgctccttctggtagcccactatgcgatcattggaccaggcttgcaagctaaggccaccagggaagcacagaaacgcgccgctgccggtatcatgaagaatcccaccgtggacgggattacagttatcgatctggaccctataccgtacgatcccaaatttgagaagcagctcggccaggtgatgctgcttgtcttatgcgtgactcaagtcctgatgatgcggacgacctgggcactctgtgaggctttgacactggccactggaccaatttccaccctatgggagggcaaccctgggcgattctggaatacaaccatcgcggtgtctatggccaacatctttagaggaagctatctggcaggcgctggtctccttttctccattatgaaaaacactacgaatacaaggcgcgggaccggaaacactggcgaaaccctgggtgagaagtggaagaatcggttgaacgccctgggcaaatcagagtttcagatatacaagaaatctgggatccaggaagttgacagaacactcgcaaaggagggaattaaacgtggcgaaactgatcatcacgctgtgagtagggggtcggccaagctgcggtggttcgtagagcgcaatttagtgacccccgagggaaaagtcgttgaccttggctgcggtcgagggggatggagctattactgtggcggtctgaagaacgtgagagaagtcaagggcctcacaaaagggggacctggccatgaggaaccaatccccatgtccacgtatgggtggaatctagtgaggctgcaatctggagtagatgtgttctttacccctccagagaagtgcgacactttgctgtgtgatattggcgaatcaagccccaacccgacagttgaggccggtcggaccctccgcgtgcttaatctggtcgagaactggttgaataacaatactcagttctgcatcaaagtgctgaacccttacatgccatccgtcatagaaaagatggaggcgctccagagaaaatacgggggagctttagtgaggaatcccctgagtcgaaactctacacacgaaatgtattgggttagcaacgcatcaggcaatatcgtatccagtgtgaacatgattagccggatgcttatcaatcgttttaccatgagacataagaaggccacgtacgagcctgacgtcgatctgggctctgggacccgcaacattggaatcgaatccgagacaccaaatctagacataattggtaaaaggatcgagaagatcaaacaggaacacgagacttcatggcactatgaccaagatcatccctacaagacctgggcttatcacggcagctacgaaacaaaacagactgggtcggcctctagtatggtgaacggagttgtgcggctcctgaccaagccgtgggacgtcattcctatggtgacacagatggcaatgaccgatactacgcccttcggccagcaaagagtatttaaggagaaagtggacacacgcacccaggaaccaaaggagggtactaaaaagttgatgaaaataaccgccgagtggctgtggaaggaactcgggaagaaaaagacacctaggatgtgtacgcgagaggagttcacccggaaagttagatccaatgctgcgcttggagccatctttactgatgagaacaagtggaaaagcgcaagggaggctgtcgaagactcacgcttctgggagctggtggataaggaacgtaatttacatctggagggcaaatgcgaaacatgtgtgtataacatgatgggcaagcgggagaagaaattgggggagtttggaaaggccaaaggttccagagcaatttggtacatgtggctcggcgccaggttcctggaatttgaggctctagggttccttaatgaagaccactggttttctcgcgagaacagcctgagtggagtcgaaggcgagggtctccacaagctggggtacatcttgcgagatgtttccaaaaaggagggaggcgccatgtatgcggacgataccgcaggctgggacactcggattacactggaagacctcaagaatgaggaaatggtgaccaaccatatggagggggaacacaagaaacttgccgaggctatcttcaaactgacataccagaataaagtagtgagagtccagaggcccactccacgcggaaccgtgatggatataatcagcagacgggaccaaaggggttctggccaggttgggacgtatggattaaacaccttcacaaacatgggcgcccagctgattcgtcaaatggagggtgaaggggtgtttaaatcaatccagcatttgactgcaaccgaggaaattgctgtccaggattggctcgcccgagtgggacgcgagagactgagtcggatggctatctccggcgacgattgcgtagttaagcccctagacgataggttcgccagcgcacttacagcgctgaatgacatgggcaaggtgcgcaaagatattcagcaatgggagccttctagagggtggaacgactggactcaggtcccattttgctcgcaccatttccacgaactcataatgaaggatggacgggtgctggtggtcccgtgtaggaatcaggacgagttgatcggtcgagcccgtatttcacagggcgctgggtggagcttaagagaaaccgcctgcctgggaaaatcctacgcacaaatgtggagtctcatgtattttcaccgccgggatcttaggctggctgccaacgcaatctgttctgccgttcccagccattgggtgcctacgtccagaacaacctggtcaatccacgcgaagcatgagtggatgactacagaagacatgctaaccgtatggaatcgcgtgtggattcaggagaacccatggatggaggacaaaactcccgtcgaaagttgggaggaaataccttacctgggcaagcgggaggatcagtggtgcggttctctcatcgggttgaccagcagggctacatgggccaagaatattcagacggcaatcaaccaagtgcgatccctgattggaaatgaagagtataccgactacatgccatcaatgaaaagattccggagggaggaagaggaagccggcgttctttggtga

SEQ ID NO: 14275 - RNA, 9876 nt, synthetic construct
  misc_feature 1..9876: note = derived and/or modified CDS sequence (opt3) from DENV-2__JX669477__SS-prME
  source 1..9876: mol_type = other RNA
accgccggcgtgatcgtaatgctgattcccacagctatggcattccacctcactacgaggaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagacccggacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataaacttcaactgaaagggatgagctacagtatgtgtactggaaagttcaagatcgtcaaagaaatcgctgagacccagcacggcacgattgtgatcagagtacagtatgagggtgacgggtctccatgcaagattcccttcgaaataaccgatttggagaaaaggcatgttctcggccggctgatcacagtgaacccgattgtcactgaaaaggactcccctgtgaacatcgaggccgaacccccatttggagatagctacatcattgtcggcgtggagcctgggcagttaaaactgaattggttcaagaagggatcgtctataggtcaaatgtttgagaccacaatgcgaggcgctaaacgcatggccatcctaggggacactgcatgggatttcggatccctcggcggtgtttttacctcaattgggaaggccctgcaccaggtgttcggcgctatctacggagcggcatttagtggcgtaagctggacgatgaaaattcttatcggggtcataatcacatggattggaatgaactccagatctaccagcttgtcagtgagtctggttctcgtgggcgtcgtgactctgtatcttggtgccatggtacaggctgactccgggtgtatcgtgagctggaagaataaagaactgaagtgcggatctggcattttcatcacagataacgttcacacctggactgagcagtacaagtttcaacccgaatcaccaagtaaattggccagcgcaatacagaaggcccatgaggaaggtatttgtggcatcaggtccgtcacccggctcgagaatctgatgtggaaacagattacacccgagttaaaccacatcctgtctgaaaatgaggtgaagctaacgataatgaccggggacatcaaaggaattatgcaggctggcaagcgctcgctcagacctcaaccaactgaactgaaatatagctggaagacatgggggaaggccaaaatgctttccaccgagtcacataaccagacattcttgatcgatggaccggaaactgcagagtgccccaataccaacagggcgtggaatagtctggaggtggaagactacggctttggtgtcttcacgacaaacatttggctcaagctgcgtgagaaacaggacgtattttgtgattctaagttaatgagcgctgccatcaaagacaatcgggcagtgcacgccgatatggggtattggatagaatccgctctgaacgacacctggaagatggagaaggcctcattcattgaggtgaaaagctgccactggcctaagtctcatactctttggtccaatggagtattggaaagtgagatgatcatccccaagaatttcgcaggccccgtcagccagcacaactaccgacctggttatcatacccaaacagctggcccatggcacctcgggaagctggaaatggattttgacttctgtgagggaactaccgtggttgtgacagaagattgcggcaatagagggccctctctaaggacgaccactgcctccggaaaactgattacagagtggtgctgtcgctcatgcaccctcccgcctctgcggtacagaggcgaggacggttgttggtacgggatggaaatcaggccacttaaggagaaggaagagaacttggtcaatagtctggtgactgcgggacatggccagattgataactttagcttaggtgttctcggcatggccctgttccttgaagagatgctgcgcacacgagtggggaccaaacacgctatattgctcgtagcactgtcgtttgtcacgctaatcactggaaatatgtccttccgggacctgggccgtgtgatggtgatggtcggggccaccatgacagatgacattggaatgggcgttacctatctcgctctgcttgccgcatttaaggtgagacccactttcgcggccggtttgctgttaaggaaactcacatctaaggagctgatgatggctaccatcgggattgcccttctgagccagtcaacactacctgaaactatcctcgagctgaccgatgcattggctctgggaatgatggccttaaaaatagtacgcaacatggaaaagtaccaactcgcagtgacgatcatggccattagttgcgtccccaatacagtgatcctgcagaacgcttggaaggtttcctgtaccattcttgcggccgtgtctgtcagcccactgttgctcacttcctcacagcagaaagcagactggatccctctggctctaaccataaagggcctgaatcccacagccatttttcttactaccctcagccggacgagtaaaaagagatcttggccactgaacgaggccatcatggctgtgggcatggtttccatcttggcaagctcgctgctaaagaatgacattccgatgacagggcctctcgtggccggaggtctgcttaccgtctgctatgtactgactggcaggtcagcggatttggaactcgagcgagctgccgacgtgaagtgggaggatcaagcagaaatatctgggagttcccccatcctgagcattacaatctctgaggacggaagcatgtccattaaaaacgaagaggaggaacagaccctaactatcctgatacgcacaggccttctcgttatctcaggtgtgttcccagtcagtattcccatcaccgccgctgcatggtacctgtgggaggtgaagaagcagcgggccggggtattgtgggatgtgcctagcccaccccctgtcggaaaagcggaattagaggacggcgcttatagaattaagcagaggggcatcctggggtactctcaaataggagccggtgtttataaagaaggcacgtttcacactatgtggcatgtgacccgtggggcagtgctcatgcaccgcggaaagcggattgagccgtcctgggccgatgtcaaaaaggacctgatctcatacggcggtgggtggaaacttgagggagaatggaaagagggcgaagaggtgcaggttctggctttggaaccaggcaagaatcccagagccgtacagacaaaacctgggatcttcaagaccaacacaggaactattggtgcagtgagtctagattttagcccaggcacctccgggtctcccatcgtcgacaggaaaggaaaggtggttggcctgtacggtaatggggtggtcacgcgatcgggagcttatgtgagcgccatagcgcagacagagaagtcaattgaggataaccctgaaatcgaggacgatattttccggaaaaagcgcctcactatcatggacctgcatccgggcgccggcaaaaccaagagataccttcccgcaatagtaagggaagctattaaacgggggttacgaacactgatcctcgccccaaccagagtcgtggctgcagagatggaagaggccttgcgcggactgcctatcaggtatcaaactcccgccattcgtgctgagcacaccggtcgggaaatcgttgacctcatgtgtcatgcgacattcacgatgagactgctttccccagtgagggtccctaactacaatctgattataatggatgaggcacactttactgaccccgccagtatcgctgcccgcggctatatttctacccgagtggaaatgggggaggcagccggaatcttcatgacagctaccccaccgggcagcagagatccttttccccagtccaacgcgccaatcatggacgaggaacgggagattcccgaaaggtcatggaactctggtcacgagtgggttactgatttcaaggggaagacagtgtggtttgtccctagcataaaagccggaaacgacatcgcagcttgcttgcgcaagaatggcaaaaaggtgattcagctaagtcgtaaaaccttcgattccgaatacgtaaagacgagagccaacgactgggattttgtggttactacagacatcagcgagatgggcgcaaatttcaaggccgagcgggtcattgatccaaggcgctgtatgaaacccgtgatcctgaccgacggggaagaacgagtgatactcgctggacctatgccggtcacccattcttcagccgcgcaaagacggggtaggatcggccgcaacccaaagaatgaaaacgaccagtatatttacatgggggagcccttagaaaatgatgaggactgcgcacactggaaagaggccaagatgctgcttgataacatcaatactcctgaaggaattatcccctccatgtttgagccagaaagagagaaagtagacgctatagatggcgaatacaggctgcggggtgaggcccgtaagacattcgtggacctcatgcgccgaggggatttgcctgtttggctggcttataaagtggcagccgagggcattaactacgctgacagaaagtggtgttttgatggaatcaagaataaccagattctcgaagagaacgtcgaagtggagatctggaccaaagagggcgaaaggaagaaactgaagccccggtggcttgacgcccgcatatatagtgatccactagcactgaaagagttcaaggagttcgcggccgggagaaagagcttgacattaaatctgatcactgagatgggaaggctccctacgtttatgacccagaaagctcggaacgccctggacaatcttgcagttctgcatacagctgaagtgggtggcaaggcccacactcacgcactctcggagttgccggagaccctggaaacactactgctccttaccctgttagccgctgtcactgggggaattttcttgtttctgatgtctggcaaaggtatcgggaagatgacgctcggcatgtgctgcattatcaccgcgtccatactgctttggtacgcccaaattcagccccattggatcgcagctagcatcattctggagttctttctcatcgtgttgctgataccagaacctgagaaacagcgaacaccccaggataaccaattaacttatgtagtgattgccatcctaaccgttgtcgccgcaacaatggctaatgaaatgggattcctggagaagaccaagaaagacctcggctttgggtcaattactacacaggagagtgaatctaacatccttgacatagatctgagaccagcctccgcgtggacgttgtacgctgtggccaccactttcgtgacacctatgctgcgccacagcatcgaaaattcaagtgtcaacgttagcctcaccgcaattgccaatcaggctaccgtgctgatgggacttggtaagggctggcccctctccaaaatggacatcggggtaccgctgttggcaattggatgttattctcaggtgaacccaatcacactgactgccgcgttactactgctcgtcgctcattacgccattatcggccctggtcttcaagcaaaggccacgagggaagctcagaaacgggccgcagctgggataatgaagaatcccaccgtggatggcattacagttatcgacctggagccaatcccctacgatcctaagtttgaaaaacagttgggacaggtgatgctgctcattctgtgcgtcactcaagtacttatgatgcgtaccacatgggccttatgtgaggcgctgaccctcgccactggcccgataagcacgttgtgggaggggaaccccggaagattctggaatacaaccatcgcagtgtccatggctaacatttttaggggctcatatctggccggtgcagggctactgttctctatcatgaagaatactaccaacacacgccggggaactggcaatgttggtgaaaccctcggcgagaaatggaagagtcgacttaacgctctggggaaatcggaatttcagatttacaagaaaagcggaatccaggaggtggacagaacattggccaaggagggcataaagagaggggaaacggatcaccatgccgtctcccgcggatctgcgaaactgcggtggttcgtggagagaaacatggtcaccccagaaggcaaggtggttgacctcggttgcgggcgtggaggctggtcatattactgtggtggcctgaaaaatgtgagggaggtaaaggggttaactaaaggaggccctgggcacgaggaaccaatccctatgagcacatatggatggaaccttgtgcggctgcaatccggcgtcgatgttttctttaccccacccgagaagtgcgacactctcctatgtgatattggtgaaagttctcctaatccaacaatcgaggctgggcgcaccctgcgagtgttgaacctggtcgaaaattggctcaacaataacacgcagttctgcattaaggtgcttaatccctacatgccgagcgtaatcgagaaaatggaaaccctgcagagaaagtatggaggcgcattggtgaggaaccctctgtcaagaaattccacacacgagatgtactgggttagtaacgccactggcaatatagtgagctctgtcaacatgatttcccgcatgctcatcaatagatttaccatgaaacataagaaagctacatacgagccagacgtggatttagggtcaggaactaggaacatcggtattgaaagcgagatacccaacctggacatcattggcaagcgaatcgaaaagattaaacaggagcacgaaacctcgtggcattatgaccaagatcacccttacaagacatgggcctatcacgggtcttacgagaccaaacagactggaagtgcatccagcatggtcaatggcgtggttcggcttctgacgaagccatgggacgtagtgcccatggtcacacagatggccatgaccgatactaccccgttcggtcagcaacgtgtgtttaaagagaaggttgacacaagaacgcaggaacctaaggaggggaccaaaaagctaatgaaaatcactgctgaatggctctggaaggagctgggaaaagagaagacaccccgcatgtgtaccagggaagagttcactcggaaagtgagatcaaacgcggccttgggcgcagtctttacagatgaaaataagtggaagtccgctcgcgaggccgtggaagacggcaggttctgggagctggtagatcgagagcggaacctccatcttgaagggaaatgcgagacctgtgtgtataatatgatgggaaagagagagaaaaagctgggtgagtttggcaaagcaaaggggtctagggccatatggtacatgtggttaggagctcgcttcctggaatttgaggccttgggcttcctcaacgaggaccactggtttagccgtgaaaatagtctgtccggtgttgagggggaaggactacatcggcttggctatatcctgagagatgtcagcaagaaagagggcggggcgatgtacgcagacgatacagccggatgggacactaggattaccctcgaagacctgaagaacgaggagatggtgacgaatcacatgaaaggtgaacataagaaattggctgaggccatcttcaagctgacctaccagaacaaggtggtccgcgttcagcgaccaacacctcggggcactgtgatggatattatctctagaaaagaccaaagggggtcaggacaggtaggcacctatggtctcaatacattcactaacatggaagcacagcttattcgccaaatggagggggagggaatatttagaagtatccagcacctgaccgctacggaagagattgccgtgcagaattggttagctcgggtcggcagggaacgtctgtcccgaatggccatcagcggcgatgactgcgtggttaagcccatcgatgaccgcttcgcatctgcgttgacagccctcaacgatatggggaaagtgagaaaggacattcagcaatgggagccatcgcggggatggaatgattggacccaggtccccttttgctcacaccatttccacgaactggtgatgaaagacggtagggtcttagttgtgccttgtcgcaaccaggatgagcttataggcagagctcggatcagccagggggccggatggtccctgaaggagactgcatgcctcggcaagagttacgctcaaatgtggacactgatgtattttcataggcgagacttgcgtttagccgcaaacgccatttgttctgcggtcccaagccactgggtgccgacctccagaactacctggtcaatccacgctaaacatgaatggatgacaacggaggatatgctggccgtgtggaatcgcgtctggattcaggaaaacccctggatggaggacaagacccctgttgaaagttgggaggaggtgccatacctcggtaaacgggaagaccagtggtgcgggtctcttatcggactgactagcagggcaacatgggccaagaatatacagaccgctatcaaccaagtaagatccctaattggcaatgagggctatactgattacatgccctcaatgaaacgcttccggagggaagaggaagaggccggggtgctgtggtga

SEQ ID NO: 14276 - RNA, 9876 nt, synthetic construct
  misc_feature 1..9876: note = derived and/or modified CDS sequence (opt3) from DENV-2__JX669478__SS-prME
  source 1..9876: mol_type = other RNA
accgcaggcgtgatcgtcatgctgattcccacagcaatggcattccacctcactacgaggaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccattactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagacccggacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggttgacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataaacttcaactgaaagggatgagctacagtatgtgtactggaaagttcaagatcgtcaaagaaatcgctgagacccagcacggcacgattgtgatcagagtacagtatgagggtgacgggtctccatgcaagattcccttcgaaataaccgatttggagaaaaggcatgttctcggccggctgatcacagtgaacccgattgtcactgaaaaggactcccctgtgaacatcgaggccgaacccccatttggagatagctacatcattgtcggcgtggagcctgggcagttaaaactgaattggttcaagaagggatcgtctataggtcaaatgtttgagaccacaatgcgaggcgctaaacgcatggccatcctaggggacactgcatgggatttcggatccctcggcggtgtttttacctcaattgggaaggccctgcaccaggtgttcggcgctatctacggagcggcatttagtggcgtaagctggacgatgaaaattcttatcggggtcataatcacatggattggaatgaactccagatctaccagcttgtcagtgagtctggttctcgtgggcgtcgtgactctgtatcttggtgccatggtacaggctgactccgggtgtatcgtgagctggaagaataaagaactgaagtgcggatctggcattttcatcacagataacgttcacacctggactgagcagtacaagtttcaacccgaatcaccaagtaaattggccagcgcaatacagaaggcccatgaggaaggtatttgtggcatcaggtccgtcacccggctcgagaatctgatgtggaaacagattacacccgagttaaaccacatcctgtctgaaaatgaggtgaagctaacgataatgaccggggacatcaaaggaattatgcaggctggcaagcgctcgctcagacctcaaccaactgaactgaaatatagctggaagacatgggggaaggccaaaatgctttccaccgagtcacataaccagacattcttgatcgatggaccggaaactgcagagtgccccaataccaacagggcgtggaatagtctggaggtggaagactacggctttggtgtcttcacgacaaacatttggctcaagctgcgtgagaaacaggacgtattttgtgattctaagttaatgagcgctgccatcaaagacaatcgggcagtgcacgccgatatggggtattggatagaatccgctctgaacgacacctggaagatggagaaggcctcattcattgaggtgaaaagctgccactggcctaagtctcatactctttggtccaatggagtattggaaagtgagatgatcatccccaagaatttcgcaggccccgtcagccagcacaactaccgacctggttatcatacccaaacagctggcccatggcacctcgggaagctggaaatggattttgacttctgtgagggaactaccgtggttgtgacagaagattgcggcaatagagggccctctctaaggacgaccactgcctccggaaaactgattacagagtggtgctgtcgctcatgcaccctcccgcctctgcggtacagaggcgaggacggttgttggtacgggatggaaatcaggccacttaaggagaaggaagagaacttggtcaatagtctggtgactgcgggacatggccagattgataactttagcttaggtgttctcggcatggccctgttccttgaagagatgctgcgcacacgagtggggaccaaacacgctatattgctcgtagcactgtcgtttgtcacgctaatcactggaaatatgtccttccgggacctgggccgtgtgatggtgatggtcggggccaccatgacagatgacattggaatgggcgttacctatctcgctctgcttgccgcatttaaggtgagacccactttcgcggccggtttgctgttaaggaaactcacatctaaggagctgatgatggctaccatcgggattgcccttctgagccagtcaacactacctgaaactatcctcgagctgaccgatgcattggctctgggaatgatggccttaaaaatagtacgcaacatggaaaagtaccaactcgcagtgacgatcatggccattagttgcgtccccaatgctgtgatcctgcagaacgcgtggaaggtttcctgtacaattcttgccgcagtgtctgtcagcccactgttgctcacctcctcacagcagaaagctgactggatccctctggccctaactataaagggcctgaatcccaccgccatttttcttacaactctcagccggaccagtaaaaagagatcttggccactgaacgaggctatcatggcagtgggcatggtttccatcttggccagctcgctgctaaagaatgacattccgatgacggggcctctcgtggcgggaggtctgcttacagtctgctatgtactgaccggcaggtcagctgatttggaactcgagcgagccgcagacgtgaagtgggaggatcaagccgaaatatctgggagttcccccatcctgagcattactatctctgaggacggaagcatgtccattaaaaacgaagaggaggaacagacactaaccatcctgatacgcactggccttctcgttatctcaggtgtgttcccagtcagtattcccatcacagctgcagcctggtacctgtgggaggtgaagaagcagcgggcgggggtattgtgggatgtgcctagcccaccccctgtcggaaaagctgaattagaggacggcgcctatagaattaagcagaggggcatctttgggtactctcaaataggagccggtgtttataaagaaggcaccttccacacgatgtggcatgtgactcgtggggcagtgctgatgcaccgcggaaagcggattgagccgtcctgggctgatgtcaaaaaggacctcatctcatacggcggtgggtggaagctggagggagaatggaaagagggcgaagaggtgcaggttcttgccctggaaccaggcaagaatcccagagcagtacagaccaaacctgggatctttaagacaaacaccggaacaattggtgctgtgagtttggatttcagcccaggcacttccgggtctcccatcgtcgacaggaaaggaaaggtggttggcctatacggtaatggggtggtcacccgatcgggagcctatgtgagcgcgatagcccagacggagaagtcaattgaggataaccctgaaatcgaggacgatattttccggaaaaagcgcctgacaatcatggacctccatccgggcgcaggcaaaactaagagatacctgcccgctatagtaagggaagccattaaacgggggcttcgaaccttaatcctggctccaacaagagtcgtggcagccgagatggaagaggccctccgcggattgcctatcaggtatcaaacccccgctattcgtgcggagcacactggtcgggaaatcgttgacctgatgtgtcatgcaacctttacaatgagactcctgtccccagtgagggtccctaactacaatcttattataatggatgaggcccacttcacggaccccgctagtatcgccgcacgcggctatatttctactcgagtggaaatgggggaggccgctggaatctttatgaccgcgacaccaccgggcagcagagatcctttcccccagtccaacgccccaatcatggacgaggaacgggagattcccgaaaggtcatggaactctggtcacgagtgggttaccgattttaaggggaagactgtgtggttcgtccctagcataaaagcaggaaacgacatcgctgcctgcctgcgcaagaatggcaaaaaggtgattcagttgagtcgtaaaacatttgattccgaatacgtaaagaccagagcaaacgactgggatttcgtggttacgactgacatcagcgagatgggcgccaattttaaggctgagcgggtcattgatccaaggcgctgtatgaaacccgtgatcctaacagacggggaagaacgagtgatactggccggacctatgccggtcacccattcttcagcggcacaaagacggggtaggatcggccgcaacccaaagaatgaaaacgaccagtatatttacatgggggagcccctcgaaaatgatgaggactgcgcccactggaaagaggctaagatgttactggataacatcaatacccctgaaggaattatcccctccatgttcgagccagaaagagagaaagtagacgccatagatggcgaatacaggcttcggggtgaggctcgtaagacttttgtggacctgatgcgccgaggggatctccctgtttggttggcatataaagtggccgctgagggcattaactacgccgacagaaagtggtgtttcgatggaatcaagaataaccagattctggaagagaacgtcgaagtggagatctggacaaaagagggcgaaaggaagaaactcaagccccggtggctggacgcacgcatatatagtgatccacttgcgctaaaagagttcaaggaatttgccgctgggagaaagagcctgaccttgaatttaatcacagagatgggaaggctgcctactttcatgacgcagaaagcccggaacgcactcgacaatctggctgttcttcataccgccgaagtgggtggcaaggcatacacacacgccctgtcggagctcccggagactttggaaaccctgctactgctcacacttctggctgcggtcaccgggggaatatttttattcttgatgtctggcaaaggtatcgggaagatgactctgggcatgtgctgcattatcacggcctccatactcctgtggtatgcacaaattcagccccactggatcgctgccagcatcattcttgagtttttcctgatcgtgctcttgataccagaacctgagaaacagcgaaccccacaggataaccaactgacatacgtagtgattgccatcttaactgttgtcgcagctaccatggccaatgaaatgggatttctagagaagacaaagaaagacctgggcttcgggtcaattaccactcaggagagtgaatctaacatcctcgacatagatcttagaccagcgtccgcttggacactgtatgccgtggcaacgacctttgtgactcctatgttgcgccatagcatcgaaaattcaagtgtcaacgttagcctgacagccattgctaatcaggcaaccgtgctcatgggactgggtaagggctggcccctttccaaaatggacatcggggtaccgctcctggccattggatgttactctcaggtgaacccaatcaccttgacagcggctctgttactactggtcgcccactacgcaattatcggccctggtctccaagccaaggctactagggaagcccagaaacgggcagctgccgggataatgaagaatcccacggtggatggcattaccgttatcgaccttgagccaatcccctatgatcctaagttcgaaaaacagctgggacaggtgatgttgctgattctctgcgtcacacaagtactgatgatgcgtactacctgggcgctttgtgaggccttaacactggcaaccggcccgataagcactctctgggaggggaaccccggaagattttggaatacgacaatcgctgtgtccatggccaacattttcaggggctcatacttggccggtgctgggctgctattttctatcatgaagaataccactaacacccgccggggaacaggcaatgttggtgaaactctgggcgagaaatggaagagtcgactcaacgcccttgggaaatcggagttccagatttataagaaaagcggaatccaggaggtggacagaaccctggccaaggagggcataaagagaggggaaacagatcatcacgcggtctcccgcggatctgctaaattgcggtggttcgtggagagaaacatggtcacgccagaaggcaaggtggttgacctgggttgcgggcgtggaggctggtcatactattgtggtggcctcaaaaatgtgagggaggtaaaggggctgaccaaaggaggccctgggcatgaagaacccatccctatgagcacttacggatggaacttagtgcggcttcaatccggcgtcgatgtatttttcacaccacccgagaagtgcgacaccctgctctgtgatattggtgaaagttctcctaatccaactatcgaggcagggcgcacactacgagtgctgaacttggtcgaaaattggctgaacaataacacccagttttgcattaaggtgctcaatccctatatgccgagcgtaatcgagaaaatggaaacgcttcagagaaagtacggaggcgccctggtgaggaaccctttgtcaagaaattccacccacgagatgtactgggttagtaacgctacaggcaatatagtgagctctgtcaacatgatttcccgcatgctgatcaatagattcactatgaaacacaagaaagccacctatgagccagacgtggatctcgggtcaggaacaaggaacatcggtattgaaagcgagatacccaacttagacatcattggcaagcgaatcgaaaagattaaacaggagcatgaaacttcgtggcactacgaccaagatcatccttataagacctgggcataccacgggtcttatgagacaaaacagaccggaagtgcctccagcatggtcaatggcgtggttcggctgcttactaagccatgggacgtaatccccatggtgacgcagatggctatgacagataccactccgtttggtcagcaacgtgtcttcaaagagaaggtggacaccagaacacaggaacctaaggaggggacgaaaaagctgatgaaaataaccgcggaatggctatggaaggagctcggaaaagagaagactccccgcatgtgtacaagggaagagtttacccggaaagttagatcaaacgccgcactgggcgctgtgttcactgatgaaaataagtggaagtccgcccgcgaggcagtcgaagacggcaggttttgggagttggtggatcgagagcggaacctgcacctcgaagggaaatgcgagacatgtgtatacaatatgatgggaaagagagagaagaaacttggtgagttcggcaaagccaaagggtctagggctatctggtatatgtggctgggagcccgctttttagagttcgaggcgctgggctttttgaacgaggaccattggttcagccgtggtaatagtctctccggggtggaaggagagggcctgcaccggctaggctacattcttagagaagttgggaagaaagagggaggtgcaatgtacgccgatgacaccgctggctgggatacaaggatcactctggaagacctcaagaacgaggagatggtcaccaatcatatgaaaggggaacacaagaaactggccgaggcaattttcaagttgacgtatcagaacaaggtggtgcgcgtccagcgaccaacccctcggggaacagttatggacatcattagcagaaaagatcaaaggggctctggtcaggtggggacttacggactgaatacctttacaaacatggaagctcagctcatacgccaaatggagggcgagggcatcttcaagtcaattcagcatcttactgccaccgaagagatcgctgtacagaattggctggccagagtggggcgggaaaggttaagtcgtatggcaatctccggagacgattgcgtcgtgaaacccattgacgatcgatttgcgagcgccctgacggctttgaacgacatgggtaaggttcgcaaagatatacagcaatgggagccatctagaggctggaatgactggacacaggtgcccttctgctcgcaccactttcatgaactcgtcatgaaggatgggcgggtgctggtagttccttgtaggaaccaggacgagctaatcggacgcgccagaatttcacagggcgcaggttggagccttaaggagaccgcttgcctggggaaatcctatgcccaaatgtggactctcatgtacttccaccggagggatctgcgattggcagccaacgcgatctgtagtgctgtgccatctcattgggtcccgacaagccgtaccacttggtccattcacgccaagcacgaatggatgaccacagaggacatgttagcagtgtggaatagagtgtggatccaggaaaacccctggatggaggataaaacgcctgtcgaatcatgggaggaggttccatatctgggaaagcgcgaagaccagtggtgcggcagtctcataggccttacctctcgggccacttgggctaaaaatatccagacagccattaaccaagtgaggagcctgatcgggaatgagggatacattgactatatgccctccatgaagagatttcgccgggaagaggaagaggctggtgttctatggtga

SEQ ID NO: 14277 - RNA, 9876 nt, synthetic construct
  misc_feature 1..9876: note = derived and/or modified CDS sequence (opt3) from DENV-2__JX669480__SS-prME
  source 1..9876: mol_type = other RNA
accgccggcgtgatcattatgctgatacccaccgctatggctttccacctcactacgagaaatggggaacctcatatgatcgtcggaagacaggaaaagggtaaaagccttctgtttaagaccgaggacggcgttaatatgtgcacattgatggccattgatttaggggaactgtgtgaggacactatcacctacaaatgcccacttctccggcaaaacgaaccggaggatattgactgttggtgcaattccacatctacctgggtgacttatggaacatgtaccacgactggcgagcaccgccgagaaaagcgttcagttgcgctggtgccccatgtcggtatggggcttgagaccagaacagaaacttggatgagtagcgagggagcttggaaacacgtgcagaggatcgagacctggatactgcggcatcctggcttcgccatcatggcagccattttggcttacacaatcggcaccacgcactttcagcgcgcactcattttcatcctgctgactgccgttgctccatccatgacaatgagatgcatagggatttctaacagggattttgtggaaggagtctcgggtggctcatgggtggacatcgtgctcgagcacgggagctgtgttaccactatggccaagaataagcccacattagatttcgaactgattaaaaccgaggcgaagcagcctgcaacgcttcggaaatattgcatcgaagccaagttgaccaacacaactaccgagagtcgctgtccaacacaaggagagccctccctgaatgaggaacaggacaaacgatttatctgcaagcattctatggtggatagaggctggggtaacgggtgtggactattcggcaagggcgggattgtcacttgcgctatgtttacctgcaaaaagaatatggaaggaaaagtggtgctccctgagaacctggaatacacaatagtcatcaccccacacagcggtgaggagcatgccgttggcaatgacactgggaagcacggagaagagattaaaatcacgccgcagtcctcaataacagaagcagagcttaccggctatggtactgtgaccatggaatgtagtcccaggacagggctggatttcaacgagatggtattgctccagatggaggaaaaggcttggctggtgcaccggcaatggtttttagacctgcctctcccatggcttcccggcgccgatacccagggaagcaattggattcagaaagagactctggtcacattcaagaaccctcatgcgaagaaacaggacgtggttgtgttgggctctcaagaaggggccatgcacacggcactaaccggagctactgagatccagatgtcctcaggtaatctgctctttacaggccatctgaagtgccgtcttcgcatggacaaactgcagttgaaggggatgagctacagtatgtgtaccggaaaattcaagatcgtcaaggagattgccgaaacacaacacggcactatcgtgattagagtacagtatgagggtgatgggtctccatgcaaaatacccttcgaaatcatggacctcgagaagaggcatgttctgggccggttaattaccgtgaacccgatcgtcacggaaaaagattcccctgtgaacatcgaggctgagcccccatttggagacagctacattataatcggcgtcgaacctgggcagctgaagctaaattggttcaaaaagggatcgtctattggtcagatgtttgagaccacaatgcgaggcgccaagcgcatggcaatcctcggggatactgcctgggacttcggatccctgggcggtgtgtttacctcaattgggaaagcacttcaccaagttttcggcgcgatctacggagcagcctttagtggcgtgagctggacaatgaagatattgatcggggtaattatcacttggattggaatgaactccagatctaccagcctgtcagtcagtctcgtgctggttggcgtggtcacgctttatctgggtgctatggtgcaggccgattccgggtgtgtagtgagctggaaaaataaggaattgaaatgcggatctggcatcttcataacagacaacgttcacacctggactgagcagtacaagtttcagcccgaatcaccaagtaagctcgcaagcgccattcaaaaagctcatgaggagggtatctgtggcattaggtccgtcacacggctggaaaatttaatgtggaagcagatcacccccgagctgaaccacatactatctgaaaatgaggtgaaactcactatcatgaccggggatattaagggaatcatgcaggccggcaaacgctcgctgagacctcagccaacagaacttaagtatagctggaaaacgtgggggaaggcaaagatgttgtccaccgagtcacataaccaaactttcctgattgacggaccggagacagcggaatgccccaataccaacagggcttggaatagtctcgaggtggaagattacggctttggtgtcttcacaactaacatctggctgaaattacgtgagaagcaggacgtattttgtgactctaaactgatgagcgccgcaataaaggataatcgggccgtgcacgctgacatggggtattggattgagtccgcccttaacgatacctggaaaatggaaaaggcatcattcatcgaggtaaagagctgccactggcctaaatctcatacgttgtggtccaatggagtactcgaaagtgagatgatcattccaaagaacttcgctggccccgtcagccagcacaactaccgacctggttatcatacacagaccgccggcccatggcacctggggaaactagaaatggactttgatttctgtgagggaactaccgtggttgtgacagaggactgcggcaatagagggccctctctgaggactaccacagcgtccggaaagctcatcacggaatggtgctgtcgctcatgcaccctgccgcctcttcggtacagaggcgaggatggttgttggtacgggatggaaattaggccattgaaagagaaggaagagaacctggtcaatagtttagtgactgccggacatggccaaatagacaactttagcctcggtgttctgggcatggctcttttcctggaggaaatgttgcgcacacgagtggggaccaagcacgcaatcctcctggtagccgtctcgtttgtgactctaattacaggaaatatgtccttccgggatctgggccgtgtgatggtcatggttggggtgaccatgacggacgatatcggaatgggcgtaacttatctcgctctgcttgccgcatttaaagtgagacccaccttcgcggccggtttgctgttaaggaagctcacatctaaagagctgatgatggctaccattgggatcactcttctgagccagtcaacaatacctgaaaccatcctagagctcacagacgccctggcattgggaatgatggtcctgaagattgtgcgcaacatggaaaaataccagttagctgttactatcatggccattagttgcgtgcccaatgcagtcatcctcctgaacgcctggaaggtgtcctgtaccatacttgctgcggtttctgtgagcccactgttgctcacgtcctcacaacagaagacagattggattcctctggccctaaccatcaaaggcctgaatcccactgcaatctttcttaccacactcagccggacaagtaagaaaagatcttggccactgaacgaggctgtcatggccgtaggcatggtgtccattttggccagctcgctgttaaagaatgacataccgatgaccgggcctctcgttgctggaggtctgcttacggtgtgctatgtcctgacaggcaggtcagcagacttggagctcgaacgagccgcggatgtgaaatgggaggaccaggctgaaatctctgggagttcccccattctgagcatcaccatttctgaggatggaagcatgtccatcaagaacgaggaagaggaacagactctaacaatactgatccgcaccggccttctcgtaatttcaggtgtgttcccagtcagtatccccattactgccgcagcctggtacctgtgggaggttaaaaagcaacgggctggggtgttgtgggacgtgcctagcccaccccctgtcggaaaggcagaattagaggatggcgcctatagaatcaaacagaggggcatactggggtactctcagattggagcgggtgtgtataaggagggcacatttcacaccatgtggcatgttacgcgtggggctgtactcatgcaccgcggaaaacggatcgaaccgtcctgggccgacgtgaagaaagatctgatctcatacggcggtgggtggaaacttgagggagaatggaaggagggcgaagaggtccaggtgctggcattggagccaggcaaaaatcccagagccgttcaaactaagcctgggctattcaaaaccaacacaggaaccattggtgctgtgagtctggactttagcccaggcacatccgggtctcccatcgtcgataggaagggaaaagtggtaggcctctacggtaatggggtcgtgactcgatcgggagcctatgttagcgcaatagctcagaccgaaaagtcaattgaggacaaccctgaaatcgaggatgacattttccggaagaaacgcctgacgatcatggatcttcatccgggcgccggcaagacaaaaagatacttacccgcgatagtgagggaagccattaagcgggggctgcgaactctcatcttggcaccaaccagagtcgtggctgccgagatggaggaagctctgcgcggactccctatcaggtatcagacacccgcaattcgtgccgagcacaccggtcgggaaatcgttgacctgatgtgtcatgccactttcaccatgagacttctgtccccagtgagggtccctaactacaatttgattataatggacgaggctcactttacagatcccgcgagtatcgcagcccgcggctatatttctacgcgagtggagatgggggaagctgccggaatcttcatgactgcaaccccaccgggcagcagagacccttttccccagtccaacgccccaatcatggatgaggaacgggagattcccgaaaggtcatggaactctggtcacgagtgggtaacagacttcaaagggaagaccgtgtggtttgttcctagcataaaggctggaaacgatatcgcggcctgcctacgcaaaaatggcaagaaagtcattcaactgagtcgtaagactttcgactccgagtacgtgaaaacaagagcaaacgattgggactttgtggtcaccacggatatcagcgaaatgggcgctaatttccgggccgagagggtaattgacccacgccgatgtatgaagcccgtgatcctcactgatggggaagagagagttatattagcaggacctatgccggtgacacattcttcagccgctcagcggaggggtcgcgtcggcagaaacccaaagaatgaaaacgaccagtatatctacatgggggagcccctggagaatgacgaagattgcgcccactggaaagaggcgaagatgcttctggacaacattaatacccctgaaggaatcattccctccatgtttgagccagaaagggagaaagtggatgcaatcgacggcgagtaccggctccgtggtgaagcccgcaagaccttcgttgatttgatgcgaagaggggacctgcctgtgtggctcgcttatagggtcgccgctgagggcataaactacgcagatcggcgctggtgttttgacggaattaaaaataaccaaatcctggaagagaacgtggaggtagaaatttggactaaggagggcgaaaggaagaaacttaagcccaggtggctagatgcccggatctatagtgacccactggctttgaaagagttcaaggagttcgccgcagggcgaaagagcttaacactgaatctcataaccgagatgggaagactgcctacatttatgactcagaagacgcgcgatgcgcttgacaacctggccgtgctccataccgctgaggccggtggcagggcatacaatcacgctttgtcggaactgccggagacactagaaactctgctccttctgaccttattggccacagttaccgggggaatcttcctgtttctcatgtctggcaaaggtattgggaagatgactctgggcatgtgctgcatcattacggcatccatccttctgtggtatgcccagatacagccccactggattgctgcgagcatcatcctcgagttctttttgattgtcctgttaatcccagaacctgagaagcaacggacaccccaggataaccagctaacatacgtggtgatagccattctgactgtcgttgcagctaccatggccaatgagatgggattcctcgagaaaactaagaaagaccttggcctggggtcaatcaccactcaggaaagtgaatctaacattttggacatcgatctgcgtccagcctccgcatggacactctatgctgtggccacgacctttgtaactcctatgctgagacatagcatagaaaattcaagtgtgaacgtcagccttacagcgatcgctaatcaagccaccgtgctcatgggactgggtaagggctggcccttgtccaaaatggacattggggttccgctgttagcaatcggatgttactctcaggtgaacccaattaccctaacagccgctctgctccttctggtcgcacactacactatcattggccctggtttgcaggccaaggcgacgagggaagctcagaagcgcgccgcagccgggatcatgaaaaatcccaccgtagatggcataacagtgattgacctggagccaatcccctatgatcctaagttcgagaaacaactcggacaggttatgctgcttatcttatgcgtgactcaggtcctgatgatgcggaccacatgggctctctgtgaagccttgaccctggcaactggcccgattagcacgctatgggaggggaaccccggacgattttggaatacaaccatagctgtgtccatggccaacatcttcagaggctcatacctggcgggtgccgggctcctattttctattatgaagaatactaccaacacaaggcgcggaactggcaatatcggtgaaaccctgggcgagaaatggaagagtcggttgaacgcactggggaagtcggagttccagatttataaaaagagcggaatccaagaagtcgacagaacactcgctaaagagggcataaagcgtggggaaacggatcatcacgccgtgtccaggggatctgcaaaactgcggtggtttgttgagcgcaacatggtgaccccagaaggcaaggtagtggacttaggttgcgggcgaggaggctggtcatactattgtggtggccttaaaaatgtcagagaggttaaggggctgactaagggaggccctgggcatgaggaacccatccctatgagcacatacggatggaacctcgtgaggctacagtccggcgtcgatgtgttcttcaccccacccgagaaatgcgacactctgttgtgtgatattggtgaaagttctcctaatccaacaatcgaggctgggcggaccctgcgcgtactcaaccttgtggaaaattggctgaacaataacacgcagttttgcattaaggttttgaatccctatatgccgagcgtgatcgagaaaatggagaccctgcaaagaaagtacggaggcgccctcgtcaggaaccctttatcacgaaattccacacacgaaatgtactgggtgagtaacgccactggcaatatagtcagctctgtgaacatgatttcccggatgctgatcaatcgtttcaccatgaaacacaagaaggcgacatatgagccagacgttgatcttgggtcaggaactagaaacatcggtattgaaagcgagatacccaacctggacatcattggcaaacgcatcgaaaagattaaacaggagcatgagacctcgtggcactacgaccaggatcatccttataagacatgggcttaccacgggtcttatgaaaccaaacagactggaagtgcatccagcatggtaaatggcgtggtcaggctactcacgaagccatgggacgtggttcccatggtgacacaaatggccatgaccgatactaccccgtttggtcagcagcgggtcttcaaggagaaagtggacacaagaacgcaggaacctaaggaggggaccaaaaagctgatgcgcatcactgctgagtggttgtggaaagaactgggaaagaagaaaacacccaggatgtgtacccgagaggaatttactcggaaggtaagatcaaacgccgcactcggcgccatattcacagatgagaataaatggaagtccgctagggaagcggtggaggactctcgcttttgggagcttgttgatcgtgaacggaacctgcacttagagggcaaatgcgaaacctgtgtctacaatatgatggggaagagagagaaaaagctgggagagttcggtaaggccaaaggcagcagggcaatctggtatatgtggttgggggctcgctttctcgagttcgaggccctgggatttctaaacgaagaccattggttcagtcgaggcaattcccttagcggtgtggagggggaaggactgcaccggctcggctacattctgagagatgtgtctaagaaagagggcggggcaatgtacgccgacgatacagctggatgggacactaggatcaccttggaagacctgaagaacgaggagatggtcacgaatcatatgaaaggtgaacacaagaagctcgccgaggcgatttttaaacttacctatcaaaacaaggttgtgcgcgtacagagaccaacacctcggggcactgtgatggatatcatttcaaggcgtgaccagcgagggagtggacaggtcggcacctacggtctgaatacattcactaacatggaagcacaattaatacgccagatggagggggagggaatcttcaaatccattcagcatctgaccgtgacggaagagatcgccgttcaaaattggttggctagagtgggccgggaaaggctcagccgcatggccatctctggcgatgactgcgtcgtgaagcccctggatgacagatttgcatcggctctaacagcccttaacgatatggggaaagtacggaaggacattcagcagtgggagccatcaaggggatggaatgattggacccaggttcccttctgcagccaccactttcatgaactggtgatgaaggacggtcgagtcctcgtggtgccttgtcgtaaccaagatgagctgataggcagagctcgcatctcccagggggccggatggagtttgaaagagactgcatgcttaggcaagtcttatgcgcagatgtggacactgatgtacttccaccggagggacctcagacttgccgctaacgccatttgtagcgcagtcccatcccattgggttccgacctcacgcactacctggagtatccacgctaaacacgaatggatgacaacggaggatatgctggccgtgtggaatcgggtatggattcaggaaaacccctggatggaggacaagacccctgtggaatcttgggaggaggtcccatatctaggtaaaagggaagaccaatggtgcgggagcctgatcggactcacttcccgagcaacatgggccaagaatatacagaccgcgatcaaccaggtgagatcattgattggcaatgaggaatacactgattatatgcccagcatgaagcggtttaggcgcgaggaagaggaggctggcgttctgtggtga

SEQ ID NO: 14278 - RNA, 9876 nt, synthetic construct
  misc_feature 1..9876: note = derived and/or modified CDS sequence (opt3) from DENV-2__JX669483__SS-prME
  source 1..9876: mol_type = other RNA
accgccggcgtgatcattatgctgatacccacagctatggctttccacctcactacgcgaaacggggaacctcatatgatcgtcggaaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagttgcgctggtgccccatgtcggtatggggcttgagaccaggacagaaacttggatgagtagcgagggagcttggaaacacgtgcagaggatcgagacctggatactgcggcatcctggcttcgccatcatggcagccattttggcttacacaatcggcaccacgcactttcagcgcgcactcattttcatcctgctgactgccgttgctccatccatgacaatgaggtgcatagggatttctaacagggattttgtggaaggagtctcgggtggctcatgggtggacatcgtactcgagcacgggagctgtgttaccactatggccaagaataagcccacattagatttcgaactgattaaaaccgaggcgaagcagcctgcaacgcttcggaaatattgcatcgaagccaagttgaccaacacaactaccgagagtcgctgtccaacacaaggagagccctccctgaatgaggaacaggacaaacgatttatctgcaagcattctatggtggatcggggctggggtaacgggtgtggacttttcggcaagggcgggattgtcacttgcgctatgtttacctgcaaaaagaatatggaaggaaaagtggtgctccctgagaacctggaatacacaatagtcatcaccccacacagcggtgaggagcatgccgttggcaatgacactgggaagcacggagaagagattaaaatcacgccgcagtcctcaataacagaagcagagcttaccggctatggtactgtgaccatggaatgtagtcccaggacagggctggatttcaacgagatggtattgctccagatggaggaaaaggcttggctggtgcaccggcaatggtttttagacctgcctctcccatggcttcccggcgccgatacccagggaagcaattggattcagaaagagactctggtcacattcaagaaccctcatgcgaagaaacaggacgtggttgtgttgggctctcaagaaggggccatgcacacggcactaaccggagctactgagatccagatgtcctcaggtaatctgctctttacaggccatctgaagtgccgtcttcgcatggacaaactgcagttgaaggggatgagctacagtatgtgtaccggaaaattcaagatcgtcaaggagattgccgaaacacaacacggcactatcgtgattaaagtacagtatgagggtgatgggtctccatgcaagatacccttcgaaatcatggacctcgagaaaagacatgttctgggcaggttaattaccgtgaacccgatcgtcacggaaaaggattcccctgtgaacatcgaggctgagcccccatttggagacagctacattataatcggcgtcgaacctgggcagctgaaactaaattggttcaagaagggatcgtctattggtcagatgtttgagaccacaatgcggggcgccaaacgaatggcaatcctcggggatactgcctgggacttcggatccctgggcggtgtgtttacctcaattgggaaggcacttcaccaagttttcggcgcgatctacggagcagcctttagtggcgtgagctggacaatgaaaatattgatcggggtaattatcacttggattggaatgaactcccgctctaccagcctgtcagtcagtctcgtgctggttggcgtggtcacgctttatctgggtgctatggtgcaggccgattccgggtgtgtagtgagctggaagaataaagaattgaagtgcggatctggcatcttcataacagacaacgttcacacctggactgagcagtacaagtttcagcccgaatcaccaagtaaactcgcaagcgccattcaaaaggctcatgaggagggtatctgtggcattagatccgtcacaaggctggaaaatttaatgtggaaacagatcacccccgagctgaaccacatactatctgaaaatgaggtgaagctcactatcatgaccggggatattaaaggaatcatgcaggccggcaagcggtcgctgcgccctcagccaacagaacttaaatatagctggaagacgtgggggaaggcaaaaatgttgtccaccgagtcacataaccaaactttcctgattgacggaccggagacagcggaatgccccaataccaacagagcttggaatagtctcgaggtggaagattacggctttggtgtcttcacaactaacatctggctgaagttaagggagaaacaggacgtattttgtgactctaagctgatgagcgccgcaataaaagataatcgtgccgtgcacgctgacatggggtattggattgagtccgcccttaacgatacctggaagatggaaaaggcatcattcatcgaggtgaaaagctgccactggcctaagtctcatacgttgtggtccaatggagtactcgaaagtgagatgatcattcccaagaatttcgctggccccgtcagccagcacaactaccggcctggttatcatacacagaccgccggcccatggcacctggggaagctagaaatggactttgatttctgtgagggaactaccgtggttgtgacagaggactgcggcaatcgagggccctctctgagaactaccacagcgtccggaaaactcatcacggaatggtgctgtaggtcatgcaccctgccgcctcttcgctaccggggcgaggatggttgttggtacgggatggaaattagaccattgaaggagaaggaagagaacctggtcaatagtttagtgactgccggacatggccaaatagacaactttagcctcggtgttctgggcatggctcttttcctggaggaaatgttgaggacacgcgtggggaccaaacacgcaatcctcctggtagccgtctcgtttgtgactctaattacaggaaatatgtccttccgagatctgggccgggtgatggtcatggttggggtgaccatgacggacgatatcggaatgggcgtaacttatctcgctctgcttgccgcatttaaggtgcgtcccaccttcgcggccggtttgctgttaagaaaactcacatctaaggagctgatgatggctaccattgggatcactcttctgagccagtcaacaatacctgaaaccatcctagagctcacagacgccctggcattgggaatgatggtcctgaaaattgtgaggaacatggaaaagtaccagttagctgttactatcatggccattagttgcgtgcccaatgcagtcatcctcctgaacgcctggaaggtgtcctgtaccatacttgctgcggtttctgtgagcccactgttgctcacgtcctcacaacagaaaacagattggattcctctggccctaaccatcaagggcctgaatcccactgcaatctttcttaccacactcagccgcacaagtaaaaagcggtcttggccactgaacgaggctgtcatggccgtaggcatggtgtccattttggccagctcgctgctaaagaatgacataccgatgaccgggcctctcgttgctggaggtctgcttacggtgtgctatgtcctgacaggcagatcagcagacttggagctcgaaagggccgcggatgtgaagtgggaggaccaggctgaaatctctgggagttcccccattctgagcatcaccatttctgaggatggaagcatgtccatcaaaaacgaggaagaggaacagactctaacaatactgatccgaaccggccttctcgtaatttcaggtgtgttcccagtcagtatccccattactgccgcagcctggtacctgtgggaggttaagaagcaacgcgctggggtgttgtgggacgtgcctagcccaccccctgtcggaaaagcagaattagaggatggcgcctatcggatcaagcagagaggcatactggggtactctcagattggagcgggtgtgtataaagagggcacatttcacaccatgtggcatgttacgagaggggctgtactcatgcaccgtggaaagcgcatcgaaccgtcctgggccgacgtgaaaaaggatctgatctcatacggcggtgggtggaaacttgagggagaatggaaagagggcgaagaggtccaggtgctggcattggagccaggcaagaatccccgggccgttcaaactaaacctgggctattcaagaccaacacaggaaccattggtgctgtgagtctggactttagcccaggcacatccgggtctcccatcgtcgatagaaaaggaaaggtggtaggcctctacggtaatggggtcgtgactaggtcgggagcctatgttagcgcaatagctcagaccgaaaagtcaattgaggacaaccctgaaatcgaggatgacattttcagaaagaagcggctgacgatcatggatcttcatccgggcgccggcaaaacaaagcgctacttacccgcgatagtgagagaagccattaaaagggggctgcggactctcatcttggcaccaacccgagtcgtggctgccgagatggaggaagctctgagaggactccctatccgctatcagacacccgcaattagggccgagcacaccggtcgtgaaatcgttgacctgatgtgtcatgccactttcaccatgcggcttctgtccccagtgagagtccctaactacaatttgattataatggacgaggctcactttacagatcccgcgagtatcgcagccaggggctatatttctacgcgcgtggagatgggggaagctgccggaatcttcatgactgcaaccccaccgggcagccgagacccttttccccagtccaacgccccaatcatggatgaggaaagagagattcccgaacggtcatggaactctggtcacgagtgggtaacagacttcaaggggaagaccgtgtggtttgttcctagcataaaagctggaaacgatatcgcggcctgcctaaggaagaatggcaaaaaggtcattcaactgagtcgcaaaactttcgactccgagtacgtgaagacacgtgcaaacgattgggactttgtggtcaccacggatatcagcgaaatgggcgctaatttcagagccgagcgggtaattgacccaaggcgctgtatgaagcccgtgatcctcactgatggggaagaacgagttatattagcaggacctatgccggtgacacattcttcagccgctcagagacggggtagggtcggccgcaaccccaaaaatgaaaacgaccagtatatctacatgggggagccactggagaatgacgaagattgcgcccactggaaggaggcgaaaatgcttctggacaacattaatacccctgaaggaatcattccctccatgtttgagccagaaagagagaaggtggatgcaatcgacggcgagtacaggctccggggtgaagcccgtaaaaccttcgttgatttgatgcgccgaggggacctgcctgtgtggctcgcttatagagtcgccgctgagggcataaactacgcagataggcggtggtgttttgacggaattaagaataaccaaatcctggaagagaacgtggaggtagaaatttggactaaagagggcgaacgcaagaaacttaaacccagatggctagatgccaggatctatagtgacccactggctttgaaggagttcaaagagttcgccgcagggagaaagagcttaacactgaatctcataaccgagatgggacgactgcctacatttatgactcagaaaacgagagatgcgcttgacaacctggccgtgctccataccgctgaggccggtggccgcgcatacaatcacgctttgtcggaactgccggagacactagaaactctgctccttctgaccttattggccacagttaccgggggaatcttcctgtttctcatgtctggcaagggtattgggaagatgactctgggcatgtgctgcatcattacggcatccatccttctgtggtatgcccagatacagccccactggattgctgcgagcatcatcctcgagttctttttgattgtcctgttaatcccagaacctgagaaacaaaggaccccacaggataaccagctaacatacgtggtgatagccattctgactgtcgttgcagctaccatggccaatgagatgggattcctcgaaaagactaaaaaggaccttggcctggggtcaatcaccactcaggagagtgaatctaacattttggacatcgatctgcggccagcctccgcatggacactctatgctgtggccacgacctttgtaactcctatgctgcgtcatagcatagaaaattcaagtgtgaacgtcagccttacagcgatcgctaatcaagccaccgtgctcatgggactgggtaaaggctggcccttgtccaagatggacattggggttccgctgttagcaatcggatgttactctcaggtgaacccaattaccctaacagccgctctgctccttctggtcgcacactacactatcattggccctggtttgcaggccaaggcgacgagagaagctcagaaaagggccgcagccgggatcatgaagaatcccaccgtagatggcataacagtgattgacctggagccaatcccctatgatcctaaattcgagaagcaactcggacaggttatgctgcttatcttatgcgtgactcaggtcctgatgatgcgcaccacatgggctctctgtgaagccttgaccctggcaactggcccgattagcacgctatgggaggggaaccccggacggttttggaatacaaccatagctgtgtccatggccaacatcttccgaggctcatacctggcgggtgccgggctcctattttctattatgaaaaatactaccaacacaagaaggggaactggcaatatcggtgaaaccctgggcgagaagtggaagagtcgcttgaacgcactggggaaatcggagttccagatttataagaaaagcggaatccaagaagtcgaccggacactcgctaaggagggcataaaaagaggggaaacggatcatcacgccgtgtcccgtggatctgcaaagctgaggtggtttgttgagcggaacatggtgaccccagaaggcaaagtagtggacttaggttgcgggcgcggaggctggtcatactattgtggtggccttaagaatgtccgagaggttaaggggctgactaaaggaggccctgggcatgaggaacccatccctatgagcacatacggatggaacctcgtgagactacagtccggcgtcgatgtgttcttcaccccacccgagaagtgcgacactctgttgtgtgatattggtgaaagttctcctaatccaacaatcgaggctgggaggaccctgcgggtactcaaccttgtggaaaattggctgaacaataacacgcagttttgcattaaagttttgaatccctatatgccgagcgtgatcgagaagatggagaccctgcaacgcaaatacggaggcgccctcgtcagaaaccctttatcaagaaattccacacacgaaatgtactgggtgagtaacgccactggcaatatagtcagctctgtgaacatgatttcccgaatgctgatcaatcggttcaccatgaagcacaagaaagcgacatatgagccagacgttgatcttgggtcaggaactcgtaacatcggtattgaaagcgagatacccaacctggacatcattggcaagagaatcgagaaaattaagcaggagcatgagacctcgtggcactacgaccaggatcatccttataaaacatgggcttaccacgggtcttatgaaaccaagcagactggaagtgcatccagcatggtaaatggcgtggtccgcctactcacgaagccatgggacgtggttcccatggtgacacaaatggccatgaccgatactaccccgtttggtcagcagagggtcttcaaagagaaggtggacacacggacgcaggaacctaaagaggggaccaagaaactgatgagaatcactgctgagtggttgtggaaggaactgggaaagaaaaagacaccccgcatgtgtaccagggaggaatttactcgaaaagtacggtcaaacgccgcactcggcgccatattcacagatgagaataagtggaaatccgctagagaagcggtggaggactctaggttttgggagcttgttgatcgcgaacgtaacctgcacttagagggcaagtgcgaaacctgtgtctacaatatgatggggaaacgggagaagaagctgggagagttcggtaaagccaagggcagcagagcaatctggtatatgtggttgggggctaggtacctcgagtttgaggccctgggattcctaaacgaagaccattggtttagtcgcggcaattcccttagcggtgtggagggggaaggactgcaccgactcggctacattctgcgggatgtgtctaaaaaggagggcggggcaatgtatgccgacgatacagctggatgggacactagaatcaccttggaagacctgaaaaacgaggagatggtcacgaatcatatgaagggtgaacacaagaaactcgccgaggcgattttcaaacttacctaccaaaacaaagttgtgagggtacagcgcccaacacctagaggcactgtgatggatatcatttcacggagggaccagcgtgggagtggacaggtcggcacctatggtctgaatacatttactaacatggaagcacaattaatacgacagatggagggggagggaatcttcaagtccattcagcatctgaccgtgacggaagagatcgccgttcaaaattggttggctcgcgtgggcagagaacggctcagcaggatggccatctctggcgatgactgcgtcgtgaaacccctggatgaccgcttcgcatcggctctaacagcccttaacgatatggggaaggtaagaaaggacattcagcagtgggagccatcacggggatggaatgattggacccaggttcccttttgcagccaccacttccatgaactggtgatgaaagacggtagggtcctcgtggtgccttgtcgaaaccaagatgagctgataggccgtgctagaatctcccagggggccggatggagtttgaaggagactgcatgcttaggcaaatcttacgcgcagatgtggacactgatgtattttcaccgccgggacctcaggcttgccgctaacgccatttgtagcgcagtcccatcccattgggttccgacctcaagaactacctggagtatccacgctaagcacgaatggatgacaacggaggatatgctggccgtgtggaatcgcgtatggattcaggaaaacccctggatggaggacaaaacccctgtggaatcttgggaggaggtcccatacctaggtaagcgggaagaccaatggtgcgggagcctgatcggactcacttccagggcaacatgggccaagaatatacagaccgcgatcaaccaggtgcgatcattgattggcaatgaggaatatactgattacatgcccagcatgaaaagattccggagggaggaagaggaggctggcgttctgtggtga

SEQ ID NO: 14279 - RNA, 9876 nt, synthetic construct
  misc_feature 1..9876: note = derived and/or modified CDS sequence (opt3) from DENV-2__JX669484__SS-prME
  source 1..9876: mol_type = other RNA
accgccggcgtgatcattatgctgatacccactgctatggctttccacctcactacgcggaacggggaacctcatatgatcgtcggaaggcaggaaaaaggtaaaagccttctgtttaaaaccgaagacggcgttaatatgtgcacattgatggccattgatttaggggaactgtgtgaggacactatcacctacaaatgcccacttctccggcaaaacgaaccggaggatattgactgttggtgcaattccacatctacctgggtgacttatggaacatgtaccacgactggcgagcaccgccgagaaaagcgttcagttgcgctggtgccccatgtcggtatggggcttgagaccaggacagaaacttggatgagtagcgagggagcttggaaacacgtgcagaggatcgagacctggatactgcggcatcctggcttcgccatcatggcagccattttggcttacacaatcggcaccacgcactttcagcgcgcactcattttcatcctgctgactgccgttgctccatccatgacaatgagatgcatagggatttctaacagggattttgtggaaggagtctcgggtggctcatgggtggacatcgtactcgagcacgggagctgtgttaccactatggccaagaataagcccacattagatttcgaactgattaaaaccgaggcgaagcagcctgcaacgcttcggaaatattgcatcgaagccaagttgaccaacacaactaccgagagtcgctgtccaacacaaggagagccctccctgaatgaagaacaggacaaacgatttatctgcaagcattctatggtggatagaggctggggtaacgggtgtggactattcggcaagggcgggattgtcacttgcgctatgtttacctgcaaaaagaatatggaaggaaaagtggtgctccctgagaacctggaatacacaatagtcatcaccccacacagcggtgaggagcatgccgttggcaatgacactgggaagcacggaaaagaaattaagatcacgccgcagtcctcaataacagaggcagaacttaccggctatggtactgtgaccatggagtgtagtcccaggacagggctggatttcaacgaaatggtattgctccagatggaggagaaggcttggctggtgcaccggcaatggtttttagacctgcctctcccatggcttcccggcgccgatacccagggaagcaattggattcagaaggaaactctggtcacattcaagaaccctcatgcgaaaaagcaggacgtggttgtgttgggctctcaagagggggccatgcacacggcactaaccggagctactgaaatccagatgtcctcaggtaatctgctctttacaggccatctgaaatgccgtcttcgcatggacaagctgcagttgaaagggatgagctacagtatgtgtaccggaaagttcaagatcgtcaaagagattgccgagacacaacacggcactatcgtgattagagtacagtatgaaggtgatgggtctccatgcaagatacccttcgagatcatggacctcgagaaaaggcatgttctgggccggttaattaccgtgaacccgatcgtcacggagaaggattcccctgtgaacatcgaagctgagcccccatttggagacagctacattataatcggcgtcgagcctgggcagctgaaactaaattggttcaagaagggatcgtctattggtcagatgtttgaaaccacaatgcgaggcgccaaacgcatggcaatcctcggggatactgcctgggacttcggatccctgggcggtgtgtttacctcaattgggaaggcacttcaccaagttttcggcgcgatctacggagcagcctttagtggcgtgagctggacaatgaaaatattgatcggggtaattatcacttggattggaatgaactccagatctaccagcctgtcagtcagtctcgtgctggttggcgtggtcacgctttatctgggtgctatggtgcaggccgattccgggtgtgtagtgagctggaagaataaagagttgaagtgcggatctggcatcttcataacagacaacgttcacacctggactgaacagtacaagtttcagcccgagtcaccaagtaaactcgcaagcgccattcaaaaggctcatgaagagggtatctgtggcattaggtccgtcacacggctggagaatttaatgtggaaacagatcacccccgaactgaaccacatactatctgagaatgaagtgaagctcactatcatgaccggggatattaaaggaatcatgcaggccggcaagcgctcgctgagacctcagccaacagagcttaaatatagctggaagacgtgggggaaggcaaaaatgttgtccaccgaatcacataaccaaactttcctgattgacggaccggagacagcggagtgccccaataccaacagggcttggaatagtctcgaagtggaggattacggctttggtgtcttcacaactaacatctggctgaagttacgtgaaaaacaggacgtattttgtgactctaagctgatgagcgccgcaataaaagataatcgggccgtgcacgctgacatggggtattggattgagtccgcccttaacggaacctggaagatggagaaggcatcattcatcgaagtgaaaagctgccactggcctaagtctcatacgttgtggtccaatggcgtactcgagagtgaaatgatcattcccaaaaatttcgctggtcccgtcagccagcacaactaccgacctggctatcatacacagaccgccgggccatggcacctgggaaagctagagatggattttgacttctgtgaaggcactaccgtggttgtgacagaggattgcgggaatagaggaccctctctgaggactaccacagcgtccggcaaactcatcacggagtggtgctgtcgctcatgcaccctgccgcctcttcggtacagaggtgaagacgggtgttggtacggaatggagattaggccattgaaggaaaaggaggaaaacctggtcaatagtttagtgactgccggccatggtcaaatagataactttagcctcggcgttctggggatggctcttttcctggaggagatgttgcgcacacgagtgggaaccaaacacgcaatcctcctggtagccgtctcgtttgtgactctaattacaggcaatatgtccttcaaggacctggggcgggtgatggtcatggttggagtggctatgaccgatgacatcggcatgggtgtaacgtatctcgccctgcttgcagcgtttaaagtgcgtcccactttcgccgctgggttgctgttaagaaagctcacctctaaagaactgatgatggccacaattggaatcacccttctgagccagtcaactatacctgagacaatcctagaactcaccgatgcactggctttgggcatgatggtcctgaagattgtgaggaacatggagaagtaccagttagccgttacaatcatgactattagttgcgtgcccaatgcagtcatcctcctgaacgcctggaaagtgtcctgtaccatacttgctgcggtttctgtgagcccactgttgctcacgtcctcacaacagaagacagactggattcctctggccctaaccatcaaaggcctgaatcccactgcaatctttcttaccacactcagccgcacaagtaagaaacggtcttggccactgaacgaagctgtcatggccgtagggatggtgtccattttggccagctcgctgttaaagaatgatataccgatgaccggacctctcgttgctggtggcctgcttacggtgtgctatgtcctgacagggagatcagcagacttggagctcgagagggccgcggacgtgaaatgggaagatcaggctgagatctctggaagttcccccattctgagcatcaccatttctgaagacggcagcatgtccatcaagaacgaggaggaagaacagactctaacaatactgatccgaaccggtcttctcgtaatttcaggggtgttcccagtcagtatccccattactgccgcagcctggtacctgtgggaagttaagaaacaacgcgctggagtgttgtgggatgtgcctagcccaccccctgtcggcaaggcagagttagaagacggcgcctatcggatcaaacagagagggatactgggatactctcagattggtgcgggcgtgtataaggaggggacatttcacaccatgtggcatgttacgaggggagctgtactcatgcaccgtggcaaacgcatcgagccgtcctgggccgatgtgaagaaggacctgatctcatacggtgggggatggaaacttgaaggcgagtggaaggaaggcgaggaagtccaggtgctggcattggagccagggaaaaatccccgggccgttcaaactaagcctggactattcaaaaccaacacaggtaccattggcgctgtgagtctggattttagcccagggacatccggatctcccatcgtcgacagaaagggcaaggtggtaggtctctacgggaatggagtcgtgactaggtcgggcgcctatgttagcgcaatagctcagaccgagaaatcaattgaagataaccctgagatcgaagacgatattttccgaaagaaacggctgacgatcatggaccttcatccgggcgccgggaagacaaaacgctacttacccgcgatagtgagagaggccattaagaggggactgcggactctcatcttggcaccaacccgagtcgtggctgccgaaatggaggaggctctgagaggtctccctatccgctatcagacacccgcaattagggccgaacacaccggccgtgagatcgttgatctgatgtgtcatgccactttcaccatgcggcttctgtccccagtgagagtccctaactacaatttgattataatggacgaagctcactttacagaccccgcgagtatcgcagccagggggtatatttctacgcgcgtggagatgggagaggctgccggcatcttcatgactgcaaccccaccgggtagccgagatccttttccccagtccaacgccccaatcatggacgaagagagagaaattcccgagcggtcatggaactctgggcacgaatgggtaacagatttcaagggaaaaaccgtgtggtttgttcctagcataaaggctggcaacgacatcgcggcctgcctaaggaaaaatggcaagaaagtcattcaactgagtcgcaagactttcgattccgagtacgtgaagacacgtgcaaacgactgggattttgtggtcaccacggacatcagcgagatgggggctaatttcagagccgaacgggtaattgatccaaggcgctgtatgaaacccgtgatcctcactgacggagaggaacgagttatattagcaggtcctatgccggtgacacattcttcagccgctcagagacggggcagggtcgggcgcaacccaaagaatgagaacgatcagtatatctacatgggagaacccctggagaatgacgaggactgcgcccactggaaagaagcgaagatgcttctggataacattaatacccctgagggcatcattccctccatgtttgaaccagagagagaaaaagtggacgcaatcgatggtgagtacaggctcagaggggaagcccgtaagaccttcgttgacttgatgcgccgaggcgatctgcctgtgtggctcgcttatagagtcgccgctgaaggaataaactacgcagacaggcggtggtgttttgatggcattaaaaataaccaaatcctggaggaaaacgtggaggtagagatttggactaaggaaggggagcgcaagaaacttaagcccagatggctagacgccaggatctatagtgatccactggctttgaaagagttcaaggagttcgccgcaggacgaaagagcttaacactgaatctcataaccgaaatgggtcggctgcctacatttatgactcagaaggcgagagacgcccttgataacctggctgtgctccatacggccgaggcaggcgggcgcgcttacaatcacgccttgtcggagctgccggaaaccctagagacactgctccttctgactttattggcaaccgttacaggaggcatcttcctgtttctcatgtctggtaagggggtcggcaaaatgaccctgggaatgtgctgcattatcactgcctccattcttctgtggtatgctcagatccagccccactggatagcggccagcattatcctcgagttctttttgatcgtgctgttaattccagagcctgaaaagcaaaggacgccccaggacaaccagctaacctacgtggtcatcgcaatactgacagttgtggctgccactatggccaatgagatgggcttcctcgagaaaaccaagaaagatcttgggctgggatcaattacaacccaggaaagtgagtctaacatcttggacattgacctgcggccagcatccgcttggactctctatgccgtagcgacaacgtttgtgacccctatgctgcgtcatagcatcgaaaattcaagtgtcaacgtgagccttactgctatagccaatcaagcaacagttctcatgggtctgggcaaggggtggcccttgtccaagatggatatcggagtgccgctgttagccattggctgttactctcaggtcaacccaatcaccctaaccgctgcactgctccttctggtagcccactacgcgattatcggtcctgggttgcaggctaaagccacaagagaggcacagaagagggccgctgccggcattatgaaaaatcccactgtggacggaatcacggttatagatctggaaccaattccctatgaccctaagttcgagaaacaactcggccaggtgatgctgcttatcttatgcgtcacccaggtgctgatgatgcgcacaacttgggcactctgtgaggctttgaccctggccacagggccgatcagcaccctatgggaaggaaaccccggccggttttggaatactacgattgcggtctccatggccaacatattccgaggttcatacctggcaggggctggactcctattttctatcatgaagaatacaaccaacactagaaggggcaccggtaatattggcgagacactgggggaaaagtggaaaagtcgcttgaacgccctgggaaagtcggagttccagatctataaaaagagcggcattcaagaggtggatcggactctcgcaaaagaagggatcaagagaggagagaccgaccatcacgctgtttcccgtggctctgccaaactgaggtggtttgtggaacggaacatggtaacaccagagggtaaggtggtcgatttagggtgcggacgcggcggttggtcatactattgtggcgggcttaagaatgttcgagaagtgaaaggactgacgaagggcgggcctggacatgaggagcccatacctatgagcacctacggctggaacctcgtcagactacagtccggtgtggacgtattcttcactccacccgaaaaatgcgatacactgttgtgtgacatcggggagagttctcctaatccaaccattgaagccggaaggactctgcgggtgctcaaccttgttgagaattggctgaacaataacacacagttttgcatcaaggtgttgaatccctatatgccgagcgtcattgagaaaatggagaccctgcaacgcaagtacggcggcgcgctcgtgagaaaccctttatcaagaaattccacgcacgagatgtactgggtcagtaacgctaccgggaatatcgtgagctctgttaacatgatatcccgaatgctgattaatcggttcacaatgaagcacaaaaaggcaacttatgaaccagatgtagaccttggatcaggtacccgtaacatcggcatcgagagcgaaattcccaacctggatataatcgggaaaagaattgagaagatcaaacaggaacatgagacatcgtggcactacgaccaggaccatccttataagacttgggcctaccacggatcttatgagaccaagcagacaggcagtgcttccagcatggtgaatggtgtcgtgcgcctactcaccaaaccatgggatgttgtgcccatggtcactcaaatggccatgacggacacaaccccgtttgggcagcagagggtgttcaaggaaaaagtagatactcggacccaggagcctaaggaaggaacgaaaaagctgatgagaattacagcagagtggttgtggaaggagctgggcaaaaagaaaaccccacgcatgtgtactagggaagagtttacacgaaaggtgcggtcaaacgccgctctcggcgcgatcttcaccgacgaaaataaatggaagtccgccagagaggcagttgaagattctaggttttgggagcttgtcgaccgcgagcgtaacctgcacttagaagggaaatgcgagacttgtgtgtacaatatgatgggaaagcgggaaaagaaactgggtgagttcggcaaggctaaagggagcagagccatatggtatatgtggttgggagcaaggtttctcgagttcgaggccctgggctttctaaacgaggatcattggttcagtcgcggtaattcccttagcggggtggaaggagagggcctgcaccgactcggctacatcctgcgggacgtctctaagaaagaagggggagctatgtacgccgatgacacagcgggttgggataccagaattacattggaggacctgaagaacgaagagatggttatcaatcatatgaagggcgagcacaaaaagctcgcagaagccatttttaaacttacttatcaaaacaaggtggtaagggtgcagcgcccaacccctagagggacggtcatggacatcatttcacggagggatcagcgtggaagtggccaggtgggtacctacgggctgaatacattcactaacatggaggctcaattaatacgacagatggaaggagagggcatcttcaaatccattcagcatctgaccgttacagaggaaatcgccgtgcaaaattggttggcacgcgtcggcagagagcggctcagcaggatggctatctctggggacgattgcgtggtaaagcccctggacgatcgctttgcctcggctctaactgcccttaacgacatgggaaaggttagaaaagatattcagcagtgggaaccatcacggggttggaatgactggacccaggtgcccttctgcagccaccactttcatgagctggtcatgaaggatggcagggtgctcgtggtcccttgtcgaaaccaagacgaactgatagggcgtgcaagaatctcccagggagcgggctggagtttgaaagagacggcctgcttaggtaagtcttatgctcagatgtggacactgatgtacttccaccgccgggatctcaggcttgccgcaaacgctatttgtagcgccgttccatcccattgggtgccgacctcaagaactacatggagtatccacgcaaaacacgagtggatgaccactgaagacatgctggccgtatggaatcgcgtgtggattcaggagaacccctggatggaagataagacccctgtcgagtcttgggaagaggtgccatatctagggaagcgggaggaccaatggtgcggaagcctgatcggcctcacatccagggcgacgtgggctaaaaatatacagaccgccatcaaccaggttcgatcattgattggcaatgaagagtacactgactatatgcccagcatgaagagatttcggagggaagaggaagaggcaggggtgctgtggtga

SEQ ID NO: 14280 - RNA, 9876 nt, synthetic construct
  misc_feature 1..9876: note = derived and/or modified CDS sequence (opt3) from DENV-2__JX669485__SS-prME
  source 1..9876: mol_type = other RNA
accgccggcgtgatcattatgctgatacccactgctatggctttccacctcactacgaggaatggggagcctcatatgatcgtcggaaagcaggaaaaaggtaagagccttctgtttaaaaccgaggacggcgttaatatgtgcacattgatggccattgatttaggggaactgtgtgaggacactatcacctacaagtgcccacttctcaggcaaaacgaaccggaggatattgactgttggtgcaattccacatctacctgggtgacttatggaacatgtaccacgactggcgagcaccggcgcgaaaaacgatcagttgcgctggtgccccatgtcggtatggggcttgagacccgtacagaaacttggatgagtagcgagggagcttggaagcacgtgcagcggatcgagacctggatactgaggcatcctggcttcgccatcatggcagccattttggcttacacaatcggcaccacgcactttcagcgggcactcattttcatcctgctgactgccgttgctccatccatgacaatgcgctgcatagggatttctaacagggattttgtggaaggagtctcgggtggctcatgggtggacatcgtgctcgagcacgggagctgtgttaccactatggccaagaataaacccacattagatttcgaactgattaagaccgaggcgaaacagcctgcaacgcttaggaagtattgcatcgaagccaaattgaccaacacaactaccgagagtcggtgtccaacacaaggagagccctccctgaatgaggaacaggacaagcgctttatctgcaagcattctatggtggatcgaggctggggtaacgggtgtggactattcggcaaaggcgggattgtcacttgcgctatgtttacctgcaagaaaaatatggaaggaaaggtggtgctccctgagaacctggaatacacaatagtcatcaccccacacagcggtgaggagcatgccgttggcaatgacactgggaaacacggaaaggaaattaaaatcacgccgcagtcctcaataacagaggcagaacttaccggctatggtactgtgaccatggagtgtagtcccagaacagggctggatttcaacgaaatggtattgctccagatggaggagaaggcttggctggtgcacaggcaatggtttttagacctgcctctcccatggcttcccggcgccgatacccagggaagcaattggattcagaaggaaactctggtcacattcaaaaaccctcatgcgaagaaacaggacgtggttgtgttgggctctcaagagggggccatgcacacggcactaaccggagctactgaaatccagatgtcctcaggtaatctgctctttacaggccatctgaagtgccggcttcgtatggacaaactgcagttgaaggggatgagctacagtatgtgtaccggaaagttcaaaatcgtcaaggagattgccgagacacaacacggcactatcgtgattcgcgtacagtatgaaggtgatgggtctccatgcaaaatacccttcgagatcatggacctcgaaaagagacatgttctgggcaggttaattaccgtgaacccgatcgtcacggagaaagattcccctgtgaacatcgaagctgagcccccatttggagacagctacattataatcggcgtcgagcctgggcagctgaagctaaattggttcaagaaaggatcgtctattggtcagatgtttgaaaccacaatgcggggcgccaagcgaatggcaatcctcggggatactgcctgggacttcggatccctgggcggtgtgtttacctcaattgggaaagcacttcaccaagttttcggcgcgatctacggagcagcctttagtggcgtgagctggacaatgaagatattgatcggggtaattatcacttggattggaatgaactcccgctctaccagcctgtcagtcagtctcgtgctggttggcgtggtcacgctttatctgggtgctatggtgcaggccgattccgggtgtgtagtgagctggaaaaataaggagttgaagtgcggatctggcatcttcataacagacaacgttcacacctggactgaacagtacaaatttcagcccgagtcaccaagtaagctcgcaagcgccattcaaaaagctcatgaagagggtatctgtggcattagatccgtcacaaggctggagaatttaatgtggaagcagatcacccccgaactgaaccacatactatctgagaatgaagtgaaactcactatcatgaccggggatattaagggaatcatgcaggccggcaaacggtcgctgcgccctcagccaacagagcttaagtatagctggaagacgtgggggaaagcaaagatgttgtccaccgaatcacataaccaaactttcctgattgacggaccggagacagcggagtgccccaataccaacagagcttggaatagtctcgaagtggaggattacggctttggtgtcttcacaactaacatctggctgaaattaagggaaaagcaggacgtattttgtgactctaaactgatgagcgccgcaataaaggataatcgtgccgtgcacgctgacatggggtattggattgagtccgcccttaacggaacctggaagatggagaaagcatcattcatcgaagtaaagagctgccactggcctaaatctcatacgttgtggtccaatggcgtactcgagagtgaaatgatcattccaaagaacttcgctggtcccgtcagccagcacaactaccggcctggctatcatacacagaccgccgggccatggcacctgggaaaactagagatggattttgacttctgtgaaggcactaccgtggttgtgacagaggattgcgggaatcgaggaccctctctgagaactaccacagcgtccggcaagctcatcacggagtggtgctgtaggtcatgcaccctgccgcctcttcgctaccggggtgaagacgggtgttggtacggaatggagattagaccattgaaggaaaaagaggaaaacctggtcaatagtttagtgactgccggccatggtcaaatagataactttagcctcggcgttctggggatggctcttttcctggaggagatgttgaggacacgcgtgggaaccaagcacgcaatcctcctggtagccgtctcgtttgtgactctaattacaggcaatatgtccttccgagacctggggcgggtgatcgtcatggttggagtgaccatgacggatgacattggcatgggtgtaacttatctcgctctgcttgccgcatttaaagtgcgtcccaccttcgcggccgggttgctgttaagaaagctcacatctaaagaactgatgatggctaccatcggaataactcttctgagccagtcaacaatccctgagaccattctagaactcacagatgccctggcattgggcatgatggtcctgaagatcgtgaggaacatggagaagtaccagttagctgttactattatggccatcagttgcgtgcccaatgcagtcatactcctgaacgcctggaaagtgtcctgtaccattcttgctgttgtgtctgtcagcccactgttgctcacgtcctcacaacagaagacagactggatccctctggcgctaaccatcaaaggcctgaatcccactgccatttttcttaccacactcagccgcacaagtaagaaacggtcttggccactgaacgaagcagtaatggctgtggggatggtttccatattggccagctcgctgttaaagaatgatatcccgatgaccggacctctcgtggccggtggcctgcttacggtctgctatgtgctgacagggagatcagctgacttggagctcgagagggcagccgacgtaaaatgggaagatcaggcggagatttctggaagttcccccatcctgagcattaccatctctgaagacggcagcatgtccataaagaacgaggaggaagaacagactctaacaatcctgattcgaaccggtcttctcgtgatctcaggggtcttcccagttagtattcccatcactgctgccgcatggtacctgtgggaagtgaagaaacaacgcgccggagtgttgtgggatgtccctagcccaccccctgtggagaaggctgaattagaggacggcgcatatcggataaaacagagaggcattctggggtactctcagatcggagccggtgtttataaggagggcacatttcacaccatgtggcatgtaacgagaggggcggtgctcatgcaccgtggaaaacgcatcgaaccgtcctgggctgatgtcaagaaggacctgatttcatacggcggtgggtggaaacttgagggagaatggaaggagggcgaagaggtgcaggttctggccttggagccaggcaaaaatccccgggcagtgcaaactaagcctgggctattcaaaaccaacacaggaaccatcggtgccgtcagtctggattttagcccaggcacatccgggtctcccatagtggacagaaagggaaaggtagtcggcctctacggtaatggggtggttactaggtcgggagcttatgtgagcgccattgcacagaccgaaaaatcaatcgaggataaccctgaaattgaggacgatatcttccgaaagaaacggctgacgataatggaccttcatccgggcgctggcaagacaaaacgctacttacccgccattgtcagagaagcgatcaagagggggctgcggactctcatcttggccccaacccgagtggttgcagctgagatggaggaagccctgagaggactccctattcgctatcagacacccgctatcagggcagagcacaccggtcgtgaaattgtggatctgatgtgtcatgccactttcaccatgcggcttctgtccccagtcagagtgcctaactacaatttgataatcatggacgaggcccactttacagaccccgctagtattgcggcaaggggctatatctctacgcgcgtagagatgggggaagccgctggaatcttcatgactgccaccccaccgggcagccgagatccttttccccagtccaacgcaccaattatggacgaggaaagagagatacccgaacggtcatggaactctggtcacgagtgggtgacagatttcaaggggaaaaccgtttggtttgtccctagcatcaaggccggaaacgacattgctgcgtgcctaaggaaaaatggcaagaaagtgatccaactgagtcgcaagactttcgattccgagtacgtgaagacacgtgccaacgactgggattttgtcgtaaccacggacattagcgaaatgggcgcaaatttcaaagctgagagagtgatcgatccacggaggtgtatgaagcccgttatactcactgacggggaagaacgcgtgatcttagccggacctatgccggtcacacattcttcagcagcccagcgaagaggtcgggtgggcaggaaccccaaaaatgaaaacgatcagtatatttacatgggggagccactggagaatgacgaagactgcgctcactggaaggaggccaaaatgcttctggataacatcaatacccctgaaggaattatcccctccatgtttgagccagaacgcgagaaggttgacgcgatagatggcgagtacagactcaggggtgaagcacggaaaaccttcgtggacttgatgcgtcgcggggatctgcctgtctggctcgcctatcgagtggctgccgagggcattaactacgctgacagaaggtggtgttttgatggaatcaagaataaccaaattctggaagagaacgtagaggtggaaatctggactaaggagggcgaacggaagaaacttaaaccccgctggctagacgcaagaatatatagtgatccactggccttgaaagagttcaaagagttcgctgccgggagaaagagcttaacactgaatctcatcaccgagatgggacggctgcctacatttatgactcagaaggcacgagacgcgcttgataacctggccgttctccatacggctgaggccggtggcagagcatacaatcacgctttgtcggaactgccggagaccctagaaacactgctccttctgactttattggccaccgtcacagggggaattttcctgtttctcatgtctggcaaaggtatcgggaagatgaccctgggcatgtgctgcattatcactgcatccatacttctgtggtatgcccagattcagccccactggatcgctgcgagcatcattctcgagttctttttgatcgtgctgttaataccagaacctgagaaacaacgcacgccccaggacaaccagctaacctacgtggtcattgccatcctgacagttgtggcagctactatggccaatgagatgggattcctcgaaaagaccaaaaaggatcttggcctggggtcaattacaacccaggagagtgaatctaacatcttggacatagacctgaggccagcctccgcatggactctctatgctgtagccacaacgtttgtgacccctatgctgcggcatagcatcgaaaattcaagtgtcaacgtgagccttactgcgattgctaatcaagccacagttctcatgggactgggtaagggctggcccttgtccaaaatggatatcggggtgccgctgttagcaattggatgttactctcaggtcaacccaatcaccctaaccgccgctctgctccttctggtagcacactacgccattatcggccctggtttgcaggcgaaggctacacgtgaagcccagaaaagagcagccgctgggataatgaagaatcccactgtggacggcattacggttatcgatctggagccaatcccctatgaccctaaattcgagaagcaactcggacaggtgatgctgcttattttatgcgtcacccaggtgctgatgatgaggacaacttgggccctctgtgaagcattgaccctggctacaggcccgataagcaccctatgggaggggaaccccggacgcttttggaatactacgatcgccgtctccatggcgaacattttccggggctcatacctggccggtgcagggctcctattttctatcatgaagaatacaaccaacactcgaagaggaaccggcaatattggtgaaacactgggcgagaaatggaagagtaggttgaacgctctggggaaatcggagttccagatctataagaaaagcggaatacaagaagtggatcgcactctcgccaaggagggcatcaaaagaggggaaaccgaccatcacgcagtttccagaggatctgctaagctgcgttggtttgtggagaggaacatggtaacaccagaaggcaaggtggtcgatttaggttgcgggcggggaggctggtcatactattgtggtggccttaaaaatgttcgcgaggtgaaggggctgacgaaaggaggccctgggcatgaggaacccattcctatgagcacctacggatggaacctcgtccgactacagtccggcgtggacgtattcttcactccacccgagaagtgcgatacactgttgtgtgacatcggtgaaagttctcctaatccaaccattgaggccgggagaactctgagggtgctcaaccttgttgaaaattggctgaacaataacacacagttttgcatcaaagtgttgaatccctatatgccgagcgtcatagagaagatggagaccctgcaacggaagtacggaggcgccctcgtgcgcaaccctttatcaagaaattccacgcacgaaatgtactgggtcagtaacgcgaccggcaatattgtgagctctgttaacatgatctccaggatgctgatcaatcgattcacaatgaaacacaagaaagctacttatgagcttgatgtagacctggggtcaggaacccggaacattggtatagaaagcgagacaccaaacctagatatcattggcaagcgtatcgagaagattaagcaggagcatgagacttcgtggcactacgaccaggaccatccctataagacctgggcataccacgggtcttatgaaacaaaacagaccggaagtgcctccagcatggtgaatggcgtcgtgagactcctgactaagccttgggatgttgtgccaatggtcacgcaaatggctatgacagacaccactccctttggtcagcagcgcgtgttcaaagagaaggtagataccaggacacaggaaccgaaagaggggacgaagaagttgatgcggatcaccgccgagtggctgtggaaagaactcggaaagaaaaagactcctagaatgtgtacacgcgaggaatttaccaggaaagtgcgatcaaacgcagcccttggcgctatattcactgacgagaataagtggaaatccgcgcgggaagccgttgaggattctagattttgggagctggtcgacagggaacgcaacttacacctggagggcaagtgcgaaacatgtgtgtacaatatgatggggaagcgtgagaaaaagttgggagagttcggtaaagcaaagggcagccgggctatctggtatatgtggctcggggccagatttctggagttcgaggcactaggatttcttaacgaagatcattggttcagtaggggcaattccctgagcggtgtggagggggaaggactccaccgcctgggctacattttgcgagacgtctctaaaaaggagggcggggccatgtacgctgatgacaccgccggatgggatacacggatcactctggaagacctcaagaacgaggagatggttaccaatcatatgaaaggtgaacacaagaaacttgcggaggcaatttttaagctgacgtatcaaaacaaagtggtaagagtgcagaggcccaccccacgcggcacagtcatggacatcatttcaagacgggatcagagggggagtggacaggtgggcacttacggtttaaataccttcacaaacatggaagcccaactgatacgtcagatggagggggagggaatcttcaagtccattcagcatttgactgttaccgaagagatcgctgtgcaaaattggctcgcccgagtcggccgcgaaagactgagccggatggcaatctctggcgacgattgcgtggtaaagcctctagacgataggtttgcttcggcccttacggctctgaacgacatggggaaagttcgcaaggatattcagcagtgggagccctcaagaggatggaatgactggacacaggtgccattctgcagccaccactttcatgaactcgtcatgaaagatggtcgggtgctggtggtcccctgtaggaaccaagacgagttgataggccgagcccgtatctcccagggggcaggatggagtttaaaggagaccgcgtgcctgggcaaatcttatgcccagatgtggactctcatgtacttccacagacgcgatcttcggctggctgccaacgcaatttgtagcgctgttccttcccattgggtgccaacatcaaggaccacttggagtatccacgccaagcacgaatggatgaccacagaggacatgctagcagtatggaatagagtgtggattcaggaaaacccgtggatggaggataagacgcccgtcgaatcttgggaggaggtgccttatctgggtaaacgcgaagaccaatggtgcgggagcctcatcggattgacctcccgggccacttgggcgaagaatatacagacagctatcaaccaggttaggtcactgattggcaatgaggaatacaccgactatatgccaagcatgaaacgatttagacgggaggaagaggaggccggcgtgctttggtga

SEQ ID NO: 14281 - RNA, 9876 nt, synthetic construct
  misc_feature 1..9876: note = derived and/or modified CDS sequence (opt3) from DENV-2__JX669486__SS-prME
  source 1..9876: mol_type = other RNA
accgccggcgtgataattatgctgatacccacagctatggctttccacctcactacgagaaatggggagcctcatatgatcgtcggaagacaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagttgcgctggtgccccatgtcggtatggggcttgagaccagaacagaaacttggatgagtagcgagggagcttggaaacacgtgcagaggatcgagacctggatactgcggcatcctggcttcgccatcatggcagccattttggcttacacaatcggcaccacgcactttcagcgcgcactcattttcatcctgctgactgccgttgctccatccatgacaatgagatgcatagggatttctaacagggattttgtggaaggagtctcgggtggctcatgggtggacatcgtgctcgagcacgggagctgtgttaccactatggccaagaataagcccacattagatttcgaactgattaaaaccgaggcgaagcagcctgcaacgcttcggaaatattgcatcgaagccaagttgaccaacacaactaccgagagtcgctgtccaacacaaggagagccctccctgaatgaagaacaggacaaacgatttatctgcaagcattctatggtggatagaggctggggtaacgggtgtggactattcggcaagggcgggattgtcacttgcgctatgtttacctgcaaaaagaatatggaaggaaaagtggtgctccctgagaacctggaatacacaatagtcatcaccccacacagcggtgaggagcatgccgttggcaatgacactgggaagcacggagaagagattaaaatcacgccgcagtcctcaataacagaagcagagcttaccggctatggtactgtgaccatggaatgtagtcccaggacagggctggatttcaacgagatggtattgctccagatggaggaaaaggcttggctggtgcaccggcaatggtttttagacctgcctctcccatggcttcccggcgccgatacccagggaagcaattggattcagaaagagactctggtcacattcaagaaccctcatgcgaagaaacaggacgtggttgtgttgggctctcaagaaggggccatgcacacggcactaaccggagctactgagatccagatgtcctcaggtaatctgctctttacaggccatctgaagtgccgtcttcgcatggacaaactgcagttgaaggggatgagctacagtatgtgtaccggaaaattcaagatcgtcaaggagattgccgaaacacaacacggcactatcgtgattagagtacagtatgagggtgatgggtctccatgcaaaatacccttcgaaatcatggacctcgagaagaggcatgttctgggccggttaattaccgtgaacccgatcgtcacggaaaaagattcccctgtgaacatcgaggctgagcccccatttggagacagctacattataatcggcgtcgaacctgggcagctgaagctaaattggttcaaaaagggatcgtctattggtcagatgtttgagaccacaatgcgaggcgccaagcgcatggcaatcctcggggatactgcctgggacttcggatccctgggcggtgtgtttacctcaattgggaaagcacttcaccaagttttcggcgcgatctacggagcagcctttagtggcgtgagctggacaatgaagatattgatcggggtaattatcacttggattggaatgaactccagatctaccagcctgtcagtcagtctcgtgctggttggcgtggtcacgctttatctgggtgctatggtgcaggccgattccgggtgtgtagtgagctggaaaaataaggaattgaaatgcggatctggcatcttcataacagacaacgttcacacctggactgagcagtacaagtttcagcccgaatcaccaagtaagctcgcaagcgccattcaaaaagctcatgaggagggtatctgtggcattaggtccgtcacacggctggaaaatttaatgtggaagcagatcacccccgagctgaaccacatactatctgaaaatgaggtgaaactcactatcatgaccggggatattaagggaatcatgcaggccggcaaacgctcgctgagacctcagccaacagaacttaagtatagctggaaaacgtgggggaaggcaaagatgttgtccaccgagtcacataaccaaactttcctgattgacggaccggagacagcggaatgccccaataccaacagggcttggaatagtctcgaggtggaagattacggctttggtgtcttcacaactaacatctggctgaaattacgtgagaagcaggacgtattttgtgactctaaactgatgagcgccgcaataaaggataatcgggccgtgcacgctgacatggggtattggattgagtccgcccttaacgatacctggaaaatggaaaaggcatcattcatcgaggtaaagagctgccactggcctaaatctcatacgttgtggtccaatggagtactcgaaagtgagatgatcattccaaagaacttcgctggccccgtcagccagcacaactaccgacctggttatcatacacagaccgccggcccatggcacctggggaaactagaaatggactttgatttctgtgagggaactaccgtggttgtgacagaggactgcggcaatagagggccctctctgaggactaccacagcgtccggaaagctcatcacggaatggtgctgtcgctcatgcaccctgccgcctcttcggtacagaggcgaggatggttgttggtacgggatggaaattaggccattgaaagagaaggaagagaacctggtcaatagtttagtgactgccggacatggccaaatagacaactttagcctcggtgttctgggcatggctcttttcctggaggaaatgttgcgcacacgagtggggaccaagcacgcaatcctcctggtagccgtctcgtttgtgactctaattacaggaaatatgtccttccgggatctgggccgtgtgatggtcatggttggggtgaccatgacggacgatatcggaatgggcgtaacttatctcgctctgcttgccgcatttaaagtgagacccaccttcgcggccggtttgctgttaaggaagctcacatctaaagagctgatgatggctaccattgggatcactcttctgagccagtcaacaacccctgaaacaatactagagctcactgacgccctggcattgggaatgatggtcctgaagatcgtgcgcaacatggaaaaataccagttagctgttaccattatgacgatcctctgcgtgcccaatgccgtcattctgcttaacgcatggaaggtgagttgtacaatcctggccgttgtgtccgtctctccattgctcctgaccagctcccaacagaagactgattggatacctctagctctgaccattaaaggccttaatcccacagcgatctttctcactaccctgtcacggacgagcaagaaaagaagttggccattgaacgaggccgtaatggcagtgggcatggtttctatcctggcttccagcttactcaagaatgacattccgatgacagggcctctggtggccggaggtcttctgaccgtctgctatgtgttgactggcaggtcggccgacctcgagctggaacgagctgcagatgtaaaatgggaggaccaggccgaaatatcagggtctagtcccatcctatccattacaatcagcgaggatggatctatgagcattaagaacgaggaagaggaacagaccctgactatccttatacgcacaggcctcctggtgatctccggtgtcttcccagtttcaattcccatcaccgcggctgcctggtacttgtgggaggtgaaaaagcaacgggcaggggtgttatgggacgtccctagtccaccccctgtggaaaaggccgagctggaggatggagcttatagaattaaacagaggggcatcctcggctacagccagataggggcaggagtttataaggaaggtacgtttcacactatgtggcatgtaacccgtggcgccgtgctgatgcaccgcgggaaacggattgagccgtcttgggcggacgtcaagaaagatcttatctcctacggaggcggttggaagctggaaggggagtggaaggaaggagaggaggtgcaggttttggctctagaaccaggcaaaaatcccagagccgtgcaaacaaagcctggcctgttcaaaaccaacacagggactatcggagcagtctcactcgactttagtccaggtaccagcggctcccccattgtggataggaaggggaaagtagtcggactgtacggcaatggtgtggttacgcgatctggggcctatgtgtcggctatcgcccagacagaaaagagcatagaagacaaccctgagattgaagatgacatcttccggaagaaacgccttactattatggatttacatccgggagcaggcaagaccaaaagatacctgcccgctatcgtcagggaggccataaagcggggcctccgaacattgattctggcgccaaccagagtggttgccgcagagatggaagaggctctccgcgggctgcctatcaggtatcagactcccgccatccgtgctgaacacaccggacgggagattgtggaccttatgtgtcatgcaacattcacgatgagactgttgtcaccagtcagggtgcctaactacaatctaatcattatggacgaggcccactttactgatcccgcctccatagctgcgcgcggttatatcagtacccgagtagaaatgggcgaggcagccgggattttcatgacagctaccccaccgggatctagagacccttttccccagagcaacgccccaatcatggatgaagaacgggaaatccccgagaggtcctggaactcaggccacgagtgggtgactgacttcaaaggtaagacagtttggtttgtcccttctattaaggcagggaacgatatagccgcttgcctgcgcaaaaatggaaagaaagtgatccaactcagccgtaagaccttcgacagtgaatacgtgaaaacgagagcgaacgattgggactttgtcgtaactacagatatttccgagatgggcgccaatttccgggcagaaagggtgatcgacccacgccgatgtatgaagcccgttattttaaccgatggcgaggaaagagtgatcctggctgggcctatgccggtcacccatagctctgccgcacagcggaggggacgcgtgggtagaaacccaaagaatgagaacgaccagtatatatacatgggcgagccccttgaaaatgacgaggattgcgcccactggaaagaagctaagatgctgctcgacaacatcaatactcctgaggggattatcccctcaatgtttgaaccagagagggagaaagttgatgccattgacggagaataccggttgcgtggcgaggcgcgcaagacattcgtggatctgatgcgaagaggtgacctccctgtctggctggcatatagggtggccgctgaagggatcaactacgccgatcggcgctggtgttttgacggcatcaagaataaccaaattcttgaggagaacgtagaagtggagatctggaccaaggaaggagagaggaagaagctaaagcccaggtggctggatgctcggatttattccgacccattggcattaaaagagttcaaggagttcgccgctggccgaaaaagtctgacactcaatctgatcactgagatggggagacttcctacgtttatgacccagaaggcccgcaacgcactggataatctcgcggttttgcatacagccgaagctggaggtagggcctacaaccacgcactgagcgagctaccggaaactctggagaccctccttctgttaacattgctggctaccgtcactggcgggatattcctctttctgatgtcgggaaaaggcatcggtaagatgacgcttgggatgtgctgcattatcaccgcctctgtgctgctctggtatgcacagattcagccccactggatcgccgcttccataattttggagttctttctgatcgtgttactaatcccagagcctgagaagcaacggacaccccaggacaatcagctgacttacgtcgttattgcgatcctcaccgtggtagccgcaacaatggctaacgaaatgggcttccttgagaaaaccaagaaagatctgggattgggcagcataactacacaggaatcagagagtaatattctggacatcgacctccgtccagcctctgcctggacgctgtatgcagtggctaccacttttgtcacacctatgcttagacattccattgaaaacagctcagtgaatgttagtctcaccgccatcgcgaaccaagctaccgtgctgatggggttgggaaagggttggcccctgagcaaaatggatataggcgtcccgttactagccatcgggtgttactcccaggtaaatccaattacactgactgcagccctccttctgttggtggctcactacgcaatcattggacctggcctgcaggccaaggcgacgagggaggctcagaagcgcgccgcagccggtatcatgaaaaaccccaccgttgacgggattacagtggtcgatctcgagccaatcccctatgaccctaagttcgaaaaacaactgggccaggtgatgcttttaatactgtgcgtcactcaggtgctcatgatgcggaccacatgggctttgtgtgaggccctgaccctagcaactggaccgatttctacgctgtgggaaggcaatcccgggcgattttggaacacaaccatcgctgttagcatggccaatatcttcagaggatcctacctcgcgggcgccggtcttctgttttcaattatgaagaacactaccaatacaaggcgcgggactggaaacataggcgagaccttgggtgagaaatggaagtctcggctgaacgcactcggcaagagtgagttccagatctataaaagatcggggattcaagaggtggatcgtacactggctaaggaaggaatcaaaaggggcgagacggaccatcacgccgtaagccgggggtccgcaaagttacgctggtttgtggaacgaaatatggtcaccccagagggaaaagttgtggatcttggctgcggtagagggggatggtcttactattgtggcggtctgaagaacgtcagggaggtgaaaggcctcactaaagggggacctggccatgaggaacccattcctatgtcaacatacgggtggaatctagtacggctgcagagcggagtggacgttttcttcaccccacccgaaaagtgcgatactttgctgtgtgacatcggcgagtccagtcctaacccaacaatagaagctggtcgcaccctcagagtgcttaatctggtcgagaactggttgaataacaatacgcagttttgcatcaaagtgctgaacccctatatgccgtctgtcattgagaagatggaaaccctccaaaggaaatacgggggagccttagtgcgaaatcctctgagccggaactcaacacacgagatgtactgggtttccaatgccactggcaacatcgtaagtagcgtgaatatgatttctcgtatgcttatcaacagattcaccatgaagcacaaaaaggcgacatatgaaccagatgtcgacctgggctccgggactcgcaacataggaattgagtcagaaatccccaatctagatatcattggtaagaggatagagaaaatcaagcaggagcatgaaaccagctggcactacgaccaggaccatccttataaaacatgggcttaccacggctcgtatgagaccaagcagactgggtctgcaagttccatggtgaacggagttgtgcggctcctgacgaaaccatgggatgtcgtgcccatggtaacacaaatggccatgaccgacactaccccgtttggccagcagagagtgttcaaggaaaaggttgatacacgcacgcaggagcctaaagagggtaccaagaaattgatgaggattactgctgaatggctgtggaaggagctcgggaaaaagaagacaccccgaatgtgtacccgggaagagtttactagaaaagtcaggagcaatgccgcacttggagccatcttcacagacgaaaacaagtggaaatcagctcgcgaggcggtggaggattcccgtttttgggaactggtggaccgggagagaaatttacacctggaaggcaagtgcgagacctgtgtctacaacatgatgggcaaaagggaaaagaaattgggggagttcggaaaggccaagggttctcgcgcaatttggtatatgtggctcggcgctcgatttctggagttcgaagccctagggtttcttaatgaggatcattggttcagccggggaaacagtctgtccggcgttgaaggtgaggggctccacagactgggatacatcttgagggacgtgagcaaaaaggaaggcggcgcaatgtacgccgatgacacagctgggtgggatactcgcataaccctggaggacctcaaaaatgaggaaatggtaacgaaccatatgaagggagagcacaagaaacttgccgaagcggtgtttaaactgacctatcaaaataaagtcgtgagagttcagcggccaacacctaggggtactgtgatggacatcatttctcgtcgagatcagcgcggctcagggcaggtcggaacctacggcttaaacacattcactaatatggaggcacaactgatcagacagatggagggtgaagggattttcaagagtatccagcatttgaccgtgacggaggaaattgccgtacaaaactggctcgctcgggttggaagggagcgcctgtccagaatggccataagcggcgacgattgcgtggtcaaacccctagacgatcggtttgcatctgctcttacagccctgaatgacatgggcaaggtgaggaaagatatccagcagtgggaaccatcgcgagggtggaacgactggacccaggtgcccttctgctcacaccactttcatgagctcgtcatgaaggatggacgtgttctggtggtaccttgtagaaaccaagacgagttgattggtcgcgctcggatcagccagggcgccgggtggtccttaaaggaaactgcatgcctgggaaaaagttatgcgcagatgtggacactcatgtacttccacaggagagatcttcgcctggccgctaatgccatctgttctgcagtgccaagccattgggtcccgacctcccggactacctggtcaattcacgctaagcacgagtggatgacaacggaagacatgctagccgtgtggaacagggtttggatacaggagaatccctggatggaagataaaacccctgtggagagttgggaggaagtcccatatctgggcaagcgagaggaccaatggtgcggttctctcatcgggttgactagcagagcaacatgggccaaaaacattcagaccgcgatcaatcaggtgcggtccctgattggaaacgaagagtacactgactatatgccctcaatgaagaggtttcgccgtgaagaggaggaagctggcgtactttggtga

SEQ ID NO: 14282 - RNA, 9876 nt, synthetic construct
  misc_feature 1..9876: note = derived and/or modified CDS sequence (opt3) from DENV-2__JX669487__SS-prME
  source 1..9876: mol_type = other RNA
accgcaggcgtgatcattatgctgataccaacggctatggctttccacctcactacgagaaacggggaacctcatatgatcgtcggaaggcaggaaaagggtaaaagccttctgtttaagaccgaggacggcgttaatatgtgcacattgatggccattgatttaggggaactgtgtgaggacactatcacctacaaatgcccacttctccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcgccatcatggcagccattttggcttacacaatcggcaccacgcactttcagcgcgcactcattttcatcctgctgactgccgttgctccatccatgacaatgagatgcatagggatttctaacagggattttgtggaaggagtctcgggtggctcatgggtggacatcgtactcgagcacgggagctgtgttaccactatggccaagaataagcccacattagatttcgaactgattaaaaccgaggcgaagcagcctgcaacgcttcggaaatattgcatcgaagccaagttgaccaacacaactaccgagagtcgctgtccaacacaaggagagccctccctgaatgaagaacaggacaaacgatttatctgcaagcattctatggtggatagaggctggggtaacgggtgtggactattcggcaagggcgggattgtcacttgcgctatgtttacctgcaaaaagaatatggaaggaaaagtggtgctccctgagaacctggaatacacaataatgatcaccccacacagcggtgaggagcatgccgtcggcaatgacactgggaagcacggaaaagaaattaagatcacgccgcagtcctcaataacagaggcagaacttaccggctatggtactgttaccatggagtgtagtcccaggacagggctggatttcaacgaaatggtgttgctccagatggaggagaaggcttggctggtacaccggcaatggtttttagacctgcctctcccatggcttcccggcgccgatacccagggaagcaattggattcagaaggaaactctggtgacattcaagaaccctcatgcgaaaaagcaggacgtcgtggttttgggctctcaagagggggccatgcacacggcactaaccggagctactgaaatccagatgtcctcaggtaatctgctctttacaggccatctgaaatgccgtcttcgcatggacaagctgcagttgaaagggatgagctacagtatgtgtaccggaaagttcaagatcgtgaaagagattgccgagacacaacacggcactatcgtcattagagtgcagtatgaaggtgatgggtctccatgcaagatacccttcgagatcatggacctcgagaagaggcatgtactgggccggttaattaccgttaacccgatcgtgacggagaaggattcccctgtcaacatcgaagctgagcccccatttggagacagctacattataatcggcgtggagcctgggcagctgaaactaaattggttcaagaagggatcgtctattggtcagatgtttgaaaccacaatgcgaggcgccaaacgcatggcaatcctcggggatactgcctgggacttcggatccctgggcggtgtctttacctcaattgggaaggcacttcaccaagtgttcggcgcgatctacggagcagcctttagtggcgttagctggacaatgaaaatattgatcggggtgattatcacttggattggaatgaactccagatctaccagcctgtcagtaagtctcgtcctggtgggcgttgtgacgctttatctgggtgctatggtccaggccgattccgggtgtgtggtaagctggaagaataaagagttgaagtgcggatctggcatcttcataacagacaacgtgcacacctggactgaacagtacaagtttcagcccgagtcaccaagtaaactcgcaagcgccattcaaaaggctcatgaagagggtatctgtggcattaggtccgttacacggctggagaatttaatgtggaaacagatcacccccgaactgaaccacatactatctgagaatgaagtcaagctcactatcatgaccggggatattaaaggaatcatgcaggccggcaagcgctcgctgagacctcagccaacagagcttaaatatagctggaagacgtgggggaaggcaaaaatgttgtccaccgaatcacataaccaaactttcctgattgacggaccggagacagcggagtgccccaataccaacagggcttggaatagtctcgaagtggaggattacggctttggtgtgttcacaactaacatctggctgaagttacgtgaaaaacaggacgtcttttgtgactctaagctgatgagcgccgcaataaaagataatcgggccgttcacgctgacatggggtattggattgagtccgcccttaacgatacctggaagatggagaaggcatcattcatcgaagtgaaaagctgccactggcctaagtctcatacgttgtggtccaatggagtgctcgagagtgaaatgatcattcccaaaaatttcgctggccccgtaagccagcacaactaccgacctggttatcatacacagaccgccggcccatggcacctggggaagctagagatggactttgatttctgtgaaggaactaccgtcgtggttacagaggactgcggcaatagagggccctctctgaggactaccacagcgtccggaaaactcatcacggagtggtgctgtcgctcatgcaccctgccgcctcttcggtacagaggcgaagatggttgttggtacgggatggagattaggccattgaaggaaaaggaggaaaacctggtgaatagtttagtcactgccggacatggccaaatagacaactttagcctcggtgtgctgggcatggctcttttcctggaggagatgttgcgcacacgagttgggaccaaacacgcaatcctcctggtggccgtatcgtttgtcactctaattacaggaaatatgtccttccgggatctgggccgtgtgatggtgatggtcggggttaccatgacggacgatatcggaatgggcgtgacttatctcgctctgcttgccgcatttaaggtaagacccaccttcgcggccggtttgctgttaaggaaactcacatctaaggaactgatgatggctaccattgggatcgcccttctgagccagtcaactatacctgagacaatcctagaactcaccgacgcactggctttgggaatgatggtgctgcgcattgtccggaacatggagaaataccagttagccgtgacaatcatggcaattagttgcgttcccaatgccgtgatcctcctgaacgcttggaaggtctcctgtactatacttgcggccgtgtctgttagcccactgttgctcacctcctcacaacagaagacggattggattcctctggcactaacaatcaaaggcctgaatcccaccgctatctttcttactaccctcagcagaacaagtaagaaaaggtcttggccactgaacgaagccgtgatggccgtcggcatggtatccattttggctagctcgctgttaaagaatgacataccgatgactgggcctctcgtggcaggaggtctgcttaccgtttgctatgtgctgacgggccgatcagccgacttggagctcgagcgcgcggctgatgtcaaatgggaagaccaggccgagatctctgggagttcccccattctgagcatcacaatttctgaagatggaagcatgtccatcaagaacgaggaggaagaacagaccctaactatactgatccggacaggccttctcgtgatttcaggtgtattcccagtgagtatccccattaccgcagccgcttggtacctgtgggaagtcaaaaagcaaagagcaggggttttgtgggacgtgcctagcccaccccctgtggagaaggccgaattagaggatggagcgtataggatcaaacagcgtggcatactgggctactctcagattggggctggagtctataaggagggtacttttcacacaatgtggcatgtgacccgcggcgccgttctcatgcaccgggggaaaagaatcgaaccgtcctgggcagacgtaaagaaagatctgatctcatacggaggcggttggaaacttgagggggaatggaaggagggagaagaggtgcaggtcctggccttggagccaggcaaaaatcccagggctgtgcaaacgaagcctggcctattcaaaactaacaccgggacaattggagccatcagtctggactttagcccaggtacctccggctctcccatagttgatcgaaaggggaaagtggtcggactctacggcaatggtgtggtaacacggtcgggggcatatgtcagcgctattgcccagactgaaaagtcaatcgaggacaaccctgaaattgaggatgacatcttccgcaagaaaagactgaccataatggatcttcatccgggagcgggcaagacgaaaaggtacttacccgccattgtgcgggaagcaatcaagcgaggcctgagaacactcatcttggctccaactcgcgttgtggccgctgagatggaggaagcactgagggggctccctattcgttatcagacccccgccatccgggccgagcacacaggaagagaaattgtcgacctgatgtgtcatgctaccttcactatgaggcttctgtccccagtgcgcgttcctaactacaatttgataatcatggacgaggcgcactttaccgatcccgcaagtattgccgctcgaggttatatctctacaagagtggagatgggcgaagccgcagggatcttcatgacggccactccaccgggaagccgggacccttttccccagtccaacgctccaattatggatgaggaaagggagatacccgaacgctcatggaactctggccacgagtgggtcaccgacttcaaaggtaagacagtgtggtttgtacctagcatcaaggcggggaacgatattgccgcatgcctacgtaaaaatggaaagaaagtgatccaactgagtagaaagaccttcgactccgagtacgttaaaactcgggctaacgattgggactttgtcgtgacaaccgatattagcgaaatgggcgccaatttcagggcagagcgcgtgatcgacccacgaagatgtatgaagcccgtcatactcacggatggcgaagaacgggtaatcttagccgggcctatgccggtgactcattcttcagctgcccagaggcgcggaagaattggtaggaacccaaagaatgaaaacgaccagtatatctacatgggcgagcccctggagaatgacgaagattgcgcgcactggaaagaggcaaagatgcttctggacaacattaatacacctgaagggatcataccctccatgtttgagccagaacgggagaaagttgatgccattgacggagagtaccgtctccgcggcgaagctcgaaagaccttcgtggatttgatgagaaggggtgacctgcctgtctggctcgcctatcgggtggctgcagaggggatcaactacgccgatcgcagatggtgttttgacggcattaaaaataaccaaatcctggaagagaacgttgaggtggaaatatggaccaaggagggagaaaggaagaaacttaaaccccggtggctagatgctcgaatctatagtgacccactggccttgaaagagttcaaggagttcgcagcgggcagaaagagcttaactctgaatctcattacagagatggggcgcctgcctacctttatgacacagaaggccagggatgctcttgacaacctggccgtcctccatactgcagaggctggaggtcgggcctacaaacacgcattgtcggaactgccggagacgctagaaaccctgctccttctgacattattggccactgtgaccggcgggatcttcctgtttctcatgtctggaaagggcattggtaagatgacactggggatgtgctgcatcataaccgcttccattcttctgtggtatgcgcagatccagccccactggatcgccgcaagcattatcctcgagttctttttgatagtactgttaattccagaacctgagaaacaacgtactccccaggataatcagctaacgtacgtggttatcgctattctgaccgtcgtggccgccacaatggcaaacgagatgggcttcctcgaaaagactaaaaaggaccttggactgggctcaatcaccacacaggagagtgaatctaatatattggacatcgatctgagaccagcttccgcctggaccctctatgcggtggctactacatttgtcacgcctatgctgaggcatagcattgagaactcaagtgttaatgtgagccttaccgccatcgcaaaccaagccactgtactcatggggctgggaaaaggttggcccttgtccaagatggacattggcgtgccgctgttagctatcgggtgttactctcaggtcaatccaattacactaaccgcagccctgctccttctggtggcgcactacgctatcataggacctggcttgcaggccaaggcaacccgcgaagcccagaaacgggctgccgcaggtattatgaagaaccccacagttgatgggatcactgtgatcgacctggagccaattccctatgatcctaaattcgagaagcaactcggccaggtcatgctgcttatattatgcgtaacacaggtgctgatgatgcgaaccacatgggctctctgtgaagccttgactctggcgaccggaccgatcagcacactatgggagggcaatcccgggagattttggaacaccactattgccgtttccatggcaaatatcttcaggggatcatacctggctggcgccggtctcctattttctattatgaaaaacacgacaaatacccgccgggggactggaaacatcggcgaaaccctgggtgagaagtggaagagtagattgaatgcactgggcaaatcggagttccagatatataagaaaagcgggatccaagaagtggaccgtacactcgctaaggagggaattaaaaggggcgaaactgatcatcacgccgtctcccgggggtctgccaagctgcgctggtttgtggagcgaaacatggtcaccccagaaggaaaagtggttgacttaggctgcggtagagggggatggtcatactattgtggcggtcttaagaacgtgagggaggtaaagggcctgacaaaagggggacctggccatgaggaacccatccctatgagcacgtacgggtggaatctcgtgcggctacagtccggagtcgatgttttcttcaccccacccgagaagtgcgacactctgttgtgtgatattggcgaaagttctcctaacccaacaatcgaggcgggtcgcaccctgagagtgctcaatcttgctgaaaactggctgaataacaatactcagttttgcataaaagtcttgaacccctatatgccgagcgtgattgagaagatggagacactgcaaaggaaatacgggggagcactcgtacgaaatcctttatcacggaactccacccacgaaatgtactgggtgagtaatgccacgggcaacatcgttagctctgtgaatatgatctcccgtatgctgattaacagattcaccatgaagcacaagaaagctacatatgagccagacgtcgatcttggctcagggactcgcaatataggaatcgaaagcgagattcccaacctggacatcattggtaagaggatcgagaaaataaagcaggagcatgagacctcgtggcactacgaccaggatcatccttataaaacatgggcctaccacggctcttatgaaactaagcagaccgggagtgcatccagcatggtgaacggagtcgtgcggctactcacaaagccatgggacgttgtacccatggtgacccaaatggccatgactgatacgacaccgtttggccagcagagagtcttcaaagagaaggtggacacccgcactcaggaacctaaagagggtaccaagaaactgatgaggatcacagctgagtggttgtggaaggaactggggaagaaaaagacgccccgaatgtgtacccgggaggaatttactagaaaagttaggtcaaatgcggccctcggagcaattttcacagatgagaacaagtggaaatccgctcgcgaagccgtggaggactctcgtttttgggagcttgtcgatcgggaaagaaatctgcacttagagggcaagtgcgaaacctgtgtgtacaacatgatgggcaaaagggagaagaagctgggggagttcggaaaagcaaagggtagccgcgccatctggtatatgtggttgggcgctcgatttctcgagttcgaggccctggggtttctaaatgaagaccattggttcagtcggggaaactcccttagcggcgtagagggtgaagggctgcacagactcggatacattctgagggatgtgtctaaaaaggagggcggcgcgatgtacgcagacgatactgccgggtgggacacacgcatcaccttggaagacctgaaaaatgaggagatggttacaaaccatatgaagggagaacacaagaaactcgctgaggccatttttaaacttacttatcaaaataaagtcgtgagagtgcagcggccaacccctaggggtacggtcatggatataatctcacgtaaggaccagcgaggcagtgggcaggttggaacctacggcctgaacacattcactaatatggaagcacaattaattcgccagatggagggtgaggggatcttcaaatccatccagcatctgaccgtgacagaagagattgctgtacaaaactggttggccagagtgggacgggaaaggctcagccgcatggctatatctggcgatgactgcgtcgtgaagcccctggatgacagatttgcctcggcactaactgcgcttaatgatatgggcaaggttcggaaagacatccagcagtgggagccatcaagggggtggaacgattggacccaggtgcccttctgcagccaccactttcatgaactggtcatgaaggacggacgagtgctcgtagttccttgtcgtaatcaagatgagctgattggtagagcccgcatctcccagggcgctgggtggagtttgaaagagacggcctgcttaggaaagtcttatgcacagatgtggacactgatgtacttccaccggagggacctcagacttgctgccaacgcaatttgtagcgccgtgccatcccattgggtcccgacctcacgcactacatggagtatccacgcgaaacacgaatggatgaccactgaggatatgctggctgtgtggaaccgggtgtggatacaggaaaatccctggatggaggacaagacccctgtcgaatcttgggaggaggttccatatctaggcaagagggaagaccaatggtgcggtagcctgatcgggctcacatcccgagccacgtgggccaaaaacattcagaccgccatcaatcaggtgagatcattgattggaaacgaggaatacactgattatatgcccagcatgaagcggtttaggcgcgaggaagaggaggctggcgtactgtggtga

SEQ ID NO: 14283 - RNA, 9876 nt, synthetic construct
  misc_feature 1..9876: note = derived and/or modified CDS sequence (opt3) from DENV-2__JX669488__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcgccatcatggcagccattttggcttacacaatcggcaccacgcactttcagcgcgcactcattttcatcctgctgactgccgttgctccatccatgacaatgagatgcatagggatttctaacagggattttgtggaaggagtctcgggtggctcatgggtggacatcgtactcgagcacgggagctgtgttaccactatggccaagaataagcccacattagatttcgaactgattaaaaccgaggcgaagcagcctgcaacgcttcggaaatattgcatcgaagccaagttgaccaacacaactaccgagagtcgctgtccaacacaaggagagccctccctgaatgaagagcaggacaaacgatttatctgcaagcattctatggtggatagaggctggggtaacgggtgtggactattcggcaagggcgggattgtcacttgcgctatgtttacctgcaaaaagaatatggaaggaaaagtggtgctccctgagaacctggaatacacaatagtcatcaccccacacagcggtgaggagcatgccgttggcaatgacactgggaagcacggaaaagaaattaagatcacgccgcagtcctcaataacagaggcagaacttaccggctatggtactgtgaccatggagtgtagtcccaggacagggctggatttcaacgaaatggtattgctccagatggaggagaaagcttggctggtgcaccggcaatggtttttagacctgcctctcccatggcttcccggcgccgatacccagggaagcaattggattcagaaggaaactctggtcacattcaagaaccctcatgcgaaaaagcaggacgtggttgtgttgggctctcaagagggggccatgcacacggcactaaccggagctactgaaatccagatgtcctcaggtaatctgctctttacaggccatctgaaatgccgtcttcgcatggacaagctgcagttgaaagggatgagctacagtatgtgtaccggaaagttcaagatcgtcaaagagattgccgagacacaacacggcactatcgtgattagagtacagtatgaaggtgatgggtctccatgcaagatacccttcgagatcatggacctcgaaaaaaggcatgttctgggccggttaattaccgtgaacccgatcgtcacggagaaggattcccctgtgaacatcgaagctgagcccccatttggagacagctacattataatcggcgtcgagcctgggcagctgaaactaaattggttcaagaagggatcgtctattggtcagatgtttgaaaccacaatgcgaggcgccaaacgcatggcaatcctcggggatactgcctgggacttcggatccctgggcggtgtgtttacctcaattgggaaggctcttcaccaagttttcggcgcgatctacggagcagcctttagtggcgtgagctggacaatgaaaatattgatcggggtaattatcacttggattggaatgaactccagatctaccagcctgtcagtcagtctcgtgctggttggcgtggtcacgctttatctgggtgctatggtgcaggccgattccgggtgtgtagtgagctggaagaataaagagttgaagtgcggatctggcatcttcataacagacaacgttcacacctggactgaacagtacaagtttcagcccgagtcaccaagtaaactcgcaagcgccattcaaaaggctcatgaagagggtatctgtggcattaggtccgtcacacggctggagaatttaatgtggaaacagatcacccccgaactgaaccacatactatctgagaatgaagtgaagctcactatcatgaccggggatattaaaggaatcatgcaggccggcaagcgctcgctgagacctcagccaacagagcttaaatatagctggaagacgtgggggaaggcaaaaatgttgtccaccgaatcacataaccaaactttcctgattgacggaccggagacagcggagtgccccaataccaacagggcttggaatagtctcgaagtggaggattacggctttggtgtcttcacaactaacatctggctgaagttacgtgaaaaacaggacgttttttgtgactctaagctgatgagcgccgcaataaaagataatcgggccgtgcacgctgacatggggtattggattgagtccgcccttaacgatacctggaagatggagaaggcatcattcatcgaagtgaaaagctgccactggcctaagtctcatacgttgtggtccaatggagtactcgagagtgaaatgatcattccaaaaaacttcgctggccccgtcagccagcacaactaccgacctggttatcatacacagaccgccggcccatggcacctggggaagctagagatggactttgatttctgtgaaggaactaccgtggttgtgacagaggactgcggcaatagagggccctctctgaggactaccacagcgtccggaaaactcatcacggagtggtgctgtcgctcatgcaccctgccgcctcttcggtacagaggcgaagatggttgttggtacgggatggagattaggccattgaaggaaaaggaggaaaacctggtcaatagtttagtgactgccggacatggccaaatagacaactttagcctcggtgttctgggcatggctcttttcctggaggagatgttgcgcacacgagtggggaccaaacacgcaatcctcctggtagccgcttcgtttgtcactctaattacaggaaatatgtccttccgggatctgggccgtgtgatggtgatggtcggggccaccatgacggacgatatcggaatgggcgttacttatctcgcactgcttgcggcctttaaggtgagacccaccttcgctgccggtttgctgttaaggaaactcacatctaaggaactgatgatggcaaccattgggatcgctcttctgagccagtcaactatacctgagacaatcctagaactcaccgacgccctggcattgggaatgatggtactgcgcattgtgcggaacatggagaaataccagttagccgtcacaatcatggctattagttgcgtgcccaatgcggttatcctcctgaacgcctggaaggtgtcctgtactatacttgcagctgtctctgtgagcccactgttgctcacctcctcacaacagaagacggattggattcctctggccctaacaatcaaaggcctgaatcccaccgccatctttcttactaccctcagcagaacaagtaagaaaaggtcttggccactgaacgaagctgttatggcagtgggcatggtctccattttggccagctcgctgttaaagaatgacataccgatgactgggcctctcgtagcgggaggtctgcttaccgtgtgctatgttctgacgggccgatcagctgacttggagctcgagcgcgccgcagatgtgaaatgggaagaccaggccgagatctctgggagttcccccattctgagcatcacaatttctgaagatggaagcatgtccatcaagaacgaggaggaagagcagaccctaactatactgatccggacaggccttctcgtcatttcaggtgtgttcccagtaagtatccccattaccgctgcagcctggtacctgtgggaagtgaaaaagcaaagagcgggggtcttgtgggacgttcctagcccaccccctgtggagaaggctgaattagaggatggagcctataggatcaaacagcgtggcatactgggctactctcagattggggcaggagtgtataaggagggtacttttcacacaatgtggcatgtcacccgcggcgccgtgctcatgcaccgggggaaaagaatcgaaccgtcctgggctgacgttaagaaagatctgatctcatacggaggcggttggaagcttgagggggaatggaaggagggagaagaggtacaggtgctggccttggagccaggcaaaaatcccagggcagtccaaacgaagcctggcctattcaaaactaacaccgggacaattggagctatcagtctggactttagcccaggtacctccggctctcccatagtggatcgaaaggggaaagttgtgggactctacggcaatggtgtcgtgacacggtcgggggcctatgtaagcgcgattgcccagactgaaaagtcaatcgaggacaaccctgaaattgaggatgacatcttccgcaagaaaagactgaccataatggatcttcatccgggagcaggcaagacgaaaaggtacttacccgctattgtccgggaagccatcaagcgaggcctgagaacactcatcttggctccaactcgcgtggttgcagccgagatggaggaagccctgagggggctccctattcgttatcagacccccgctatccgggcggagcacacaggaagagaaattgtggacctgatgtgtcatgcaaccttcactatgaggcttctgtccccagtccgcgtgcctaactacaatttgataatcatggacgaggcccactttaccgatcccgctagtattgccgcacgaggttatatctctacaagagttgagatgggcgaagccgctgggatcttcatgacggcgactccaccgggaagccgggacccttttccccagtccaacgccccaattatggatgaggaaagggagatacccgaacgctcatggaattctggccacgagtgggtgaccgacttcaaaggtaagacagtctggtttgtgcctagcatcaaggcagggaacgatattgctgcctgcctacgtaaaaatggaaagaaagtaatccaactgagtagaaagaccttcgactccgagtacgtgaaaactcgggcaaacgattgggactttgttgtcacaaccgatattagcgaaatgggcgccaatttcagggctgagcgcgtgatcgacccacgaagatgtatgaagcccgtgatactcacggatggcgaagagcgggtcatcttagccgggcctatgccggtaactcattcttcagcggcacagaggcgcggaagaattggtaggaacccaaagaatgaaaacgaccagtatatctacatgggcgagcccctggagaatgacgaagattgcgcccactggaaagaggctaagatgcttctggacaacattaatacacctgaagggatcataccctccatgtttgagccagaacgggagaaagtggatgccattgacggagagtaccgtctccgcggcgaagctcgaaagaccttcgttgatttgatgagaaggggtgacctgcctgtgtggctcgcatataaagtcgccgctgaggggatcaactacgccgatcggcgctggtgttttgacggcattaagaataaccaaatcctggaagagaacgtggaggttgaaatatggaccaaagagggagaaagaaagaagcttaaacccaggtggctagatgcacggatctatagtgacccactggcgttgaaggagttcaaagaattcgccgctggccgaaagagcttaactctgaatctcattacagagatggggagactgcctacctttatgacacagaaagcccgcgatgcacttgacaacctggctgtgctccatactgccgaggcaggaggtagggcctacaagcacgctttgtcggaactgccggagacgctagaaaccctgctccttctgacattattggcgactgtcaccggcgggatcttcctgtttctcatgtctggaaagggcattggtaaaatgacactggggatgtgctgcatcataaccgcctccattcttctgtggtatgcacagatccagccccactggatcgctgccagcattatcctcgagttctttttgatagtgctgttaattccagaacctgagaagcaacggactccccaggataatcagctaacgtacgtagtgatcgccattctgaccgttgtcgcagctacaatggccaacgagatgggcttcctcgaaaaaactaagaaagaccttggactgggctcaatcaccacacaggagagtgaatctaatatattggacatcgatctgcgtccagcgtccgcttggaccctctatgccgtggcaactacatttgtgacgcctatgctgagacatagcattgagaactcaagtgtcaatgttagccttaccgccatcgctaaccaagcaactgtgctcatggggctgggaaagggttggcccttgtccaagatggacattggcgtaccgctgttagccatcgggtgttactctcaggtgaatccaattacactaaccgcggctctgctccttctggtcgcccactacgcaatcataggacctggcttgcaggccaaagctaccagggaagcccagaagcgcgcagctgccggtattatgaaaaaccccacagtggatgggatcactgttatcgacctggagccaattccctatgatcctaagttcgagaaacaactcggccaggtgatgctgcttatattatgcgtcacgcaggtactgatgatgcggaccacatgggcgctctgtgaagccttgactctggcaaccggaccgatcagcacactatgggagggcaatcccgggcgattttggaacaccactattgctgtgtccatggccaatatcttcagaggatcatacctggcaggcgctggtctccttttttctattatgaagaacacggccaatacaaggcgcgggaccggaaacatcggcgaaactctgggtgagaagtggaaaagtcggttgaatgccctgggcaagtcggagttccagatatataaaaagagcgggatccaagaagttgacagaaccctcgcgaaagagggaattaagcgtggcgaaacagatcatcacgctgtgtccagggggtctgcaaaactgcggtggtttgtcgagcgcaacatggtgactccagaaggaaaggtcgtggacttaggctgcggtcgagggggatggtcatactattgtggcggtcttaagaacgttagagaggtgaaaggcctgaccaaggggggacctggccatgaggaacccatccctatgagcacatacgggtggaatctcgtaaggctacagtccggagtggatgtcttcttcacgccacccgagaaatgcgacaccctgttgtgtgatattggcgaaagttctcctaacccaactatcgaggccggtcggacactgcgcgttctcaatcttgctgaaaactggctgaataacaatacccagttttgcataaaggtgttgaacccctatatgccgagcgtcattgagaaaatggagactctgcaaagaaagtacgggggagccctcgtgaggaatcctttatcacgaaactccacacacgaaatgtactgggtaagtaatgcaaccggcaacatcgtgagctctgttaatatgatctcccggatgctgattaaccgtttcacgatgaagcacaaaaaggccacctatgagccagacgtggatcttggctcagggacaagaaatataggaatcgaaagcgagattcccaacctggacatcattggtaaacgcatcgaaaagataaaacaggagcatgagacttcgtggcactacgaccaggatcatccttataagacctgggcttaccacggctcttatgaaacaaagcagactgggagtgcgtccagcatggtcaacggagtggtcaggctactcaccaaaccatgggacgtggttcccatggtaacacaaatggccatgaccgatactacgccgtttggccagcagcgggtgttcaaggagaaagtcgacacaagaacccaggaacctaaggagggtactaaaaagctgatgcgcatcaccgcagagtggttgtggaaggaactggggaaaaagaaaacacccaggatgtgtacgcgagaggaatttacccggaaggtgagatcaaatgctgccctcggagcaattttcactgatgagaacaaatggaagtccgccagggaagctgttgaggactctcgcttttgggagcttgtggatcgtgaacggaatctgcacttagagggcaaatgcgaaacatgtgtctacaacatgatgggcaagagagagaagaaactgggggaattcggaaaggccaaaggtagcagggcgatctggtatatgtggttgggcgcacgctttctcgagttcgaggccctggggtttctaaatgaagaccattggttcagtcgaggaaactcccttagcggcgtggagggtgaagggctgcaccggctcggatacattctgagagatgtatctaagaaagagggcggcgctatgtacgccgacgataccgcagggtgggacactaggatcacattggaagacctgaagaatgaggagatggtgaccaaccatatggaaggagagcacaagaaactcgctgaagccatttttaagcttacatatcaaaataaagttgtccgcgtgcagagaccaactcctcggggtaccgtgatggatataatctcaaggaaggaccagcgtggcagtgggcaggtcggaacgtacggcctgaacaccttcacaaatatggaggctcaattaattcgacagatggagggtgaagggatcttcaaatccatccagcatctgactgttaccgaggaaattgccgtgcaaaactggttggcacgcgtaggaagagagcggctcagcaggatggcgatatctggcgatgactgcgtggtcaagcccctggatgaccgctttgcctcggctctaacagcccttaatgatatgggcaaggtgagaaaagacatccagcagtgggaaccatcacgggggtggaacgattggactcaggttcccttctgcagccaccactttcatgagctggtgatgaaggacggaagggtcctcgtggtaccttgtcgaaatcaagatgagctgattggtcgtgcaagaatctcccagggcgctgggtggagtttgaaagaaaccgcctgcttaggaaagtcttatgcacagatgtggacgctgatgtacttccaccgccgggacctcaggcttgccgcgaacgctatttgtagcgccgttccatcccattgggtgccgacatcaagaaccacttggagtatccacgcaaaacacgagtggatgacaaccgaagatatgctggccgtctggaaccgcgtgtggatacaggagaatccctggatggaagacaagactcctgtggagtcttgggaggaagtcccatatctaggcaagcgggaggaccaatggtgcggtagcctgatcgggctcacctccagggctacatgggccaaaaacattcagacggcaatcaatcaggttcgatcattgattggaaacgaagagtacaccgattatatgcccagcatgaagagatttcggagggaagaggaggaagctggcgtgctgtggtga

SEQ ID NO: 14284 - RNA, 9876 nt, synthetic construct
  misc_feature 1..9876: note = derived and/or modified CDS sequence (opt3) from DENV-2__JX669479__SS-prME
  source 1..9876: mol_type = other RNA
accgccggagtgatcgtaatgctgattcccacagctatggcattccacctcactacgagaaatggggaacctcatatgatagttggaaggcaggaaaagggtaaatcccttctgtttaagaccgaagacggcgtgaatatgtgcacattgatggccatcgatttaggggaactgtgtgaggacactattacctacaaatgcccactcctccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagagcgagaacctcgaatacaccatagtcatcactcctcactccggtgaggagcatgctgttggcaatgacacggggaagcacggaaaagaaattaagatcacaccacagtcaagtaccactgaggccgaactgaccggctatggtacagtgaccatggagtgtagcccgaggactgggcttgatttcaacgaaatggtactgttgcaaatggaggacaaagcatggctcgtgcaccggcagtggtttctggatttacccctgccttggctcccaggcgctgacacacagggatctaattggatacagaaggagacgcttgtcaccttcaagaacccccatgccaaaaagcaagacgtggttgtgctgggctcccaggaaggggcgatgcacactgccttgacaggagcaaccgagattcagatgtcaagcggtaatctactgtttacaggccatctcaaatgccgtctgcgcatggataaacttcaactgaaagggatgagttactctatgtgtactggaaagttcaagatcgtcaaagaaatcgctgagacccagcacggcacgattgtgatcagagtacagtatgagggtgacgggtccccttgcaagattccattcgaaataaccgatttggagaaaaggcatgttctcggccggctgatcacagtgaaccccattgtcactgaaaaggacagcccggtgaacatcgaggccgaacctccctttggagattcgtacatcattgtcggcgtggagccagggcagttaaaactgaattggttcaagaagggatcttccataggtcaaatgtttgagaccacaatgcgaggcgctaaacgcatggccatcctaggggacactgcatgggatttcggatcactcggcggtgtttttaccagtattgggaaggccctgcaccaggtgttcggcgctatctacggagcggcatttagcggcgtatcctggacgatgaaaattcttatcggggtcataatcacatggattggaatgaactctagaagcacctcattgagtgtgtccctggttctcgtgggcgtcgtgactctgtatcttggtgccatggtacaggctgacagcgggtgtatcgtgtcttggaagaataaagaactgaagtgcggatcaggcattttcatcacagataacgttcacacctggactgagcagtacaagtttcaacctgaaagtcccagcaaattggcctccgcaatacagaaggcccatgaggaaggtatttgtggcatcaggtctgtcacccggctcgagaatctgatgtggaaacagattacaccagagttaaaccacatcctgtcggaaaatgaggtgaagctaacgataatgaccggggacatcaaaggaattatgcaggctggcaagcgcagcctcagaccccaacctactgaactgaaatattcctggaagacatgggggaaggccaaaatgctttcaaccgagagtcataaccagacattcttgatcgatggaccagaaactgcagagtgcccgaataccaacagggcgtggaactctctggaggtggaagactacggctttggtgtcttcacgacaaacatttggctcaagctgcgtgagaaacaggacgtattttgtgatagcaagttaatgtccgctgccatcaaagacaatcgggcagtgcacgccgatatggggtattggatagaatcagctctgaacgacacctggaagatggagaaggccagcttcattgaggtgaaatcttgccactggcccaagtcccatactctttggagtaatggagtattggaaagcgagatgatcatccctaaaaacttcgcaggcccagtctctcagcacaactaccgacccggttatcatacccaaacagctggcccttggcacctcgggaagctggaaatggattttgacttctgtgagggaactaccgtggttgtgacagaagattgcggcaatagagggccatccctaaggacgaccactgcctcaggaaaactgattacagagtggtgctgtcgcagttgcaccctacccccgctgcggtacagaggcgaggacggttgttggtacgggatggaaatcaggcctcttaaggagaaggaagagaacttggtcaatagcctggtgactgcgggacatggccagattgataacttttcgttaggtgttctcggcatggccctgttccttgaagagatgctgcgcacacgagtggggaccaaacacgctatattgctcgtagcactgtcctttgtcacgctaatcactggaaatatgtctttccgggacctgggccgtgtgatggtgatggtcggggccaccatgacagatgacattggaatgggcgttacctatctcgctctgcttgccgcatttaaggtgagaccaactttcgcggccggtttgctgttaaggaaactcacaagcaaggagctgatgatggctaccatcgggattgcccttctgtcacagagtacactacccgaaactatcctcgagctgaccgatgcattggctctgggaatgatggccttaaaaatagtacgcaacatggaaaagtaccaactcgcagtgacgatcatggccatttcctgcgtccctaatgctgtgatcctgcagaacgcgtggaaggtttcttgtacaattcttgccgcagtgagcgtcagccccctgttgctcacctcaagccagcagaaagctgactggatcccactggccctaactataaagggcctgaatcctaccgccatttttcttacaactctcagtcggacctctaaaaagagatcctggcccctgaacgaggctatcatggcagtgggcatggttagcatcttggcctcgtcactgctaaagaatgacattccaatgacggggccgctcgtggcgggaggtctgcttacagtctgctatgtactgaccggcaggtctgctgatttggaactcgagcgagccgcagacgtgaagtgggaggatcaagccgaaataagtgggtccagccctatcctgtctattactatcagcgaggacggatccatgtcaattaaaaacgaagaggaggaacagacactaaccatcctgatacgcactggccttctcgttatcagtggtgtgttccccgtcagcattccaatcacagctgcagcctggtacctgtgggaggtgaagaagcagcgggcgggggtattgtgggatgtgccctctcctccacccgtcgaaaaagctgagttagaagacggagcctatagaattaagcagaggggcatcctgggctactcccaaataggggcaggagtttataaagagggtacctttcacacgatgtggcatgtgactcgtggcgccgtgctcatgcaccgcgggaagcggattgagccttcatgggctgatgtcaaaaaggacctgatcagttacggaggcggttggaaacttgaaggggagtggaaagaaggagaggaagtgcaggttctggccttggagccgggcaagaatccaagagcagtacagaccaaacccggcatcttcaagacaaacaccgggacaattggagctgtgagcctagatttttcccctggtacttctggctcgccaatcgtcgacaggaaagggaaggtggttggactgtacggcaatggtgtggtcacccgaagcggggcctatgtgtcagcgatagcccagacggagaagtccattgaagataaccccgagatcgaagacgatattttccggaaaaagcgcctcacaatcatggacctgcatcctggagcaggcaaaactaagagataccttccggctatagtaagggaggccattaaacggggcttacgaaccctgatcctcgctcccacaagagtcgtggcagccgaaatggaggaggccttgcgcgggctgccaatcaggtatcaaacccctgctattcgtgcggaacacactggacgggagatcgttgacctcatgtgtcatgcaaccttcacaatgagactgcttagtcccgtgagggtcccaaactacaatctgattataatggatgaagcccactttacggaccctgcttctatcgccgcacgcggttatattagcactcgagtggagatgggcgaggccgctgggatcttcatgaccgcgacacccccaggatccagagatccgtttcctcagtcaaacgcccccatcatggacgaagaacgggaaattccagagaggtcttggaatagcggccacgaatgggttaccgatttcaagggtaagactgtgtggtttgtccccagtataaaagcagggaacgacatcgctgcctgcttgcgcaagaatggcaagaaggtgattcagctatcccgtaaaacattcgatagcgagtacgtaaagaccagagcaaacgactgggattttgtggttacgactgacatctctgagatgggcgccaatttcaaggctgaacgggtcattgatcctaggcgctgtatgaaaccagtgatcctgacagacggcgaggaacgagtgatactcgccgggcccatgcctgtcacccattcatccgcggcacaaagacggggaaggatcggtcgcaacccgaagaatgagaacgaccagtatatttacatgggcgaaccattagagaatgatgaggactgcgcccactggaaagaagctaagatgctgcttgataacatcaatacccccgaggggattatccctagtatgtttgaacccgagagagaaaaagtagacgccatagatggagagtacaggctgcggggcgaggctcgtaagactttcgtggacctcatgcgccgaggtgatttgccagtttggctggcatataaagtggccgctgaagggattaactacgccgacagaaagtggtgttttgatggcatcaagaataaccagattctcgaggaaaacgtcgaggtggagatctggacaaaagaaggagagaggaagaaactgaagcctcggtggcttgacgcacgcatatatagcgatcccctagcgctgaaagagttcaaggagttcgccgctggcagaaagtcgttgaccttaaatctgatcacagaaatggggaggctcccaacttttatgacgcagaaagcccggaacgcactggacaatcttgctgttctgcataccgccgaggtgggaggtcgagcatacacacacgccctctctgagttgcctgaaactctggagaccctactgctccttacactgttagctgcggtcaccggcgggattttcttgtttctgatgtccggaaagggcatcggtaaaatgactctcgggatgtgctgcattatcacggccagcatactgctttggtatgcacaaattcagccgcactggatcgctgcctcaatcattctggagttctttctcatcgtgttgctgatacccgagccagaaaagcagagaacccctcaggataaccaattaacatacgtagtgattgccatcctaactgttgtcgcagctaccatggccaatgagatgggcttcctggagaaaacaaagaaggacctcggatttggcagtattaccactcaggaatctgagtccaacatccttgacatagatctgcgccccgcgagcgcttggacattgtatgccgtggcaacgaccttcgtgactccaatgctgaggcattcaatcgaaaatagtagcgtcaacgtttccctcacagccattgctaatcaggcaaccgtgctgatggggcttggaaaaggttggcctctctctaagatggacatcggcgtacccctgttggccattgggtgttacagccaggtgaacccgatcaccctgacagcggctttactactgctcgtcgcccactacgcaattatcggaccaggccttcaagccaaagctactcgggaggcccagaagcgtgcagctgccggtataatgaaaaatcctacggtggatgggattaccgttatcgacctggaacccatcccatatgatcccaagtttgagaagcagttgggccaggtgatgctgctcattctgtgcgtcacacaagtacttatgatgagaactacctgggcgttatgtgaggccctgacactcgcaaccggacctatatccactttgtgggaaggcaacccggggaggttctggaatacgacaatcgctgtgtcaatggccaacatttttcgcggatcttacctggcaggcgctggtctactgttcagtatcatgaaaaataccactaacacccggcgagggacaggaaatgttggcgagactctcggtgaaaagtggaaatcgagacttaaggccctgggcaaaagcgagtttcagatttataagaaatccgggatccaggaggtggacaggaccttggccaaggaaggaataaagcgcggcgagacagatcatcacgcggtctctcgggggtcagctaaactgagatggttcgtggaacgtaacatggtcacgcccgagggaaaggtggttgacctcggctgcggtaggggagggtggagctactattgtggcggtctgaaaaacgtgcgggaagtaaagggcttaaccaaagggggaccaggccatgaggagcctatccccatgtccacttacgggtggaatcttgtgcgcctgcaaagtggagtcgatgttttctttacacctccagaaaagtgcgacaccctcctatgtgatattggcgagtctagccccaaccctactatcgaagcaggtcgaacactgagagtgttgaatctggtcgagaactggctcaataacaatacccagttctgcattaaggtgcttaacccatatatgccctcagtaatcgagaaaatggagacgctgcagaggaagtacgggggagccttggtgcggaatccgctgtcccgcaacagtacccacgagatgtactgggttagcaatgctacaggcaacatagtgtcttccgtcaatatgatttcaagaatgctcatcaacaggtttactatgaaacacaagaaagccacctatgaacctgacgtggatttaggcagcgggacacgaaatatcggaattgagtcggaaataccaaacctggacatcattggtaagcggatcgagaagattaaacaggaacatgagacttcttggcactacgaccaagatcatccctataagacctgggcataccacggcagttatgagacaaaacagaccgggtccgccagctcaatggtcaacggagtggttcgtcttctgactaagccttgggacgtagtgccaatggtcacgcagatggctatgacagataccactcccttcggccagcaaagagtgtttaaagaaaaggttgacacccgcacacaggagccgaaggaaggtacgaaaaagctaatgaaaatcaccgcggagtggctctggaaggagctggggaaagaaaagactcctaggatgtgtacacgggaggagttcaccagaaaagtgcgctccaatgccgcattgggagctgtctttactgatgagaacaagtggaagtctgccagggaagcagtggaggacggccgattctgggagctggtagatcgggaaagaaatctccaccttgagggcaaatgcgaaacatgtgtgtacaacatgatggggaagagggagaaaaagctgggagaatttggtaaagccaagggcagccgcgctatatggtatatgtggttaggggcccgtttcctggagtttgaggcgttgggattcctcaatgaagaccattggtttagtcggggcaactccctgagcggtgttgagggggaaggactacacagacttggctacatcctgagggaggtcggcaagaaagaagggggagcaatgtacgccgatgacaccgctggttgggatacacgcattactctcgaggacctgaagaatgaggaaatggtgaccaaccatatgaaaggcgagcacaagaaattggccgaagcaatcttcaagctgacgtatcagaataaggtggtccgagttcagcggcccaccccaagagggacagtgatggacattatctctaggaaagatcaacgcggatcaggccaggtaggtacttacgggctcaacaccttcacaaatatggaggctcagcttattagacaaatggagggagaaggcatatttaagagtatccagcatctgactgccaccgaggaaattgctgtgcagaactggttagcccgggtcggcagggagcgtctgtcccgaatggcaatcagcggggacgattgcgtggttaaacctatcgacgatcgcttcgcgtctgccttgacggctctcaatgacatgggaaaggtgagaaaagatattcagcaatgggaaccctcgcggggttggaacgactggacacaggtcccattttgctcacaccacttccatgagctggtgatgaaggatggcagggtcttagttgtgccctgtcgcaatcaggacgagcttatagggagagcccggatcagccagggagcaggctggtccctgaaggaaaccgcttgcctcggtaaaagttatgcccaaatgtggactctgatgtactttcacaggcgagatttgcgtttagcagccaacgcgatttgttctgctgtccctagccattgggtgccaacatccagaaccacttggtcaatccacgccaagcacgagtggatgaccacagaagacatgctggcagtgtggaaccgcgtctggattcaggagaatccgtggatggaagataaaacgcccgttgagagttgggaggaagtgccttatctcgggaagcgggaggaccagtggtgcggatctcttatcggcctgaccagcagggccacttgggctaaaaacatacagacagccatcaatcaagtaagatccctaattggcaacgaagggtacaccgactatatgccatcaatgaagcgcttccggagggaggaagaggaggcaggagtgctgtggtga

SEQ ID NO: 14285 - RNA, 9876 nt, synthetic construct
  misc_feature 1..9876: note = derived and/or modified CDS sequence (opt3) from DENV-2__KF744403__SS-prME
  source 1..9876: mol_type = other RNA
accgccggcatgatcattatgctgatacccaccgtgatggctttccacctcactacgagaaacggggagcctcatatgatcgtcagcagacaggaaaaggggaaatcccttctgtttaagaccgaggacggtgttaatatgtgcacattgatggcaatggatttaggcgaactgtgtgaggacactattacctacaaatgcccattactccggcaaaacgaaccggaggatatcgactgttggtgcaattctacatcaacctgggtgacttatgggacatgtaccacgactggagagcaccgccgagaaaagcgtagtgtagccctggtgccccatgtcggcatgggtcttgagaccagaacagaaacttggatgagctccgagggggcgtggaaacacgctcagaggattgagacctggatcctgcggcatcctggattcacattgatggccgcaatactcgcctacaccatcggcacgactaactttcagcgcgctctgattttcatcctgctcacagcagtggccccatctatgaccatgagatgcattggcatctcgaatagggattttgttgaaggggtgtcaggaggtagctgggtcgacatagtgttagagcacggcagttgtgtaactacaatggctaagaacaagcccaccctggatttcgaacttattaaaacggaggccaagcagcctgcgaccttgcggaaatattgcatcgaagcaaagctgacaaatactaccacagagtcccgctgtccaactcaaggggagccctctctaaacgaagaacaggacaaacgatttgtttgcaagcacagcatggtggatagaggatggggcaatggttgtggactcttcggaaagggcggcattgtcacatgcgccatgtttacatgcaaaaagaacatggaagggaaaatcgtgcagcctgagaatctggaatacaccatcgtgattactccacattccggagaggagcacgctgtcggtaacgacacgggcaagcatgggaaagaaataaagatcacaccgcagtcaagtattaccgaggccgaacttactggatatggcaccgttacaatggagtgtagccccaggaccggtctggatttcaatgaaatggtgttgctccaaatggagaacaaagcatggctggtacaccggcagtggtttttagacctgcctctcccatggcttcccggggctgatactcagggctctaattggatccagaaggagacactggtgacgttcaagaaccctcacgccaaaaagcaagacgtcgtggttttgggatcccaggaaggcgcgatgcataccgccctaactggggcaacagagatacagatgtcaagcggaaacctgctctttaccggtcacctgaaatgccgtcttcgcatggacaagctgcaattgaaaggcatgagttactctatgtgtacagggaagttcaaggtggtcaaagaaattgctgagactcagcatggaaccatcgtggtaagagttcagtatgagggcgatggttccccatgcaagatccccttcgaaattatggacctcgagaaaaggcacgtgctggggcggttaatcacggtcaatccgattgtgaccgaaaaggatagccctgtcaacatagaggccgaacccccatttggcgactcgtacgtgatcattggagttgagcctggccagctgaaactaaattggttcaagaaggggtcttccatcggacaaatgtttgagacaactatgcgaggtgctaaacgcatggccatcctcggcgataccgcatgggacttcgggtcactgggaggcgtgtttacaagtattggtaaggcccttcatcaggtattcggggctatatacggcgcggcatttagcggagtctcctggactatgaaaatcttgattggcgtgatcattacctggatcgggatgaactctagaagcacgtcactgagtgtttccctcgtgctggtcggagtggtaacactttatctgggcgtggttgtccaggccgatagcggttgtgtggtgtcttggaggaataaggaattgaaatgcgggtcaggaatattcatcaccgacaacgtccacacttggacagagcagtacaagtttcaacccgaaagtccaagcaagctcgcttccgccattcagaaagcacaccaggagggcatctgtggtattcggtctgttacccgcctggaaaatttaatgtggaagcagatcactcccgagctgaaccatatactatcggagaatgaagtgaaactcaccattatgacaggcgatatcaaggggattatgcacgccggaaaaagaagcctgaggcctcaaccaacggagcttcgttattcctggaagacctggggcaaagctaagatcttgtcaactgaaagtcataaccagacattcctgatagacgggccggagaccgccgaatgccccaatacaaaccgggcatggaactctctcgaggtggaggattacggatttggcgtattcactaccaacatctggctgcgattaagagaaaagcaggacgcgttttgtgacagcaaactgatgtccgctgccattaaggataatagggcagtccacgccgacatgggttattggatcgagtcagctcttaacgatacgtggaaaattgaaaaggccagcttcatcgaggtgaaatcttgccactggcctaagtcccatacattgtggagtaacggggttctcgagagcgaaatgataattccaaagaatttcgcaggacccgtgtctcagcacaactaccgccctggctatcatacccaaactgctggtccatggcacctgggcaaactagagatggactttgatttctgtaaggggaccacagtcgtggttactgaagactgcggaaatcggggcccctccctgagaaccacaacggcctcagggaaactcatcaccgagtggtgctgtaggagttgcactctgccgcctcttcgctaccgaggagaagatggctgttggtacggtatggagatccggccattgaaggagaaagaagagaacctggtgagctcgttagtaacagcggggcatggacagattgacaatttttccctcggcgtcctgggtatggcccttttcctggaagagatgttgcgtaccagagtgggcactaagcacgctatcctcctggtggcagtctcttttgttacactaattaccgggaacatgagcttcagggatctgggacgcgtgatggtaatggtgggcgccacgatgactgacgatatagggatgggagtcacctatctcgctctgcttgccgcatttaaggtgcggcccacattcgcggccggcttgctgttaagaaaactcacctcaaaggaactgatgatgactacaatcggtattgttcttctgagtcagtccaccatccctgagacaattctagagctcactgacgctctggccttggggatgatggtgctgaaaatcgtcaggaagatggaacgataccaattagcagtgaccataatggctatcctctgcgttcccaatgccgtgattctgcagaacgcatggaaagtctcttgtacgatccttgccgtagtgagcgtttccccactgttgctcacatcaagccagcagaaggctgattggattcctctggcgctaaccatcaagggactgaatcccactgccatatttcttaccacactcagtcgcacttctaaaaagcggtcctggccactgaacgaggcaattatggctgtgggcatggtcagcatcttggcctcgtcactgctaaagaatgacatcccgatgaccggccctctcgtggccgggggactgcttacggtatgctatgtgctgacaggtagatctgctgacttggaactcgagaaggcagccgatgtcaggtgggaagaccaagcggagattagtggctccagccccatactgtctatcattatcagcgaggatgggtccatgtcaattaaaaacgaagaggaggaacagaccctaactatcctgatacgtacaggacttctcgttatcagtggcctgttcccagtgagcattcccatcaccgctgccgcatggtacttgtgggaggtgaagaaacagcgcgccggtgtcttatgggacgtgccttctccaccccctgttgggaaggctgaactggaggatggagcatatcggattaagcagaaaggcatcctcggctactcccaaataggggccggagtatataaggaaggtacttttcacacaatgtggcatgtgaccagaggcgcggtcctgatgcacaaagggaagaggattgagccgtcatgggctgacgtgaaaaaggatcttatcagttacggaggcggttggaagctggaaggggagtggaaagagggagaagaggttcaggtgttggccctagaaccaggcaagaatccccgagcagtccagacgaaacctggcctgttcaagactaacgccgggaccatcggagctgtgagcctcgacttttccccaggtacatctggctcgcccattatcgataaaaaggggaaggtagtcggactgtacggcaatggtgtggttacccggaacgggagctatgtgtcagccatagcacagacagagaaatccattgaagacaaccctgagatcgaggatgacattttccgcaagaaaagacttactatcatggatttacatccgggagctggcaagaccaaaaggtacctgcccgccatagtccgggaagcgattaagcgaggcctcagaacgttgatcctggccccaacacgcgtggttgcagctgagatggaagaggccctcagggggctgcctatccgttatcaaactcccgctattcgggcagaacacaccggaagagagatcgtggaccttatgtgtcatgccacattcaccatgaggctgttgagtccaattcgcgtccctaattacaacctaataatcatggacgaggcccactttactgatcccgcttctattgcggcacgaggttatatcagcaccagagtggaaatgggcgaggccgctgggatcttcatgacagccacgccaccgggatcccgggacccttttccccagtcaaatgcaccaattatggatgaagagagggagatacccgaacgctcttggaacagcggccacgagtgggtaactgacttcaagggtaaaaccgtgtggtttgttcctagtatcaaggccgggaatgatattgctgcgtgcctgcgtaaaaacggaaagaaagtcatccagctctccagaaagacattcgacagcgaatacgtgaagacccggactaatgattgggactttgtggtcacaaccgatatttctgagatgggcgccaacttcaaagcagaaagggtaatcgacccacgccgatgtatgaagcccgtgatattaacggatggcgaggagagagttatcctggctgggcctatgccggtgactcattcatccgccgcacaacggaggggacgcattggtagaaatcccaagaatgaaaatgaccagtatatctacatgggcgagccccttgaaaacgacgaggattgcgcccactggaaggaagctaaaatgctgctcgacaatattaacacacctgaggggatcatacccagtatgtttgagccagaaagggagaaggtcgatgccattgacggagaataccggttgcgtggcgaggcgcgcaaaaccttcgtggatctgatgcgaagaggtgacctccctgtttggctggcatataaggtggccgctgaagggatcaattacgccgataggcggtggtgttttgacggcattcgcaacaaccagatccttgaggagaatgtcgaagtggagatatggaccaaggaaggagagaggaaaaagctaaaacccaggtggctggatgctcggatctatagcgacccattggcattaaaggagttcaaagagttcgccgctggccgaaagtcgctgactctcaacctgattacagagatggggagacttcctacctttatgacacagaaggcccgcgatgcactggacaatctcgcggtattgcatactgccgaagctggaggtagggcctacaaccacgcactgtctgagctaccggaaacgctggagatcctccttctgttaaccttgctggctacagtgactggcgggattttcctctttctgatgtccggacggggcatcggtaaaatgacccttgggatgtgctgcataattacagccagcatcctgctctggtatgcacaaatccagccccactggattgccgcttcaatcatattggagttctttctgattgttttactaatcccagaacctgagaagcagcgtaccccacaggataatcaactgacttacgtcgtgattgcgatcctcacggtggtcgccgcaaccatggctaacgaaatgggcttccttgagaaaacaaagaaagacctgggattgggcagtataactacccagcagccagaatctaatatcctggacattgatctcagacctgcctccgcctggacactgtatgcagttgctaccacttttatcacacccatgcttaggcatagcattgagaactcaagtgtgaatgtaagcctcacggccatcgcgaaccaggctaccgtgctgatggggttgggaaagggttggccgctgtccaagatggacattggcgtcccattactagccatcgggtgttactctcaagtgaatcctataactctgacagcagccctccttctgttggttgctcactacgcaattatcggacccggcctgcaggccaaagcgacccgcgaggctcagaagcgggccgcagccggtatcatgaaaaacccaaccgtggatgggattacagtcatagacctcgatcccatcccttatgacccgaagttcgaaaaacagctgggccaagtaatgcttttagtgctgtgcgttactcaggtgctcatgatgcgaacgacctgggctttgtgtgaggccctgacactagcaactggacccattagcaccctgtgggaaggcaatccagggagattttggaacacaaccatcgctgtctccatggccaatattttcaggggatcatacctcgcgggcgccggtcttctgttttctatcatgaagaacactacgaatacacgccgggggaccggaaacataggcgagactttgggtgaaaagtggaaaagtagactgaacgcactcggcaagtcggagttccagatctataaaaagagcgggattcaagaggtggatcgtaccctggctaaagaaggaatcaagaggggcgagacagaccatcacgccgtctcccgggggtctgcaaaattacgctggtttgtggaacgaaatatgattactcctgagggaaaggttgtggatcttggctgcggtagagggggatggtcatactattgtggcggtctgaagaacgtaagggaggtgaaaggcctcaccaaaggcgggcccgggcatgaggaacctatcccaatgagcacatacgggtggaatctagtccggctgcagtccggagttgacgtgttcttcacgccccctgaaaaatgcgataccttgctgtgtgacataggcgagagttctccaaaccccactgtcgaagctggtcgcacactcagagtgcttaatctggtagagaactggttgaataacaatacccagttttgcattaaggtgctgaacccgtatatgcctagcgttatcgagaaaatggaagccctccagaggaagtacgggggagccttagtgcgaaatccactgtcacggaactccactcacgagatgtactgggtcagtaatgcgagcggcaacatcgtgtcttccgtcaatatgatttcacgtatgcttataaacagattcacaatgaagcacaaaaaggctacctatgaacccgatgtggacctgggcagcgggacgcgcaacatcggaattgagtcggaagttcctaatctagacatcattggtaaaaggatcgagaagataaaacaagagcatgaaacctcttggcactacgatcaggaccatccatataagacatgggcataccacggcagttatgagactaagcagaccgggtccgccagctcaatggtaaacggagtggtccggctcctgacaaaaccctgggatgtgatcccgatggttactcagatggctatgaccgacacaaccccttttggccaacagagagtgttcaaggaaaaagtcgatactcgcacgcaggagcccaaggaaggtaccaaaaagttgatgaagattaccgccgagtggctgtggaaagagctcgggaagaaaaagactccaaggatgtgtacccgagaagagtttacacggaaagtgagatccaatgcagcccttggagctatcttcacggacgaaaacaagtggaaatctgcgagggaggccgtagaggatagccgcttttgggaactggtggacaaggagcgtaatttacacctggaaggcaagtgcgagacctgtgtttacaacatgatgggcaaacgggaaaagaaattgggggagttcggaaaggcaaaaggtagtagagctatttggtatatgtggctcggcgccaggtttctggagttcgaagcactagggtttcttaatgaggatcattggttctcccgcgaaaacagcctgtctggagtcgagggcgaaggtctccacaagctggggtacatcttgcgagacgtgtcaaagaaagagggaggcgccatgtacgctgatgacactgccggctgggacacacggattaccctggaggatctcaagaatgaagagatggtgactaaccatatggaaggggagcacaagaaacttgcggaagcaatatttaaactgacatatcagaataaagtcgttagagtgcaaaggcctacaccccgcggaacagtaatggacatcattagtagacgggatcagaggggttccggccaggtggggacttacggattaaacaccttcacgaatatggaggcccaactgatccgtcagatggagggcgaaggtgtcttcaagagcatccagcatttgaccgctacagaggaaattgccgtgcagaactggctcgcacgagttgggcgcgagagactgtctcggatggctatatcgggagacgattgcgtggtcaaaccactagacgataggtttgcctcagctcttactgccctgaatgacatgggcaaggtgcgcaaagatatccaacagtgggagcccagcaagggctggaacgactggacccaggtacctttctgctcccaccactttcatgaactcattatgaaagatgggagagttctggtggtcccatgtcggaaccaggacgagttgatcggaagggcacgaattagtcaaggtgcgggctggtctttacgtgaaacagcctgcctgggaaagagctatgctcagatgtggtccctcatgtacttccacagacgcgatcttcggctggccgcaaatgctatctgttcagccgtgccgagtcattgggtgcccacttctaggaccacgtggagcatacacgcaaagcacgagtggatgacaaccgaagacatgctaactgtctggaacagagtttggatccaggagaatccttggatggaggacaaaacaccagtggaatcctgggaggaaattccctatctgggaaagcgcgaggatcagtggtgcggctcactcatcggtttgaccagccgggccacttgggcgaaaaacattcaaaccgctatcaatcaggtaaggtctctgatagggaacgaagagtacacagactatatgccttccatgaagcgatttagacgggaggaagaggaagccggagtgctttggtga

SEQ ID NO: 14286 - RNA, 9876 nt, synthetic construct
  misc_feature 1..9876: note = derived and/or modified CDS sequence (opt3) from DENV-2__KF744406__SS-prME
  source 1..9876: mol_type = other RNA
accgccggcatgatcattatgctgatacccaccgtgatggctttccacctcactacgagaaacggggagcctcatatgatcgtcagcagacaggaaaagggaaaatcccttctgtttaagaccgaggacggtgttaatatgtgcacattgatggcaatggatttaggcgaactgtgtgaggacactattacctacaaatgcccattactccggcaaaacgaaccggaggatatcgactgttggtgcaattctacatcaacctgggtgacttatgggacatgtaccacgactggagagcaccgccgagaaaagcgtagtgtagccctggtgccccatgtcggcatgggtcttgagaccagaacagaaacttggatgagctccgagggggcgtggaaacacgctcagaggattgagacctggatcctgcggcatcctggattcacattgatggccgcaatactcgcctacaccatcggcacgactaactttcagcgcgctctgattttcatcctgctcacagcagtggccccatctatgaccatgagatgcattggcatctcgaatagggattttgttgaaggggtgtcaggaggtagctgggtcgacatagtgttagagcacggcagttgtgtaactacaatggctaagaacaagcccaccctggatttcgaacttattaaaacggaggccaagcagcctgcgaccttgcggaaatattgcatcgaagcaaagctgacaaatactaccacagagtcccgctgtccaactcaaggggagccctctctaaacgaagaacaggacaaacgatttgtttgcaagcacagcatggtggatagaggatggggcaatggttgtggactcttcggaaagggcggcattgtcacatgcgccatgtttacatgcaaaaagaacatggaagggaaaatcgtgcagcctgagaatctggaatacaccatcgtgattactccacattccggagaggagcacgctgtcggtaacgacacgggcaagcatgggaaagaaataaagatcacaccgcagtcaagtattaccgaggccgaacttactggatatggcaccgttacaatggagtgtagccccaggaccggtctggatttcaatgaaatggtgttgctccaaatggagaacaaagcatggctggtacaccggcagtggtttttagacctgcctctcccatggcttcccggggctgatactcagggctctaattggatccagaaggagacactggtgacgttcaagaaccctcacgccaaaaagcaagacgtcgtggttttgggatcccaggaaggcgcgatgcataccgccctaactggggcaacagagatacagatgtcaagcggaaacctgctctttaccggtcacctgaaatgccgtcttcgcatggacaagctgcaattgaaaggcatgagttactctatgtgtacagggaagttcaaggtggtcaaagaaattgctgagactcagcatggaaccatcgtggtaagagttcagtatgagggcgatggttccccatgcaagatccccttcgaaattatggacctcgagaaaaggcacgtgctggggcggttaatcacggtcaatccgattgtgaccgaaaaggatagccctgtcaacatagaggccgaacccccatttggcgactcgtacgtgatcattggagttgagcctggccagctgaaactaaattggttcaagaaggggtcttccatcggacaaatgtttgagacaactatgcgaggtgctaaacgcatggccatcctcggcgataccgcatgggacttcgggtcactgggaggcgtgtttacaagtattggtaaggcccttcatcaggtattcggggctatatacggcgcggcatttagcggagtctcctggactatgaaaatcttgattggcgtgatcattacctggatcgggatgaactctagaagcacgtcactgagtgtttccctcgtgctggtcggagtggtaacactttatctgggcgtggttgtccaggccgatagcggttgtgtggtgtcttggaggaataaggaattgaaatgcgggtcaggaatattcatcaccgacaacgtccacacttggacagagcagtacaagtttcaacccgaaagtccaagcaagctcgcttccgccattcagaaagcacaccaggagggcatctgtggtattcggtctgttacccgcctggaaaatttaatgtggaagcagatcactcccgagctgaaccatatactatcggagaatgaagtgaaactcaccattatgacaggcgatatcaaggggattatgcacgccggaaaaagaagcctgaggcctcaaccaacggagcttcgttattcctggaagacctggggcaaagctaagatcttgtcaactgaaagtcataaccagacattcctgatagacgggccggagaccgccgaatgccccaatacaaaccgggcatggaactctctcgaggtggaggattacggatttggcgtattcactaccaacatctggctgcgattaagagaaaagcaggacgcgttttgtgacagcaaactgatgtccgctgccattaaggataatagggcagtccacgccgacatgggttattggatcgagtcagctcttaacgatacgtggaaaattgaaaaggccagcttcatcgaggtgaaatcttgccactggcctaagtcccatacattgtggagtaacggggttctcgagagcgaaatgataattccaaagaatttcgcaggacccgtgtctcagcacaactaccgccctggctatcatacccaaactgctggtccatggcacctgggcaaactagagatggactttgatttctgtaaggggaccacagtcgtggttactgaagactgcggaaatcggggcccctccctgagaaccacaacggcctcagggaaactcatcaccgagtggtgctgtaggagttgcactctgccgcctcttcgctaccgaggagaagatggctgttggtacggtatggagatccggccattgaaggagaaagaagagaacctggtgagctcgttagtaacagcggggcatggacagattgacaatttttccctcggcgtcctgggtatggcccttttcctggaagagatgttgcgtaccagagtgggcactaagcacgctatcctcctggtggcagtctcttttgttacactaattaccgggaacatgagcttcagggatctgggacgcgtgatggtaatggtgggcgccacgatgactgacgatatagggatgggagtcacctatctcgctctgcttgccgcatttaaggtgcggcccacattcgcggccggcttgctgttaagaaaactcacctcaaaggaactgatgatgactacaatcggtattgttcttctgagtcagtccaccatccctgagacaattctagagctcactgacgctctggccttggggatgatggtgctgaaaatcgtcaggaagatggaacgataccaattagcagtgaccataatggctatcctctgcgttcccaatgccgtgattctgcagaacgcatggaaagtctcttgtacgatccttgccgtagtgagcgtttccccactgttgctcacatcaagccagcagaaggctgattggattcctctggcgctaaccatcaagggactgaatcccactgccatatttcttaccacactcagtcgcacttctaaaaagcggtcctggccactgaacgaggcaattatggctgtgggcatggtcagcatcttggcctcgtcactgctaaagaatgacatcccgatgaccggccctctcgtggccgggggactgcttacggtatgctatgtgctgacaggtagatctgctgacttggaactcgagaaggcagccgatgtcaggtgggaagaccaagcggagattagtggctccagccccatactgtctatcattatcagcgaggatgggtccatgtcaattaaaaacgaagaggaggaacagaccctaactatcctgatacgtacaggacttctcgttatcagtggcctgttcccagtgagcattcccatcaccgctgccgcatggtacttgtgggaggtgaagaaacagcgcgccggtgtcttatgggacgtgccttctccaccccctgttgggaaggctgaactggaggatggagcatatcggattaagcagaaaggcatcctcggctactcccaaataggggccggagtatataaggaaggtacttttcacacaatgtggcatgtgaccagaggcgcggtcctgatgcacaaagggaagaggattgagccgtcatgggctgacgtgaaaaaggatcttatcagttacggaggcggttggaagctggaaggggagtggaaagagggagaagaggttcaggtgttggccctagaaccaggcaagaatccccgagcagtccagacgaaacctggcctgttcaagactaacgccgggaccatcggagctgtgagcctcgacttttccccaggtacatctggctcgcccattatcgataaaaaggggaaggtagtcggactgtacggcaatggtgtggttacccggaacgggagctatgtgtcagccatagcacagacagagaaatccattgaagacaaccctgagatcgaggatgacattttccgcaagaaaagacttactatcatggatttacatccgggagctggcaagaccaaaaggtacctgcccgccatagtccgggaagcgattaagcgaggcctcagaacgttgatcctggccccaacacgcgtggttgcagctgagatggaagaggccctcagggggctgcctatccgttatcaaactcccgctattcgggcagaacacaccggaagagagatcgtggaccttatgtgtcatgccacattcaccatgaggctgttgagtccaattcgcgtccctaattacaacctaataatcatggacgaggcccactttactgatcccgcttctattgcggcacgaggttatatcagcaccagagtggaaatgggcgaggccgctgggatcttcatgacagccacgccaccgggatcccgggacccttttccccagtcaaatgcaccaattatggatgaagagagggagatacccgaacgctcttggaacagcggccacgagtgggtaactgacttcaagggtaaaaccgtgtggtttgttcctagtatcaaggccgggaatgatattgctgcgtgcctgcgtaaaaacggaaagaaagtcatccagctctccagaaagacattcgacagcgaatacgtgaagacccggactaatgattgggactttgtggtcacaaccgatatttctgagatgggcgccaacttcaaagcagaaagggtaatcgacccacgccgatgtatgaagcccgtgatattaacggatggcgaggagagagttatcctggctgggcctatgccggtgactcattcatccgccgcacaacggaggggacgcattggtagaaatcccaaaaatgaaaatgaccagtatatctacatgggcgagccccttgaaaacgacgaggattgcgcccactggaaggaagctaaaatgctgctcgacaatattaacacacctgaggggatcatacccagtatgtttgagccagaaagggagaaggtcgatgccattgacggagaataccggttgcgtggcgaggcgcgcaaaaccttcgtggatctgatgcgaagaggtgacctccctgtttggctggcatataaggtggccgctgaagggatcaattacgccgataggcggtggtgttttgacggcattcgcaacaaccagatccttgaggagaatgtcgaagtggagatatggaccaaggaaggagagaggaaaaagctaaaacccaggtggctggatgctcggatctatagcgacccattggcattaaaggagttcaaagagttcgccgctggccgaaagtcgctgactctcaacctgattacagagatggggagacttcctacctttatgacacagaaggcccgcgatgcactggacaatctcgcggtattgcatactgccgaagctggaggtagggcctacaaccacgcactgtctgagctaccggaaacgctggagatctccctccttctgaccttattggctacagtgactggcgggattttcctgtttctcatgagcggacggggcatcggtaaaatgaccctggggatgtgctgcataattacagcctcaatccttctgtggtatgcacaaatccagccccactggattgccgctagtatcatactcgagttctttttgattgttctgttaatcccagaacctgagaagcagcgtaccccacaggataatcaactaacttacgtcgtgattgcgatcctgacggtggtcgccgcaaccatggctaacgaaatgggcttcctcgagaaaacaaagaaagaccttggactgggctctataactacccagcagccagaatccaatatcttggacattgatctgagacctgccagcgcctggacactctatgcagttgctaccacttttatcacacccatgctgaggcattcaattgagaacagtagcgtgaatgtatcccttacggccatcgcgaaccaggctaccgtgctcatggggctgggaaagggttggccgttgtctaagatggacattggcgtcccactgttagccatcgggtgttacagccaagtgaatcctataactctaacagcagccctgctccttctggttgctcactacgcaattatcggacccggcttgcaggccaaagcgacccgcgaggctcagaagcgggccgcagccggtatcatgaaaaacccaaccgtggatgggattacagtcatagacctggatcccatcccttatgacccgaagttcgaaaaacagctcggccaagtaatgctgcttgtgttatgcgttactcaggtgctgatgatgcgaacgacctgggctctctgtgaggccttgacactggcaactggacccatttccaccctatgggaaggcaatccagggagattttggaacacaaccatcgctgtctcaatggccaatattttcaggggatcttacctggcgggcgccggtctcctttttagtatcatgaagaacactacgaatacacgccgggggaccggaaacataggcgagactctgggtgaaaagtggaaatcgagattgaacgcactgggcaagagcgagttccagatctataaaaagtccgggattcaagaggtggatcgtaccctcgctaaagaaggaatcaagaggggcgagacagaccatcacgccgtctctcgggggtcagcaaaactgcgctggtttgtggaacgaaatatgattactcctgagggaaaggttgtggatttaggctgcggtagagggggatggagctactattgtggcggtcttaagaacgtaagggaggtgaaaggcctgaccaaaggcgggcccgggcatgaggaacctatcccaatgtccacatacgggtggaatctcgtccggctacagagtggagttgacgtgttcttcacgccccctgaaaaatgcgataccctgttgtgtgacataggcgagtctagcccaaaccccactgtcgaagctggtcgcacactgagagtgctcaatcttgtagagaactggctgaataacaatacccagttttgcattaaggtgttgaacccgtatatgccttcagttatcgagaaaatggaagccctgcagaggaagtacgggggagccctcgtgcgaaatccattatcccggaacagtactcacgagatgtactgggtcagcaatgcgtctggcaacatcgtgtcctcagtcaatatgattagccgtatgctgataaacagattcacaatgaagcacaaaaaggctacctatgaacccgatgtggaccttggctcggggacgcgcaacatcggaattgagtctgaagttcctaatctggacatcattggtaaaaggatcgagaagataaaacaagagcatgaaaccagttggcactacgatcaggaccatccatataagacatgggcataccacggctcctatgagactaagcagaccgggagcgcctcatccatggtaaacggagtggtccggctactcacaaaaccctgggatgtgatcccgatggttactcagatggctatgaccgacacaaccccttttggccaacagagagtgttcaaggaaaaagtcgatactcgcacgcaggagcccaaggaaggtaccaaaaagctgatgaagattaccgccgagtggttgtggaaagagctggggaagaaaaagactccaaggatgtgtacccgagaagagtttacacggaaagtgagatctaatgcagccctcggagctatcttcacggacgaaaacaagtggaaaagcgcgagggaggccgtagaggatagtcgcttttgggaacttgtggacaaggagcgtaatctgcacttagaaggcaagtgcgagacctgtgtttacaacatgatgggcaaacgggaaaagaaactgggggagttcggaaaggcaaaaggttccagagctatttggtatatgtggttgggcgccaggtttctcgagttcgaagcactggggtttctaaatgaggatcattggttcagccgcgaaaactctctttcaggagtcgagggcgaaggtctgcacaagctcgggtacatcctgcgagacgtgagtaagaaagagggaggcgccatgtacgctgatgacactgccggctgggacacacggattaccttggaggatctgaagaatgaagagatggtgactaaccatatggaaggggagcacaaaaagctcgcggaagcaatatttaaacttacatatcagaataaggtcgttagagtgcaaaggcctacaccccgcggaacagtaatggacatcatttccagacgggatcagaggggtagcggccaggtggggacttacggactgaacaccttcacgaatatggaggcccaattaatccgtcagatggagggcgaaggtgtcttcaagtctatccagcatctgaccgctacagaggaaattgccgtgcagaactggttggcacgagttgggcgcgagagactctcgcggatggctatatcaggagacgattgcgtggtcaaaccactggacgataggtttgccagcgctctaactgcccttaatgacatgggcaaggtgcgcaaagatatccaacagtgggagccctccaagggctggaacgactggacccaggtacctttctgcagtcaccactttcatgaactgattatgaaagatgggagagttctcgtggtcccatgtcggaaccaggacgagctgatcggaagggcacgaatttctcaaggtgcgggctggagcttgcgtgaaacagcctgcttagggaagtcctatgctcagatgtggtcactgatgtacttccacagacgcgatctccggcttgccgcaaatgctatctgtagtgccgtgccgtctcattgggtgcccactagcaggaccacgtggtccatacacgcaaagcacgagtggatgacaaccgaagacatgctgactgtctggaacagagtttggatccaggagaatccttggatggaggacaaaacaccagtggaatcatgggaggaaattccctatctaggaaagcgcgaggatcagtggtgcggcagcctgatcggtctcacctctcgggccacttgggcgaaaaacattcaaaccgctatcaatcaggtaaggtccttgatagggaacgaagagtacacagactatatgcctagtatgaagcgatttagacgggaggaagaggaagccggagtgctgtggtga

SEQ ID NO: 14287 - RNA, 9876 nt, synthetic construct
  misc_feature 1..9876: note = derived and/or modified CDS sequence (opt3) from DENV-2__KF744404__SS-prME
  source 1..9876: mol_type = other RNA
accgccggcatgatcattatgctgatacccacagtgatggctttccacctcactacgagaaacggggaacctcatatgatcgtcagcagacaggaaaagggaaaatcccttctgtttaagaccgaagacggtgttaatatgtgcacattgatggcaatggatttaggcgaactgtgtgaggacactattacctacaaatgcccattactccggcaaaacgaaccggaggatatcgactgttggtgcaattctacatcaacctgggtgacttatgggacatgtaccacgactggagagcaccgccgagaaaagcgtagtgtagccctggtgccccatgtcggcatgggtcttgagaccagaacagaaacttggatgagctccgagggggcgtggaaacacgctcagaggattgagacctggatcctgcggcatcctggattcacattgatggccgcaatactcgcctacaccatcggcacgactaactttcagcgcgctctgattttcatcctgctcacagcagtggccccatctatgaccatgagatgcattggcatctcgaatagggattttgttgaaggggtgtcaggaggtagctgggtcgacatagtgttagagcacggcagttgtgtaactacaatggctaagaacaagcccaccctggatttcgaacttattaaaacggaggccaagcagcctgcgaccttgcggaaatattgcatcgaagcaaagctgacaaatactaccacagagtcccgctgtccaactcaaggggagccctctctaaacgaagaacaggacaaacgatttgtttgcaagcacagcatggtggatagaggatggggcaatggttgtggactcttcggaaagggcggcattgtcacatgcgccatgtttacatgcaaaaagaacatggaagggaaaatcgtgcagcctgagaatctggaatacaccatcgtgattactccacattccggagaggagcacgctgtcggtaacgacacgggcaagcatgggaaagaaataaagatcacaccgcagtcaagtattaccgaggccgaacttactggatatggcaccgttacaatggagtgtagccccaggaccggtctggatttcaatgaaatggtgttgctccaaatggagaacaaagcatggctggtacaccggcagtggtttttagacctgcctctcccatggcttcccggggctgatactcagggctctaattggatccagaaggagacactggtgacgttcaagaaccctcacgccaaaaagcaagacgtcgtggttttgggatcccaggaaggcgcgatgcataccgccctaactggggcaacagagatacagatgtcaagcggaaacctgctctttaccggtcacctgaaatgccgtcttcgcatggacaagctgcaattgaaaggcatgagttactctatgtgtacagggaagttcaaggtggtcaaagaaattgctgagactcagcatggaaccatcgtggtaagagttcagtatgagggcgatggttccccatgcaagatccccttcgaaattatggacctcgagaaaaggcacgtgctggggcggttaatcacggtcaatccgattgtgaccgaaaaggatagccctgtcaacatagaggccgaacccccatttggcgactcgtacgtgatcattggagttgagcctggccagctgaaactaaattggttcaagaaggggtcttccatcggacaaatgtttgagacaactatgcgaggtgctaaacgcatggccatcctcggcgataccgcatgggacttcgggtcactgggaggcgtgtttacaagtattggtaaggcccttcatcaggtattcggggctatatacggcgcggcatttagcggagtctcctggactatgaaaatcttgattggcgtgatcattacctggatcgggatgaactctagaagcacgtcactgagtgtttccctcgtgctggtcggagtggtaacactttatctgggcgtggttgtccaggccgatagcggttgtgtggtgtcttggaggaataaggaattgaaatgcgggtcaggaatattcatcaccgacaacgtccacacttggacagagcagtacaagtttcaacccgaaagtccaagcaagctcgcttccgccattcagaaagcacaccaggagggcatctgtggtattcggtctgttacccgcctggaaaatttaatgtggaagcagatcactcccgagctgaaccatatactatcggagaatgaagtgaaactcaccattatgacaggcgatatcaaggggattatgcacgccggaaaaagaagcctgaggcctcaaccaacggagcttcgttattcctggaagacctggggcaaagctaagatcttgtcaactgaaagtcataaccagacattcctgatagacgggccggagaccgccgaatgccccaatacaaaccgggcatggaactctctcgaggtggaggattacggatttggcgtattcactaccaacatctggctgcgattaagagaaaagcaggacgcgttttgtgacagcaaactgatgtccgctgccattaaggataatagggcagtccacgccgacatgggttattggatcgagtcagctcttaacgatacgtggaaaattgaaaaggccagcttcatcgaggtgaaatcttgccactggcctaagtcccatacattgtggagtaacggggttctcgagagcgaaatgataattccaaagaatttcgcaggacccgtgtctcagcacaactaccgccctggctatcatacccaaactgctggtccatggcacctgggcaaactagagatggactttgatttctgtaaggggaccacagtcgtggttactgaagactgcggaaatcggggcccctccctgagaaccacaacggcctcagggaaactcatcaccgagtggtgctgtaggagttgcactctgccgcctcttcgctaccgaggagaagatggctgttggtacggtatggagatccggccattgaaggagaaagaagagaacctggtgagctcgttagtaacagcggggcatggacagattgacaatttttccctcggcgtcctgggtatggcccttttcctggaagagatgttgcgtaccagagtgggcactaagcacgctatcctcctggtggcagtctcttttgttacactaattaccgggaacatgagcttcagggatctgggacgcgtgatggtaatggtgggcgccacgatgactgacgatatagggatgggagtcacctatctcgctctgcttgccgcatttaaggtgcggcccacattcgcggccggcttgctgttaagaaaactcacctcaaaggaactgatgatgactacaatcggtattgttcttctgagtcagtccaccatccctgagacaattctagagctcactgacgctctggccttggggatgatggtgctgaaaatcgtcaggaagatggaacgataccaattagcagtgaccataatggctatcctctgcgttcccaatgccgtgattctgcagaacgcatggaaagtctcttgtacgatccttgccgtagtgagcgtttccccactgttgctcacatcaagccagcagaaggctgattggattcctctggcgctaaccatcaagggactgaatcccactgccatatttcttaccacactcagtcgcacttctaaaaagcggtcctggccactgaacgaggcaattatggctgtgggcatggtcagcatcttggcctcgtcactgctaaagaatgacatcccgatgaccggccctctcgtggccgggggactgcttacggtatgctatgtgctgacaggtagatctgctgacttggaactcgagaaggcagccgatgtcaggtgggaagaccaagcggagattagtggctccagccccatactgtctatcattatcagcgaggatgggtccatgtcaattaaaaacgaagaggaagaacagaccctaactatcctgatacgtacaggacttctcgttatcagtggcctgttcccagtgagcattcccatcaccgctgccgcatggtacttgtgggaggtgaagaaacagcgcgccggtgtcttatgggacgtgccttctccaccccctgttgggaaggctgaactggaggatggagcatatcggattaagcagaaaggcatcctcggctactcccaaataggggccggagtatataaggaaggtacttttcacacaatgtggcatgtgaccagaggcgcggtcctgatgcacaaagggaagaggattgagccgtcatgggctgacgtgaaaaaggatcttatcagttacggaggcggttggaagctggaaggggagtggaaagagggagaagaggttcaggtgttggccctagaaccaggcaagaatccccgagcagtccagacgaaacctggcctgttcaagactaacgccgggaccatcggagctgtgagcctcgacttttccccaggtacatctggctcgcccattatcgataaaaaggggaaggtagtcggactgtacggcaatggtgtggttacccggaacgggagctatgtgtcagccatagcacagacagagaaatccattgaagacaaccctgagatcgaggatgacattttccgcaagaaaagacttactatcatggatttacatccgggagctggcaagaccaaaaggtacctgcccgccatagtccgggaagcgattaagcgaggcctcagaacgttgatcctggccccaacacgcgtggttgcagctgagatggaagaggccctcagggggctgcctatccgttatcaaactcccgctattcgggcagaacacaccggaagagagatcgtggaccttatgtgtcatgccacattcaccatgaggctgttgagtccaattcgcgtccctaattacaacctaataatcatggacgaggcccactttactgatcccgcttctattgcggcacgaggttatatcagcaccagagtggaaatgggcgaggccgctgggatcttcatgacagccacgccaccgggatcccgggacccttttccccagtcaaatgcaccaattatggatgaagagagggagatacccgaacgctcttggaacagcggccacgagtgggtaactgacttcaagggtaaaaccgtgtggtttgttcctagtatcaaggccgggaatgatattgctgcgtgcctgcgtaaaaacggaaagaaagtcatccagctctccagaaagacattcgacagcgaatacgtgaagacccggactaatgattgggactttgtggtcacaaccgatatttctgagatgggcgccaacttcaaagcagaaagggtaatcgacccacgccgatgtatgaagcccgtgatattaacggatggcgaggagagagttatcctggctgggcctatgccggtgactcattcatccgccgcacaacggaggggacgcattggtagaaatcccaaaaatgaaaatgaccagtatatctacatgggcgagccccttgaaaacgacgaggattgcgcccactggaaggaagctaaaatgctgctcgacaatattaacacacctgaggggatcatacccagtatgtttgagccagaaagggagaaggtcgatgccattgacggagaataccggttgcgtggcgaggcgcgcaaaaccttcgtggatctgatgcgaagaggtgacctccctgtttggctggcatataaggtggccgctgaagggatcaattacgccgataggcggtggtgttttgacggcattcgcaacaaccagatccttgaggagaatgtcgaagtggagatatggaccaaggaaggagagaggaaaaagctaaaacccaggtggctggatgctcggatctatagcgacccattggcattaaaggagttcaaagagttcgccgctggccgaaagtcgctgactctcaacctgattacagagatggggagacttcctacctttatgacacagaaggcccgcgatgcactggacaatctcgcggtattgcatactgccgaagctggaggtagggcctacaaccacgcactgtctgagctaccggaaacgctgcaaatctccctccttctgaccttattggctacagtgactggcgggattttcctgtttctcatgagcggacggggcatcggtaaaatgaccctggggatgtgctgcataattacagcctcaatccttctgtggtatgcacagatccagccccactggattgccgctagtatcatactcgagttctttttgattgttctgttaatcccagagcctgaaaagcagcgtaccccacaagataatcagctaacttacgtcgtgattgcgatcctgacggtggtcgccgcaaccatggctaacgagatgggcttcctcgagaaaaccaagaaagaccttggactgggctctataactacccagcagccagagtccaatatcttggacattgatctgagacctgccagcgcctggacactctatgcagttgctaccacttttatcacacccatgctgaggcattcaattgaaaacagtagcgtgaatgtatcccttacggccatcgcgaaccaagctaccgtgctcatggggctgggaaagggttggccgttgtctaagatggacattggcgtcccactgttagccatcgggtgttacagccaggtgaatcctataactctaacagcagccctgctccttctggttgctcactacgcaattatcggacccggcttgcaggccaaagcgacccgcgaggctcagaagcgggccgcagccggtatcatgaaaaacccaaccgtggatgggattacagtcatagacctggatcccatcccttatgacccgaagttcgagaaacaactcggccaggtaatgctgcttgtgttatgcgttactcaggtgctgatgatgcgaacgacctgggctctctgtgaagccttgacactggcaactggacccatttccaccctatgggagggcaatccagggagattttggaacacaaccatcgctgtctcaatggccaatattttcaggggatcttacctggcgggcgccggtctcctttttagtatcatgaagaacactacgaatacacgccgggggaccggaaacataggcgaaactctgggtgagaagtggaaatcgagattgaacgcactgggcaagagcgagttccaaatctataaaaagtccgggattcaggaggtggatcgtaccctcgctaaagagggaatcaagaggggcgaaacagaccatcacgccgtctctcgggggtcagcaaaactgcgctggtttgtggagcgaaatatgattactcctgaaggaaaggttgtggatttaggctgcggtagagggggatggagctactattgtggcggtcttaagaacgtaagggaggtgaaaggcctgaccaaaggcgggcccgggcatgaggaacctatcccaatgtccacatacgggtggaatctcgtccggctacagagtggagttgacgtgttcttcacgccccctgagaaatgcgataccctgttgtgtgacataggcgaatctagcccaaaccccactgtcgaggctggtcgcacactgagagtgctcaatcttgtagaaaactggctgaataacaatacccagttttgcattaaggtgttgaacccgtatatgccttcagttatcgagaaaatggaggccctgcaaaggaagtacgggggagccctcgtgcgaaatccattatcccggaacagtactcacgaaatgtactgggtcagcaatgcgtctggcaacatcgtgtcctcagtcaatatgattagccgtatgctgataaacagattcacaatgaagcacaaaaaggctacctatgagcccgatgtggaccttggctcggggacgcgcaacatcggaattgaatctgaggttcctaatctggacatcattggtaaaaggatcgaaaagataaaacaggagcatgagaccagttggcactacgatcaggaccatccatataagacatgggcataccacggctcctatgaaactaagcagaccgggagcgcctcatccatggtaaacggagtggtccggctactcacaaaaccctgggatgtgatcccgatggttactcaaatggctatgaccgacacaaccccttttggccagcagagagtgttcaaggagaaagtcgatactcgcacgcaggaacccaaggagggtaccaaaaagctgatgaagattaccgccgaatggttgtggaaagagctggggaagaaaaagactccaaggatgtgtacccgagaggaatttacacggaaagtgagatctaatgcagccctcggagctatcttcacggacgagaacaagtggaaaagcgcgagggaagccgtagaggatagtcgcttttgggagcttgtggacaaggaacgtaatctgcacttagagggcaagtgcgaaacctgtgtttacaacatgatgggcaaacgggagaagaaactgggggagttcggaaaggcaaaaggttccagagctatttggtatatgtggttgggcgccaggtttctcgagttcgaggcactggggtttctaaatgaagatcattggttcagccgcgagaactctctttcaggagtcgaaggcgagggtctgcacaagctcgggtacatcctgcgagacgtgagtaagaaagaaggaggcgccatgtacgctgatgacactgccggctgggacacacggattaccttggaggatctgaagaatgaggaaatggtgactaaccatatggagggggaacacaaaaagctcgcggaggcaatatttaaacttacatatcaaaataaggtcgttagagtgcagaggcctacaccccgcggaacagtaatggacatcatttccagacgggatcagaggggtagcggccaagtggggacttacggactgaacaccttcacgaatatggaagcccagttaatccgtcagatggagggcgagggtgtcttcaagtctatccagcatctgaccgctacagaagagattgccgtgcaaaactggttggcacgagttgggcgcgaaagactctcgcggatggctatatcaggagacgattgcgtggtcaaaccactggacgataggtttgccagcgctctaactgcccttaatgacatgggcaaggtgcgcaaagatatccagcagtgggagccctccaagggctggaacgactggacccaggtacctttctgcagtcaccactttcatgagctgattatgaaagatgggagagttctcgtggtcccatgtcggaaccaagacgaactgatcggaagggcacgaatttctcagggtgcgggctggagcttgcgtgagacagcctgcttagggaagtcctatgctcagatgtggtcactgatgtacttccacagacgcgatctccggcttgccgcaaatgctatctgtagtgccgtgccgtctcattgggtgcccactagcaggaccacgtggtccatacacgcaaagcacgaatggatgacaaccgaggacatgctgactgtctggaacagagtttggatccaggaaaatccttggatggaggacaaaacaccagtggagtcatgggaagagattccctatctaggaaagcgcgaagatcaatggtgcggcagcctgatcggtctcacctctcgggccacttgggcgaaaaacattcagaccgctatcaatcaggtaaggtccttgatagggaacgaggaatacacagactatatgcctagtatgaagcgatttagacgggaggaggaagaggccggagtgctgtggtga

SEQ ID NO: 14288 - RNA, 9876 nt, synthetic construct
  misc_feature 1..9876: note = derived and/or modified CDS sequence (opt3) from DENV-2__KF744407__SS-prME
  source 1..9876: mol_type = other RNA
accgccggcatgatcattatgctgatacccacagtgatggctttccacctcactacgagaaacggggaacctcatatgatcgtcagcaggcaggaaaaggggaaatcccttctgtttaagaccgaggacggtgttaatatgtgcacattgatggcaatggatttaggcgaactgtgtgaggacactattacctacaaatgcccattactccggcaaaacgaaccggaggatatcgactgttggtgcaattctacatcaacctgggtgacttatgggacatgtaccacgactggagagcaccgccgagaaaagcgtagtgtcgccctggtgccccatgtcggcatgggtcttgagaccagaacagaaacttggatgagctccgagggggcgtggaaacacgctcagaggattgagacctggatcctgcggcatcctggattcacattgatggccgcaatactcgcctacaccatcggcacgactaactttcagcgcgctctgattttcatcctgctcacagcagtggccccatctatgaccatgagatgcattggcatctcgaatagggattttgttgaaggggtgtcaggaggtagctgggtcgacatagtgttagagcacggcagttgtgtaactacaatggctaagaacaagcccaccctggatttcgaacttattaaaacggaggccaagcaccctgcgaccttgcggaaatattgcatcgaagcaaagctgacaaatactaccacagcctcccgctgtccaactcagggggagccctctctaaacgaggaacaagacaaacgatttgtttgcaagcatagcatggtggatagaggatggggcaatggttgtggactcttcggaaagggcggcattgtaacctgcgctatgtttacatgcaaaaagaacatggaggggaaagtggtgcagcctgaaaatctggagtacaccatcgtcatcactccacactccggagaagaacatgccgttggtaacgacacgggcaagcacgggaaagagattaagataacaccgcagtcaagtatcaccgaagcagagcttactggatatggcaccgtgacaatggaatgtagccccaggaccggtctggatttcaatgagatggtattgctccagatggaaaacaaggcttggctggtgcaccggcaatggtttttagacctgcctctcccatggcttcccggggccgatactcagggctctaattggattcagaaggagacactggtcacgttcaagaaccctcatgcgaaaaagcaggacgtggttgtgttgggatcccaagagggcgccatgcacaccgcactaactggggctacagaaatccagatgtcaagcggaaacctgctctttaccggtcatctgaaatgccgtcttcgcatggacaagctgcagttgaaaggcatgagttactctatgtgtacagggaagttcaaggtcgtgaaagagatagccgaaactcaacacggaaccattgtagttagagtgcagtatgagggcgatggttccccatgcaagatccccttcgagatcatggacctcgagaagaggcatgtcctggggcggttaattacggtgaatccgatcgtcaccgagaaggatagccctgtgaacattgaagctgagcccccatttggcgactcgtacgttataatcggagtggaacctggccagctgaaactaaattggttcaagaaggggtcttccattggacagatgtttgagacaactatgcgaggtgccaaacgcatggcaatcctcggcgataccgcctgggacttcgggtcactgggaggcgtatttacaagtatcggtaaggcacttcaccaagtcttcggggcgatttacggcgcagcctttagcggagtgtcctggactatgaaaatattgatcggcgttattatcacctggattgggatgaactctagaagcacgtcactgagtgtgtccctcgtcctggtgggagtagtgacactttatctgggcgttatggtccaggctgatagcggttgtgtggcctcttggaagaataaagagttgaagtgcgggtcaggaatcttcataaccgacaacgtgcacacttggacagaacagtacaagtttcagcccgagagtccaagcaaactcgcatccgccatccaaaaggctcatcaggaaggcatttgtggtatcaggtctgtcacccggctggagaatttaatgtggaaacagattactcccgaactgaaccacatcctatcggagaatgaggttaagctcaccataatgacaggcgatattaaagggatcatgcatgccggaaagcgcagcctgagacctcagccaacggaacttaggtattcctggaaaacctggggcaaggcaaagattttgtcaactgagagtcacaaccaaacattcctgatcgacgggccggaaaccgcggagtgccccaatacaaaccgtgcttggaactctctcgaagtggaggattacggatttggcgtgttcactaccaacatatggctgcggttacgagagaaacaggacgccttttgtgacagcaagctgatgtccgcagccatcaaagataatagagctgtacacgccgacatgggttattggattgaatcagcacttaacgatacgtggaagatcgagaaagctagcttcattgaagtcaagtcttgccattggcctaagtcccacacattgtggagtaacggggtgctcgagagcgagatgatcatacccaaaaatttcgccggacccgtttctcagcataactacaggcctggctatcacacccagactgcgggtccatggcatctgggcaagctagaaatggactttgatttctgtgaggggaccacagtggtcgtgactgaagactgcggaaatcgcggcccctccctgcggaccacaacggcctcagggaaactcattaccgagtggtgctgtagaagttgcactctgccgcctcttaggtaccgcggagaagatggctgttggtacggtatggagatccgaccattgaaggagaaagaagagaacctggttagctcgttagtgacagctgggcacggacaaatcgacaatttttccctcggcgtactgggtatggcacttttcctggaagagatgttgcggacccgtgtcggcactaagcacgccattctcctggtggctgtgtcttttgtcacactaatcaccgggaacatgagcttcagagatctgggaagggttatggtgatggtaggcgccacgatgactgacgatattgggatgggagtgacctatctcgcactgcttgcggcctttaaggtccgccccacattcgctgccggcttgctgttacggaaactcacctcaaaggaactgatgatgactacaataggtatcgtgcttctgagtcagtccaccattcctgagacaatcctagagctcactgacgcactggctttggggatgatggttctgaaaattgtgagaaatatggaaaagtaccagttagccgtcaccatcatggcaatactctgcgtgcccaacgccgttatcctgcaaaatgcttggaaagtgtcttgtacgattcttgcggtcgtaagcgtgtccccactgttgctcacatcaagccagcagaaggccgattggatccctctggcactaaccattaagggactgaaccccactgctatctttcttaccacactcagtaggacttctaaaaagcgatcctggccactgaatgaggccataatggccgttggcatggtgagcattttggcttcgtcactgctcaaaaatgacatcccgatgaccggccctctagtcgcagggggactgcttacggtgtgctatgtactgacaggtcgctctgccgacttggaactcgagaaggcggctgatgtgcggtgggaagaacaggccgagatcagtggctccagccccattctgtctataatcattagcgaagacgggtccatgtcaatcaaaaatgaggaagaggagcaaaccctaactattctgatcagaacaggacttctcgtcataagtggcctgttcccagttagcatccccattaccgcagccgcttggtacttgtgggaagtgaagaaacagagggctggtgtgttatgggatgtcccttctccaccccctgtggggaaggccgagctggaagacggagcgtatcgtatcaagcagaaaggcattctcggctactcccagatcggggctggagtttataaggagggtacttttcatacaatgtggcacgtaacccgcggcgccgtgctgatgcataaagggaagcggatagaaccgtcatgggcagatgtcaaaaaggaccttattagttacggaggcggttggaagctggagggggagtggaaagaaggagaggaagtgcaagttttggccctagagccaggcaagaaccccagagctgtgcagacgaaacctggcctgttcaagactaatgccgggaccatcggagcagtcagcctcgatttttccccaggtacatctggctcgcccatcattgacaaaaaggggaaggtggtaggactgtacggcaacggtgtcgtgaccaggaacgggagctatgtttcagctatcgcccagacagaaaaatccatagaggataatcctgagattgaagacgatatcttccgaaagaaacggcttactattatggacttacacccgggagcgggcaagaccaaacgctacctgcccgccatcgtgagagaggcaataaagaggggcctccggacgttgattctggctccaacacgagtcgtggccgctgaaatggaggaagcactcagagggctgcctatccgctatcagactcccgccatcagggccgagcataccggacgtgagattgttgatcttatgtgtcacgctacattcaccatgcggctgttgagtccaatcagagtgcctaactacaatctaattataatggacgaagcgcactttactgaccccgcatctatcgccgctaggggttatattagcacccgcgtcgagatgggcgaagccgcagggatcttcatgacagccacgccaccgggatcccgagatccttttccccaatcaaacgctccaatcatggacgaggagagagaaattcccgagcggtcttggaatagcggccatgaatgggtgactgatttcaagggtaaaaccgtatggtttgtgcctagtataaaggcggggaacgacatcgccgcatgcctgaggaaaaatggaaagaaagttattcagctctcccgcaagacattcgatagcgagtacgtcaagacccgtactaacgactgggattttgtggtgacaaccgacatctctgaaatgggcgctaatttcaaagccgagagagtcattgatccacggaggtgtatgaagcccgtaatcttaacggacggcgaggaacgcgtgatactggcagggcctatgccggttactcactcatccgccgctcagcgaagaggacggatcggtaggaaccccaaaaatgagaacgatcaatatatttacatgggcgaaccacttgagaatgacgaagactgcgcccattggaaggaggcgaaaatgctgctcgataacatcaatacacctgaggggattatccccagtatgtttgaaccagagcgcgaaaaggtggacgcaatagatggagagtacagattgaggggcgaagcccggaaaaccttcgtcgacctgatgcgtcgcggtgatctccctgtgtggctggcttataaggttgccgctgaggggattaactacgcagaccgaagatggtgttttgatggcatcaggaacaatcagattcttgaggaaaacgtggaggtcgaaatctggaccaaggagggagagcggaaaaagctaaaaccccgctggctggacgccagaatatatagcgatccattggctttaaaggagttcaaagagttcgccgcaggcaggaagtcgctgactctcaatctgatcacagaaatggggcggcttcctacctttatgacacagaaggcgcgagacgccctggataacctcgctgtgttgcacactgccgaggcaggaggtagagcttacaatcacgccctgtctgaactaccggagacgctggagaccctccttctgttaacattgctggcaactgtaaccggcgggattttcctctttctgatgtccggaaaaggcatcggtaagatgacacttgggatgtgctgcattatcaccgccagcgtgctgctctggtatgctcagatacaaccccattggattgcggcctcaatcatcttggagttctttctgattgttttactaatcccagagcctgaaaaacagcgcactccccaggacaaccagctgacgtacgtcgtgatagcaattctcaccgtggtcgctgccacaatggccaatgagatgggcttccttgaaaagactaaaaaggattttggactgggcagtatcgcaacccaacagccagagtctaacattttggacatcgacctgaggcctgcttccgcctggacactctatgcggttgctaccactttcataacacccatgctgcggcacagcatcgaaaattcaagtgtgaacgtaagccttacggccattgcaaatcaggccaccgtgctcatggggctgggaaagggttggccgttgtccaaaatggatatcggcgtcccactgttagctattgggtgttactctcaggtgaaccctatcactctaacagcagccctgctccttctggttgcgcattacgctattatcggacccggcttgcaagccaaggcaacccgtgaagcccagaaaagagctgccgcaggtataatgaagaatccaaccgtggacgggattacagtcatcgatctggaccccatcccttatgatccgaaatttgagaagcagctcggccaggtaatgctgcttgtgttatgcgttactcaagtgctgatgatgaggacgacctgggctctctgtgaagccttgacactggcgactggacccattagcaccctatgggagggcaacccagggcgcttctggaatacaaccatagccgtctccatggcaaacatctttcggggatcatacctggctggcgccggtctccttttctctattatgaagaatactacgaacacacgaagagggaccggaaacatcggcgaaactctgggtgagaaatggaagagtaggttgaatgcactgggcaaatcggagtttcagatttataagaaaagcgggatccaggaagtggaccgcaccctcgctaaggagggaataaaacggggcgaaacagatcaccatgccgtctccagagggtctgccaagctgcgttggttcgtggagaggaacatgatcactcctgagggaaaggttgtggacttaggctgcggtcgcgggggatggtcatactattgtggcggtcttaaaaatgtacgggaagtgaagggcctgaccaaagggggacccggccacgaggaacctattccaatgagcacatacgggtggaacctcgtccgactacaatccggagttgatgtgttctttacgccccctgagaagtgcgacaccctgttgtgtgatatcggcgaaagttctccaaatcccactgtcgaggcgggtagaacactgagggtgctcaaccttgtagagaattggctgaacaataacacccagttctgcattaaagtgttgaatccgtatatgcctagcgttatcgaaaagatggaggctctgcagcggaagtacgggggagcactcgtgcgcaacccattatcaagaaattccactcacgaaatgtactgggtcagtaacgccagcggcaatatagtgtcttccgtcaacatgatttcaaggatgctgatcaaccgatttacaatgaaacataagaaagctacctatgagcccgacgtggatcttggcagcgggacgcggaatatcggaattgaatcggaggttcctaacctggacataatcggtaagcgtattgagaaaatcaagcaggaacacgagacctcttggcattacgaccaagatcacccatataagacatgggcctaccacggcagttatgaaactaaacagaccgggtccgcaagctcaatggtaaatggagtggtcagactactcacaaagccctgggacgtgattccgatggttactcagatggccatgaccgatacaacccctttcggccagcaacgcgtgtttaaagagaaggtcgacactaggacgcaggaacccaaagagggtacaaagaagctgatgaaaatcaccgctgagtggttgtggaaggaactggggaaaaagaaaactccacggatgtgtaccagagaggagttcacacgcaaggtgaggtccaacgcggccctcggagcaatatttacggatgagaataaatggaagtctgctcgagaggccgtagaagacagccggttctgggagcttgtggataaggaaagaaacctgcatttagagggcaaatgcgaaacctgtgtttacaatatgatgggcaagagggagaaaaagctgggggagtttggaaaagcaaagggtagtcgcgccatctggtatatgtggttgggcgctcgtttcctcgaatttgaggccctggggttcctaaacgaagaccactggttttcccgggagaatagcctttctggagtcgaaggcgagggtctgcataagctcgggtacattctgagagatgtgagcaagaaagagggaggcgcgatgtacgcagacgatactgccggctgggacacaaggatcaccttggaagacctgaaaaacgaggaaatggtgactaatcacatggagggggaacataagaaactcgctgaggccattttcaaacttacatatcagaacaaagtcgttcgcgtgcagcgacctaccccacggggaacagtaatggatatcattagtagaagggaccaacgcggttccggccaggtggggacttacggactgaataccttcacgaacatggaggcacagttaataagacaaatggaaggcgagggtgtctttaaaagcatccagcacctgaccgctacagaagagattgccgtgcagaattggttgactcgggttgggagggagcgtctctctcgaatggctatctcgggagatgactgcgtggtcaagccactggatgaccgcttcgcctcagcactaaccgcgcttaacgatatgggcaaagtgagaaaggacatccagcaatgggaacccagcaaaggctggaacgattggacacaggtacctttttgctcccaccatttccacgagctgattatgaaggacgggcgggttctcgtggtcccatgtaggaatcaggatgaactgataggacgcgccagaatcagtcagggtgctggctggtctttgcgggagactgcctgcttagggaagtcatatgcacaaatgtggtccctgatgtactttcataggcgagacctccgtcttgctgccaacgcaatttgttcagccgtgccgagtcactgggtgcccacctctagaacgacatggagcatccacgcgaaacatgaatggatgaccactgaggatatgctgacagtctggaatcgcgtttggattcaggagaacccttggatggaagacaagaccccagtggagtcctgggaagagatcccctatctaggaaaacgggaagaccagtggtgcggctcactgataggtctcactagcagggctacctgggccaagaatatccagacagcaattaaccaagtaagatctttgatcgggaatgaggagtacacggattatatgccttccatgaaacgcttccggagggaagaggaagaggccggagtgctgtggtga

SEQ ID NO: 14289 - RNA, 9876 nt, synthetic construct
  misc_feature 1..9876: note = derived and/or modified CDS sequence (opt3) from DENV-2__KF744399__SS-prME
  source 1..9876: mol_type = other RNA
accgcaggcatgatcattatgctgataccaactgtgatggctttccacctcactacgcggaatggggaacctcatatgatcgtcagcaggcaggaaaaggggaaatcccttctgtttaagaccgaggacggtgttaatatgtgcacattgatggctatggatttaggcgaactgtgtgaggacactattacctacaaatgcccactactccggcaaaatgaaccggaggatatcgactgttggtgcaattctacatcaacctgggtgacttatgggacatgtaccacgactggggagcaccgccgagaaaagcgtagtgtcgccctggtgccccatgtcggcatgggtcttgagaccagaacagaaacttggatgagctccgagggggcgtggaaacacgctcagaggattgagacctggatcctgcggcatcctggattcacattgatggccgcaatactcgcctacaccatcggcacgactaactttcagcgcgctctgattttcatcctgctcacagcagtggccccatctatgaccatgagatgcattggcatctcgaatagggattttgttgaaggggtgtcaggaggtagctgggtcgacatagtgttagagcacggcagttgtgtaactacaatggctaagaacaagcccaccctggatttcgaacttattaaaacggaggccaagcaccctgcgaccttgcggaaatattgcatcgaagcaaagctgacaaatactaccacagagtcccgctgtccaactcagggggagccctctctaaacgaagaacaagacaaacgatttgtttgcaagcatagcatggtggatagaggatggggcaatggttgtggactcttcggaaagggcggcattgtaacctgcgccatgtttacatgcaaaaagaacatggaagggaaaatcgtgcagcctgagaatctggaatacaccatcgtgattactccacactccggagaggagaacgctgtcggtaatgacacgggcaagcatgggaaagaaataaaggttacaccgcagtcaagtatcaccgaggccgaacttactggatatggcaccgtgacaatggagtgtagccccaggaccggtctggggttcaacgaaatggtattgctccagatggagaataaagcatggctggtgcaccggcaatggtttttagatctgcctctcccatggcttcccggcgctgacactcagggatctaactggattcagaaggagacactggtcacgttcaagaaccctcacgccaaaaagcaggatgtggttgtgttgggctcccaagaaggggcgatgcataccgccctaactggagcaacagagatccagatgtcaagcggtaatctgctctttaccggccacctgaaatgccgtcttcgcatggacaagctgcagttgaaagggatgagttactctatgtgtacaggaaagttcaaggtcgtgaaagaaatagctgagactcaacatggcaccattgtagttagagtgcagtatgagggtgacgggtccccatgcaagatccccttcgaaatcatggatctcgagaaaaggcacgtcctgggccggttaattacggtgaacccgatcgtcaccgaaaaggacagccctgtgaatattgaggccgaacccccatttggagattcgtacgttataatcggcgtggagcctgggcagctgaaactatcttggttcaagaagggatcctcaattggtcagatgtttgagacaactatgcgaggcgctaaacgcatggccatcctcggggacaccgcatgggatttcggaagtctgggcggtgtatttacaagcatcgggaaggcccttcatcaagtcttcggcgctatttacggagcggcattttccggcgtgtcttggactatgaaaatattgatcggggttgtgattacctggatcggaatgaacagcagatcaacgagtctgtccgtcagcctcgtgctggtaggcgtggttacactttatctgggtgtcatggtgcaggccgactctgggtgtgtggtctcatggaagaataaagaattgaagtgcggaagtggcattttcatcaccgataacgttcacacttggacagagcagtacaagtttcagcccgaaagcccatccaaactcgcttctgccatacaaaaggcacaccaggagggtatctgtggcattaggtcggtgacccggctggaaaatttaatgtggaaacagatcactcccgagctgaaccatattctaagcgagaatgaagtgaagctcaccatcatgacaggggacataaaaggaattatgcacgccggcaagcgctccctgagacctcagccaacggagcttaggtattcatggaaggcttgggggaaagccaagatcttgagtaccgaactgcataaccaaactttcctcattgatggaccggagacagcagaatgccccaataccaaccgtgcgtggaactctctggaggtagaggactacggctttggtgtcttcacaactaacatctggttaaaactgcgggaaaagcaggatgctttttgtgacagcaaacttatgtccgccgcaataaaggacaatcgagccgtgcacgctgatatggggtattggatcgagtcagccttgaacgacacctggaaaattgaaaaggccagcttcatcgaggttaagtcttgccactggcctaaatcccatacgctctggagtaacggagtgctggagagcgaaatgattatcccaaagaatttcgctggccccgtctctcagcacaactacagacctggttatcatacacagaccgccggcccatggcacctagggaaactggagatggattttgacttctgtaagggaactaccgtggttgtgacagaagattgcggcaatagggggccctccctccgcactaccacagcgtcaggaaaactgataacggagtggtgctgtcggagttgcacccttccgcctttgagatacaggggcgaagacggttgttggtacgggatggagattcgcccactgaaggagaaggaagagaacttagtaaatagcctcgtcactgccggacatggccaaatcgataacttttcgctgggtgtgcttggcatggctctgttcttggaagagatgctccgaacacgggtggggaccaaacacgcaatcctgctagtcgccgtttcctttgtgactctgattacaggaaatatgtctttccgtgacctcggcagagtaatggtgatggtcggggctaccatgacggatgacatcggaatgggcgtgacttatctggcccttttggcagcgtttaaggttaggcccaccttcgccgctggtctgttactccgcaaactgacaagcaaggaacttatgatgaccactattgggatagtgctgctatcacagagtacaatccctgagaccattctcgagctgacagatgccttggcactgggaatgatggtcttaaaaatcgtgcggaagatggaaagataccagctcgctgttactattatggccatcctgtgcgtgcccaacgcagtcatacttcaaaatgcctggaaggtatcctgtaccatcctggctgtggtttctgtgagcccattgctcctgacgtcctcacagcagaaagcggactggattcctctagccctgacaatcaagggccttaaccccaccgcaatttttctcactaccctgagcaggacaagtaaaaagcgatcttggccattgaatgaggctatcatggccgtcggcatggtgtccatactggccagctcgttactcaaaaacgatattccgatgactgggcctctggtagctggaggtcttctgaccgtgtgctatgtcttgacgggccgctcagcagacctcgaactggagaaggccgcggacgttcggtgggaagaacaggctgagatctctgggagttcccccatcctaagcattataatctctgaagatggaagcatgtccattaaaaatgaggaagaggagcaaacactgaccatccttattagaactggcctcctggtgatctcaggtttgttcccagtgagtatacccatcacagccgcagcctggtacttatgggaagtcaagaagcagagggctggggtgctgtgggacgttcctagcccaccccctgtaggaaaagcagagctcgaagatggcgcctatcgtattaagcagaaaggcatcctggggtactctcagattggagcgggtgtgtataaggagggcacctttcacactatgtggcatgtcacacgcggggctgtgcttatgcacaaaggaaagcggctggaaccgtcctgggccgacgttaagaaagatttgatctcatacggcggtgggtggaagctagagggagagtggaaagaaggcgaggaagtgcaagtcctggcactcgagccaggcaagaaccccagagccgtgcagaccaaacctgggctgttcaagacgaatactggaaccataggtgctgtaagtcttgactttagcccaggcacatccgggtctcccattatcgataagaaaggaaaggtcgtgggcttatacggtaacggggttgtgaccaggaacggatcgtatgtcagcgccatcgcacagacagaaaaatcaattgaggacaatcctgagatcgaagatgacatattccgaaagaaacggctgactattatggatctccatccgggcgctggcaagaccaagcgctacttgcccgccatcgtgagagaggcgattaaaagggggctgcggacgctcatcctggccccaacacgagttgtggcagctgaaatggaggaagcccttagaggactgcctatacgctatcagactcccgctattagggcagagcacaccggtcgtgagatcgtcgacttgatgtgtcatgccacattcaccatgcggctactgtccccaatcagagtgcctaactacaatctcattatcatggatgaagcccactttactgaccccgctagtattgcggcaaggggctatatatctacccgcgtagagatgggggaagccgctggaatcttcatgacagccacgccaccgggcagccgagacccttttccccaatccaacgcaccaattatggatgaggagagagaaatccccgagcggtcatggaactctggtcacgaatgggtgactgacttcaaggggaaaaccgtttggtttgtccctagcatcaaggccggaaacgatattgctgcgtgcttaaggaaaaatggcaagaaggtgatacagctgagtcgcaaaacattcgactccgagtacgtgaagacccgtactaacgattgggactttgtcgtaacaaccgatatcagcgaaatgggcgccaatttcaaagcagagagagtgattgacccacggaggtgtatgaagcccgttatccttacggatggggaggaacgcgtgattctggctggacctatgccggtcactcattcttcagccgcacagcgaagaggtcggatcggcaggaaccccaaaaatgagaacgaccaatatatatacatgggggaacccctcgagaatgatgaagactgcgcccactggaaggaggctaaaatgttgctggacaacatcaatacacctgagggaattatcccctccatgtttgaaccagagcgcgaaaaggtggatgccattgacggcgagtacagactcaggggtgaagcgcggaagaccttcgttgatctgatgcgtcgcggggaccttcctgtgtggctagcatataaagtcgccgctgagggcatcaactacgccgatcgaagatggtgttttgacggaataaggaacaatcagattctggaggaaaacgtggaggtagaaatctggaccaaggagggcgagcggaaaaagttgaaaccccgctggttagatgctagaatttatagtgacccactggcactcaaggagttcaaggagttcgccgctgggaggaaaagcctgactcttaatctgatcacagaaatgggacggctccctacctttatgacacagaaggcccgagatgcattggacaacctggcggtgctacatactgccgaggctggtggcagagcctacaatcacgcactgtcggaactcccggagacgcttgagaccctgttattgctgacactcctggctactgttaccgggggaatattcctttttctgatgtctggcaaaggtatcgggaagatgacactcggcatgtgctgcattatcaccgcctccgtcttgctgtggtatgcacagattcaaccccactggatcgccgctagcataattttagagttctttctaatcgtgctgctcatcccagagcctgaaaaacagcgcactccccaggataaccagcttacgtacgtggtcattgcgatcctgaccgttgtggccgcaacaatggctaatgagatgggattcttggaaaagactaagaaagactttggcctggggtcaatagccacccaacagccagagagtaacattctcgatatcgacctgaggcctgcctctgcatggacactttatgctgtagccaccactttcattacacccatgctccggcattccatcgagaatagctcagtgaacgtcagtctgacggcgatagctaatcaggccaccgtgttgatgggactgggtaagggctggccgttaagcaaaatggacatcggggttccactactggcaattggatgttactcccaggtgaaccctatcactctcacagccgcacttctgttgctggtcgcacactacgccattatcggccccggtctccaagcgaaggctacccgtgaagcccagaaaagagcagccgctgggattatgaagaatccaaccgtagatggcatcacagtgatagacctggatcccattccttatgacccgaagtttgagaaacagcttggacaggttatgttactggtgctctgcgtcactcaagtgttgatgatgaggacgacctgggccctgtgtgaagcactaacactggctactggccccatctctaccctctgggaggggaacccaggacgcttctggaatacaaccatcgccgtcagcatggcgaacatttttcggggctcctaccttgccggtgcagggctgttgttctcaataatgaagaatactacgaacacacgaagaggaaccggcaacatcggtgaaactctgggcgagaaatggaagtctaggctcaatgctctggggaaaagtgagtttcagatttataagaaatcgggaatccaggaagtggatcgcaccttagccaaggagggcattaagagaggggaaacagaccatcacgcagttagcagaggatccgctaaacttcgttggttcgtggagaggaacatggtaactcctgagggcaaggtggtcgatctgggttgcgggcggggaggctggtcttactattgtggtggcctcaaaaatgttcgcgaagtgaaggggctaaccaaaggaggccccgggcatgaggaacctatcccaatgtcaacatacggatggaacctggtccgattgcaaagcggcgtggacgtattctttacgccccctgagaagtgcgataccctgctctgtgacataggtgaatccagtccaaatcccactgtggaggccgggagaacacttagggttctgaacttggtggagaattggctgaacaataacacccagttctgcatcaaggtcctcaatccgtatatgccttctgtgattgagaaaatggaggccttacagcggaagtacggaggcgcgctggtccgcaacccacttagcagaaattcaactcacgaaatgtactgggtgtccaacgctagtggcaatatcgttagctctgtaaacatgatttccaggatgctgatcaaccgatttacaatgcggcacaaaaaggcaacctatgagcccgatgtggacctagggtcaggaacgcgtaatataggtattgaaagcgagatccctaacctcgatatcattggcaaaagaatagagaagatcaagcaggaacatgagacctcgtggcactacgaccaagaccatccatataaaacatgggcctaccacgggtcttatgaaactaagcagaccggaagtgcttccagcatggtcaatggcgtggttcgcctgttgacaaaaccctgggatgtgattccgatggtcactcagatggccatgaccgacacaacccctttcggtcagcaaagggtgtttaaggagaaagtagatactcggacgcaggaacccaaggaggggacaaagaaactgatgaagatcaccgcagagtggctctggaaagaacttggaaagaaaaagactccaagaatgtgtacccgcgaggagttcacaaggaaagtgcgatcaaacgccgctctgggcgcgatttttacggacgagaataagtggaagtccgcccgggaggcagttgaagattctagattctgggagttagtcgacaaagaaaggaacctgcacttggagggcaagtgcgaaacctgtgtgtacaatatgatggggaaacgcgagaagaaactcggagagtttggtaaggctaagggcagccgtgccatctggtatatgtggctgggggcacggttcctagaatttgaggcccttggattcctgaacgaagatcattggtttagtagagaaaattccctcagcggcgtggaaggtgaggggctgcacaaattgggatacatactgagggaggtctctaagaaagaaggcggcgctatgtacgccgacgatactgcggggtgggacacacgcatcaccctcgaggatcttaagaacgaagagatggttactaatcatatggaaggagagcacaaaaagctggcagaggccattttcaagttaacatatcagaacaaagtggtacgagtgcagcggcctacccccagaggtacagtcatggacatcatttcaaggcgcgaccaaagaggcagtggacaggtgggaacttacggcctgaataccttcacgaacatggaagctcagttgatccggcaaatggagggtgaaggggtttttaagtccattcagcatctcaccgccacagaggagaatgcagtgcagaactggctggctagggtcggacgtgaacgactaagccgcatggccatatctggcgatgactgcgtggtaaaaccacttgatgacagattcgcttcggccctgactgcactcaacgatatgggcaaggttcggaaagacatccagcaatgggagccctcaagggggtggaatgattggacccaggtgcctttttgcagccaccacttccatgaactgattatgaaggacggacgcgtcttggtggtgccatgtagaaaccaggatgagttaatcggtcgggcgaggatctcccagggcgccgggtggagtctgcgagaaacagcttgcctcggaaagtcttatgcccaaatgtggagccttatgtactttcaccgtagagacctgcgcctagcagctaatgccatttgttccgcagtcccgtcacattgggttcccacaagtcggaccacgtggtctatacacgccaaaaacgagtggatgacaaccgaggatatgctgactgtgtggaatagggtatggatccaggaaaacccttggatggaggacaagacaccagtggaaagctgggaggaaattccctatctcggcaaaagagaggatcagtggtgcggttccttgatcgggctgacctcacgcgcgacttgggctaagaatattcagaccgccatcaaccaagtccggagccttataggaaatgaggaatacacagactatatgccttctatgaaaaggttccgaagagaggaagaggaagcaggcgtgctgtggtga

SEQ ID NO: 14290 - RNA, 9876 nt, synthetic construct
  misc_feature 1..9876: note = derived and/or modified CDS sequence (opt3) from DENV-2__JX286516__SS-prME
  source 1..9876: mol_type = other RNA
accgccggcgtgatcgtaatgctgattcccacagctatggcattccacctcactacgcggaacggggaacctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtatagtgacaatggagtgtagtcccaggaccgggcttgatttcaacgaaatggtactgttgcaaatggaggacaaagcatggctcgtgcaccggcagtggtttctggatttacctctgccatggctccccggcgctgacactcagggaagcaattggattcagaaggagacacttgtcacgttcaagaaccctcatgccaaaaagcaagacgtggttgtgctgggctctcaggaaggggcgatgcacaccgccttgactggagcaacagagatccagatgtcctcaggtaatctactgtttaccggccatctcaaatgccgtctgcgcatggataaacttcaactgaaagggatgagctacagtatgtgtacaggaaagttcaagatcgtcaaagaaattgctgagactcagcacggcaccatcgtgattagagtacagtatgagggtgacgggtctccatgcaagatacccttcgaaatcacggatttggagaaaaggcatgttctcggccggctgattaccgtgaacccgatcgtcacagaaaaggactcccctgtgaacatcgaggccgaacccccatttggagatagctacattatagtcggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccatggtacaggctgactccgggtgtattgtgagctggaagaataaagaactgaagtgcggatctggcatcttcataactgataacgttcacacatggaccgagcagtacaagtttcaacccgaatcaccaagtaaattggccagcgcaattcagaaggcccatgaggaaggtatctgtggcattaggtccgtcactcggctcgagaatctgatgtggaaacagatcacccccgagttaaaccacatactgtctgaaaatgaggtgaagctaacaatcatgacgggggacattaaaggaatcatgcaggctggcaagcgctcgctcagacctcaaccaaccgaactgaaatatagctggaagacttgggggaaggccaaaatgctttccacagagtcacataaccagaccttcttgattgatggaccggaaacagcagagtgccccaatactaacagggcgtggaatagtctggaggtggaagactacggctttggtgtcttcaccacgaacatctggctcaagctgcgtgagaaacaggacgtattttgtgattctaagttaatgagcgctgccataaaagacaatcgggcagtgcacgccgatatggggtattggattgaatccgctctgaacgacacatggaagatggagaaggcctcattcatcgaggtgaaaagctgccactggcctaagtctcataccctttggtccaatggagtattggaaagtgagatgatcattcccaagaatttcgcaggccccgtcagccagcacaactaccgacctggttatcatactcaaaccgctggcccatggcacctcgggaagctggaaatggattttgacttctgtgagggaacaactgtggttgtgaccgaagattgcggcaatagagggccctctctaaggacaacgaccgcctccggaaaactgatcactgagtggtgctgtcgctcatgcacactcccgcctctgcggtacagaggcgaggacggttgttggtacgggatggaaattaggccacttaaggagaaggaagagaacttggtcaatagtctggtgaccgcgggacatggccagatagataactttagcttaggtgttctcggcatggccctgttccttgaagagatgctgcgcactcgagtggggacaaaacacgctatcttgctcgtagcactgtcgtttgtcaccctaattacgggaaatatgtccttccgggacctgggccgtgtgatggtgatggtcggggccactatgaccgatgacatcggaatgggcgttacatatctcgctctgcttgccgcatttaaggtgagacccaccttcgcggccggtttgctgttaaggaaactcacttctaaggagctgatgatggctacaattgggatcgcccttctgagccagtcaaccctacctgaaacaatactcgagctgactgatgcattggctctgggaatgatggccttaaaaatcgtacgcaacatggaaaagtaccaactcgcagtgaccattatggccatcagttgcgtccccaatgctgtgattctgcagaacgcgtggaaggtttcctgtacgatccttgccgcagtgtctgtcagcccactgttgctcacatcctcacagcagaaagctgactggatacctctggccctaaccattaagggcctgaatcccactgccatctttcttaccacactcagccggacaagtaaaaagagatcttggccactgaacgaggctatcatggcagtgggcatggtttccattttggccagctcgctgctaaagaatgacataccgatgaccgggcctctcgtggcgggaggtctgcttacggtctgctatgtactgacaggcaggtcagctgatttggaactcgagcgagccgcagacgtgaagtgggaggatcaagccgaaatctctgggagttcccccattctgagcatcaccatttctgaggacggaagcatgtccatcaaaaacgaagaggaggaacagactctaacaatactgatccgcaccggccttctcgttatttcaggtgtgttcccagtcagtatccccattactgctgcagcctggtacctgtgggaggtgaagaagcagcgggcgggggtattgtgggatgtgcctagcccaccccctgtcggaaaagctgaattagaggacggcgcctatagaatcaagcagaggggcatactggggtactctcaaattggagccggtgtttataaagaaggcacatttcacaccatgtggcatgtgacgcgtggggcagtgctcatgcaccgcggaaagcggatcgagccgtcctgggctgatgtcaaaaaggacctgatctcatacggcggtgggtggaaacttgagggagaatggaaagagggcgaagaggtgcaggttctggccttggaaccaggcaagaatcccagagcagtacagactaaacctgggattttcaagaccaacacaggaaccatcggtgctgtgagtctagattttagcccaggcacatccgggtctcccatagtcgacaggaaaggaaaggtggttggcctgtacggtaatggggtggtcactcgatcgggagcctatgtgagcgcgattgcccagaccgagaagtcaatcgaggataaccctgaaattgaggacgatatcttccggaaaaagcgcctcacgataatggacctgcatccgggcgcaggcaaaacaaagagataccttcccgctattgtaagggaagccatcaaacgggggttacgaactctgatcctcgctccaaccagagtcgtggcagccgagatggaagaggccttgcgcggactgcctattaggtatcaaacacccgctatccgtgcggagcacaccggtcgggaaattgttgacctcatgtgtcatgcaactttcaccatgagactgctttccccagtgagggtccctaactacaatctgataatcatggatgaggcccactttacagaccccgctagtattgccgcacgcggctatatctctacgcgagtggaaatgggggaggccgctggaatcttcatgactgcgaccccaccgggcagcagagatccttttccccagtccaacgccccaattatggacgaggaacgggagatacccgaaaggtcatggaactctggtcacgagtgggttacagatttcaaggggaagaccgtgtggtttgtccctagcatcaaagcaggaaacgacattgctgcctgcttgcgcaagaatggcaaaaaggtgatccagctaagtcgtaaaactttcgattccgaatacgtaaagacaagagcaaacgactgggattttgtggttaccacggacattagcgagatgggcgccaatttcaaggctgagcgggtcatcgatccaaggcgctgtatgaaacccgtgatactgactgacggggaagaacgagtgatcctcgccggacctatgccggtcacacattcttcagcggcacaaagacggggtaggattggccgcaacccaaagaatgaaaacgaccagtatatctacatgggggagcccttagaaaatgatgaggactgcgcccactggaaagaggctaagatgctgcttgataacattaatacccctgaaggaatcataccctccatgtttgagccagaaagagagaaagtagacgccattgatggcgaatacaggctgcggggtgaggctcgtaagaccttcgtggacctcatgcgccgaggggatttgcctgtttggctggcatataaagtggccgctgagggcatcaactacgccgacagaaagtggtgttttgatggaattaagaataaccagatcctcgaagagaacgtcgaagtggagatatggactaaagagggcgaaaggaagaaactgaagccccggtggcttgacgcacgcatctatagtgatccactagcgctgaaagggttcaaggagttcgccgctggaagaaagagcttgacattaaatctgattaccgaaatgggtaggctccctacatttatgactcagaaagcccggaacgcactggacaatcttgctgttctgcatacggccgaggtgggcgggaaggcatacacccacgccctctcggaattgccggagacactggagactctactgctccttaccctgttagctgcggtcacaggaggcatcttcttgtttctgatgtctggtaaagggattggcaagatgaccctcggaatgtgctgcatcataactgcctccattctgctttggtatgcacaaatccagccccactggatcgctgccagcattatcctggagttctttctcatagtgttgctgattccagagcctgaaaaacagcgaacgccccaggataaccaattaacctacgtagtgatcgccattctaacagttgtcgcagctactatggccaatgagatgggcttcctggaaaagaccaagaaagacctcgggtttggatcaatcacaacccaggagagtgagtctaacatacttgacatcgatctgagaccagcgtccgcttggactttgtatgccgtggcaacaacgttcgtgacccctatgctgcgccatagcattgaaaattcaagtgtcaacgttagcctcactgccatcgctaatcaggcaacagtgctgatgggtcttggcaaggggtggcccctctccaaaatggacattggagtaccgctgttggccatcggctgttactctcaggtgaacccaattaccctgaccgcggctttactactgctcgtcgcccactacgcaatcataggtcctgggcttcaagccaaggctacaagggaggcccagaaacgggcagctgccggcattatgaagaatcccactgtggatggaatcacggttatcgacctggaaccaattccctatgatcctaagtttgagaaacagttgggccaggtgatgctgctcatactgtgcgtcacccaagtacttatgatgcgtacaacttgggcgttatgtgaagccctgaccctcgcaacagggccgatcagcaccttgtgggagggaaaccccggcagattctggaatactacgattgctgtgtccatggccaacatctttaggggttcatacctggcaggggctggactactgttctctattatgaagaatacaaccaacactcgccggggcaccggtaatgttggcgagacactcggggaaaaatggaagagtcgacttaacgccctgggaaaatcggagtttcagatctataagaaaagcggcatacaggaagtggacagaactttggccaaggaggggatcaagaggggagagaccgatcatcacgcggtctcccgcggctctgctaaactgcggtggttcgtggaaagaaacatggtcacaccagagggtaaggtggttgacctcgggtgcggacgtggcggttggtcatactattgtggcgggctgaaaaatgtgagggaagtaaagggattaacgaaaggcgggcctggacatgaggaacccattcctatgagcacctacggctggaaccttgtgcggctgcaatccggtgtcgatgttttctttactccacccgagaagtgcgacacactcctatgtgatatcggggagagttctcctaatccaaccattgaagcaggacgcactctgcgagtgttgaacctggtcgagaattggctcaacaataacacacagttctgcatcaaggtgcttaatccctatatgccgagcgtaatagagaaaatggagaccctgcagagaaagtacggcggcgccttggtgaggaaccctctgtcaagaaattccacgcacgaaatgtactgggttagtaacgctaccgggaatattgtgagctctgtcaacatgatctcccgcatgctcatcaatagatttacaatgaaacacaagaaagccacttatgagccagacgtggatttaggatcaggtaccaggaacattggcatagagagcgaaatccccaacctggacattatcgggaagcgaattgagaagatcaaacaggaacatgagacatcgtggcactacgaccaagatcatccttataagacttgggcataccacggatcttatgaaaccaaacagacaggcagtgcctccagcatggtcaatggtgtggttcggcttctgaccaagccatgggacgtagtgcccatggtcactcagatggctatgacggatacaaccccgttcgggcagcaacgtgtgtttaaagagaaggttgacactagaacccaggagcctaaggaaggaacgaaaaagctaatgaaaataacagcggagtggctctggaaggaactgggcaaagagaagaccccacgcatgtgtactagggaggagttcacacggaaagtgagatcaaacgccgcattgggcgctgtctttaccgatgagaataagtggaagtccgcccgcgaagcagtggaggacgggaggttctgggaactggtagatcgagagcggaacctccaccttgagggaaaatgcgaaacttgtgtgtacaatatgatgggtaagagagagaaaaagctgggcgaatttgggaaagccaagggatctagggctatctggtatatgtggttaggcgcccgcttcctggagtttgaagcgttgggtttcctcaacgaggaccattggtttagccgtgggaatagtctgtccggagttgagggcgaaggcctacaccggcttgggtacattctgagagaggtcggaaagaaagaaggtggcgcaatgtacgccgatgacacagctgggtgggataccaggatcacactcgaggacctgaagaacgaagagatggtgactaatcatatgaaaggagagcacaagaaattggccgaagcaattttcaagctgacctatcagaacaaggtggtccgcgttcagcgaccaacgcctcggggcaccgtgatggacatcattagcagaaaagatcaaaggggttctgggcaggtaggaacatacggcctcaatactttcaccaacatggaggctcagcttatacgccaaatggaaggcgaggggatctttaagtcaattcagcatctgacagccactgaggaaatcgctgtgcagaattggttagccagagtcggacgggagaggctgagtcgtatggcaatctccggtgacgattgcgtggttaaacccattgacgatcgattcgcgagcgccttgaccgctctcaacgacatgggcaaggtgcgcaaagatatacagcaatgggaaccatctagagggtggaatgactggacgcaggtccccttttgctcgcaccacttccatgagctggtgatgaaggatggacgggtcttagttgtgccttgtaggaaccaggacgaacttatcggccgcgccagaatttcacagggtgcagggtggagcctgaaggagacagcttgcctcggaaaatcctatgcccaaatgtggaccctgatgtactttcaccggagggatttgcgattagcagccaacgcgatctgtagtgctgtcccatctcattgggtgccgactagccgtacaacctggtccattcacgccaagcacgagtggatgactaccgaagacatgctggcagtgtggaatagagtctggatccaggagaacccctggatggaagataaaacacctgttgagtcatgggaagaggtgccatatctcggcaagcgcgaggaccagtggtgcggcagtcttatagggctgacgtctcgggccacctgggctaaaaatatccagactgccattaaccaagtaaggagcctaatcggaaatgaaggttacacagactatatgccctccatgaagagattccgccgggaggaagaggaagcaggcgtgctgtggtga

SEQ ID NO: 14291 - RNA, 9876 nt, synthetic construct
  misc_feature 1..9876: note = derived and/or modified CDS sequence (opt3) from DENV-2__JX286518__SS-prME
  source 1..9876: mol_type = other RNA
accgcaggcgtgatcgtaatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataaacttcaactgaaagggatgagctacagtatgtgtactggaaagttcaagatcgtcaaagaaatcgctgagacccagcacggcacgattgtgatcagagtacagtatgagggtgacgggtctccatgcaagattcccttcgaaataaccgatttggagaaaaggcatgttctcggccggctgatcacagtgaacccgattgtcactgaaaaggactcccctgtgaacatcgaggccgaacccccatttggagatagctacatcattgtcggcgtggagcctgggcagttaaaactgaattggttcaagaagggatcgtctataggtcaaatgtttgagaccacaatgcgaggcgctaaacgcatggccatcctaggggacactgcatgggatttcggatccctcggcggtgtttttacctcaattgggaaggccctgcaccaggtgttcggcgctatctacggagcggcatttagtggcgtaagctggacgatgaaaattcttatcggggtcataatcacatggattggaatgaactccagatctaccagcttgtcagtgagtctggttctcgtgggcgtcgtgactctgtatcttggtgccatggtacaggctgactccgggtgtatcgtgagctggaagaataaagaactgaagtgcggatctggcattttcatcacagataacgttcacacctggactgagcagtacaagtttcaacccgaatcaccaagtaaattggccagcgcaatacagaaggcccatgaggaaggtatttgtggcatcaggtccgtcacccggctcgagaatctgatgtggaaacagattacacccgagttaaaccacatcctgtctgaaaatgaggtgaagctaacgataatgaccggggacatcaaaggaattatgcaggctggcaagcgctcgctcagacctcaaccaactgaactgaaatatagctggaagacatgggggaaggccaaaatgctttccaccgagtcacataaccagacattcttgatcgatggaccggaaactgcagagtgccccaataccaacagggcgtggaatagtctggaggtggaagactacggctttggtgtcttcacgacaaacatttggctcaagctgcgtgagaaacaggacgtattttgtgattctaagttaatgagcgctgccatcaaagacaatcgggcagtgcacgccgatatggggtattggatagaatccgctctgaacgacacctggaagatggagaaggcctcattcattgaggtgaaaagctgccactggcctaagtctcatactctttggtccaatggagtattggaaagtgagatgatcatccccaagaatttcgcaggccccgtcagccagcacaactaccgacctggttatcatacccaaacagctggcccatggcacctcgggaagctggaaatggattttgacttctgtgagggaactaccgtggttgtgacagaagattgcggcaatagagggccctctctaaggacgaccactgcctccggaaaactgattacagagtggtgctgtcgctcatgcaccctcccgcctctgcggtacagaggcgaggacggttgttggtacgggatggaaatcaggccacttaaggagaaggaagagaacttggtcaatagtctggtgactgcgggacatggccagattgataactttagcttaggtgttctcggcatggccctgttccttgaagagatgctgcgcacacgagtggggaccaaacacgctatattgctcgtagcactgtcgtttgtcacgctaatcactggaaatatgtccttccgggacctgggccgtgtgatggtgatggtcggggccaccatgacagatgacattggaatgggcgttacctatctcgctctgcttgccgcatttaaggtgagacccactttcgcggccggtttgctgttaaggaaactcacatctaaggagctgatgatggctaccatcgggattgcccttctgagccagtcaacactacctgaaactatcctcgagctgaccgatgcattggctctgggaatgatggccttaaaaatagtacgcaacatggaaaagtaccaactcgcagtgacgatcatggccattagttgcgtccccaatgctgtgatcctgcagaacgcgtggaaggtttcctgtacaattcttgccgcagtgtctgtcagcccactgttgctcacctcctcacagcagaaagctgactggatccctctggccctaactataaagggcctgaatcccaccgccatttttcttacaactctcagccggaccagtaaaaagagatcttggccactgaacgaggctatcatggcagtgggcatggtttccatcttggccagctcgctgctaaagaatgacattccgatgacggggcctctcgtggcgggaggtctgcttacagtctgctatgtactgaccggcaggtcagctgatttggaactcgagcgagccgcagacgtgaagtgggaggatcaagccgaaatatctgggagttcccccatcctgagcattactatctctgaggacggaagcatgtccattaaaaacgaagaggaggaacagacactaaccatcctgatacgcactggccttctcgttatctcaggtgtgttcccagtcagtattcccatcacagctgcagcctggtacctgtgggaggtgaagaagcagcgggcgggggtattgtgggatgtgcctagcccaccccctgtcggaaaagctgaattagaggacggcgcctatagaattaagcagaggggcatcctggggtactctcaaataggagccggtgtttataaagaaggcacctttcacacgatgtggcatgtgactcgtggggcagtgctcatgcaccgcggaaagcggattgagccgtcctgggctgatgtcaaaaaggacctgatctcatacggcggtgggtggaaacttgagggagaatggaaagagggcgaagaggtgcaggttctggccttggaaccaggcaagaatcccagagcagtacagaccaaacctgggatcttcaagacaaacaccggaacaattggtgctgtgagtctagattttagcccaggcacttccgggtctcccatcgtcgacaggaaaggaaaggtggttggcctgtacggtaatggggtggtcacccgatcgggagcctatgtgagcgcgatagcccagacggagaagtcaattgaggataaccctgaaatcgaggacgatattttccggaaaaagcgcctcacaatcatggacctgcatccgggcgcaggcaaaactaagagataccttcccgctatagtaagggaagccattaaacgggggttacgaaccctgatcctcgctccaacaagagtcgtggcagccgagatggaagaggccttgcgcggactgcctatcaggtatcaaacccccgctattcgtgcggagcacactggtcgggaaatcgttgacctcatgtgtcatgcaaccttcacaatgagactgctttccccagtgagggtccctaactacaatctgattataatggatgaggcccactttacggaccccgctagtatcgccgcacgcggctatatttctactcgagtggaaatgggggaggccgctggaatcttcatgaccgcgacaccaccgggcagcagagatccttttccccagtccaacgccccaatcatggacgaggaacgggagattcccgaaaggtcatggaactctggtcacgagtgggttaccgatttcaaggggaagactgtgtggtttgtccctagcataaaagcaggaaacgacatcgctgcctgcttgcgcaagaatggcaaaaaggtgattcagctaagtcgtaaaacattcgattccgaatacgtaaagaccagagcaaacgactgggattttgtggttacgactgacatcagcgagatgggcgccaatttcaaggctgagcgggtcattgatccaaggcgctgtatgaaacccgtgatcctgacagacggggaggaacgagtgatactcgccggacctatgccggtcacccattcttcagcggcacaaagacggggtaggatcggccgcaacccaaagaatgaaaacgaccagtatatttacatgggggagcccttagaaaatgatgaggactgcgcccactggaaagaggctaagatgctgcttgataacatcaatacccctgaaggaattatcccctccatgtttgagccagaaagagagaaagtagacgccatagatggcgaatacaggctgcggggtgaggctcgtaagactttcgtggacctcatgcgccgaggggatttgcctgtttggctggcatatagagtggccgctgagggcattaactacgccgacaggaaatggtgttttgatggaatcaagaataaccagattctcgaagagaacgtcgaagtggagatctggacaaaggagggcgaacggaaaaagctgaaaccccgctggcttgacgcaagaatatatagtgatccactagcgctgaaggagttcaaagagttcgccgctgggagaaagagcttgaccttaaatctgatcacagagatgggacggctccctacttttatgacgcagaaggcccgaaacgcactggacaatcttgctgttctgcataccgccgaagtgggtggcaaagcatacacacacgccctctcggagttgccggagactctggaaaccctactgctccttacactgttagctgcggtcaccgggggaattttcttgtttctgatgtctggcaagggtatcgggaaaatgactctcggcatgtgctgcattatcacggcctccatactgctttggtatgcacaaattcagccccactggatcgctgccagcatcattctggagttctttctcatcgtgttgctgataccagaacctgagaagcagagaaccccacaggataaccaattaacatacgtagtgattgccatcctaactgttgtcgcagctaccatggccaatgaaatgggattcctggagaaaacaaagaaggacctcggctttgggtcaattaccactcaggagagtgaatctaacatccttgacatagatctgcgcccagcgtccgcttggacattgtatgccgtggcaacgaccttcgtgactcctatgctgaggcatagcatcgaaaattcaagtgtcaacgttagcctcacagccattgctaatcaggcaaccgtgctgatgggacttggtaaaggctggcccctctccaagatggacatcggggtaccgctgttggccattggatgttactctcaggtgaacccaatcaccctgacagcggctttactactgctcgtcgcccactacgcaattatcggccctggtcttcaagccaaagctactcgggaagcccagaagcgtgcagctgccgggataatgaaaaatcccacggtggatggcattaccgttatcgacctggagccaatcccctatgatcctaagtttgaaaagcagttgggacaggtgatgctgctcattctgtgcgtcacacaagtacttatgatgagaactacctgggcgttatgtgaggccctgacactcgcaaccggcccgataagcactttgtgggaggggaaccccggaaggttctggaatacgacaatcgctgtgtccatggccaacatttttcgcggctcatacctggccggtgctgggctactgttctctatcatgaaaaataccactaacacccggcgaggaacaggcaatgttggtgaaactctcggcgagaagtggaaaagtagacttaacgccctggggaagtcggaatttcagatttataaaaagagcggaatccaggaggtggacaggaccttggccaaagagggcataaagcgcggggaaacagatcatcacgcggtctcccggggatctgctaagctgagatggttcgtggagcgtaacatggtcacgccagaaggcaaagtggttgacctcggttgcgggaggggaggctggtcatactattgtggtggcctgaagaatgtgcgggaggtaaaagggttaaccaagggaggccctgggcatgaggaacccatccctatgagcacttacggatggaaccttgtgcgcctgcaatccggcgtcgatgttttctttacaccacccgagaaatgcgacaccctcctatgtgatattggtgaaagttctcctaatccaactatcgaggcagggcgaacactgagagtgttgaacctggtcgaaaattggctcaacaataacacccagttctgcattaaggtgcttaatccctatatgccgagcgtaatcgagaagatggaaacgctgcagaggaaatacggaggcgccttggtgcggaaccctctgtcacgcaattccacccacgagatgtactgggttagtaacgctacaggcaatatagtgagctctgtcaacatgatttccagaatgctcatcaataggtttactatgaagcacaaaaaggccacctatgagccagacgtggatttagggtcaggaacacgaaacatcggtattgaaagcgagatacccaacctggacatcattggcaaacggatcgaaaagattaagcaggagcatgaaacttcgtggcactacgaccaagatcatccttataaaacctgggcataccacgggtcttatgagacaaagcagaccggaagtgcctccagcatggtcaatggcgtggttcgtcttctgactaaaccatgggacgtagtgcccatggtcacgcagatggctatgacagataccactccgttcggtcagcaaagagtgtttaaggagaaagttgacacccgcacacaggaacctaaggaggggacgaagaaactaatgaagatcaccgcggaatggctctggaaagagctgggaaaggagaaaactcccaggatgtgtacacgggaagagttcaccagaaaggtgcgctcaaacgccgcattgggcgctgtctttactgatgaaaataaatggaagtccgccagggaggcagtggaagacggccgattctgggagctggtagatcgggagagaaacctccaccttgaagggaagtgcgagacatgtgtgtacaatatgatgggaaaaagggaaaagaaactgggtgagtttggcaaggccaaagggtctcgcgctatatggtatatgtggttaggagcccgtttcctggaatttgaggcgttgggcttcctcaacgaggaccattggtttagccggggtaatagtctgtccggggttgaaggagagggcctacacagacttggctacatcctgagggaagtcgggaagaaggagggaggtgcaatgtacgccgatgacaccgctggctgggatacacgcattactctcgaagacctgaaaaacgaggagatggtgaccaatcatatgaagggggaacacaaaaagttggccgaggcaatcttcaaactgacgtatcagaacaaggtggtccgagttcagcggccaacccctagaggaacagtgatggacattatcagcaggaaggatcaacgcggctctggtcaggtagggacttacggactcaataccttcacaaacatggaagctcagcttattagacaaatggagggcgagggcatatttaaatcaatccagcatctgactgccaccgaagagattgctgtgcagaattggttagcccgggtcgggagggaacgtctgagtcgaatggcaatctccggagacgattgcgtggttaagcccatcgacgatcgcttcgcgagcgccttgacggctctcaacgacatgggtaaagtgagaaaggatattcagcaatgggagccatctcggggctggaatgactggacacaggtccccttttgctcgcaccacttccatgaactggtgatgaaagatgggagggtcttagttgtgccttgtcgcaaccaggacgagcttataggaagggcacggatctcacagggcgcaggttggagcctgaaggagaccgcttgcctcgggaagtcctatgcccaaatgtggactctgatgtactttcacaggcgagatttgcgtttagcagccaacgcgatttgtagtgctgtcccatctcattgggtgccgacaagcagaaccacttggtccatccacgccaaacacgaatggatgaccacagaggacatgctggcagtgtggaatcgcgtctggattcaggaaaacccctggatggaggataagacgcctgttgaatcatgggaggaggtgccatatctcggaaaacgggaagaccagtggtgcggcagtcttatcggcctgacctctagggccacttgggctaagaatatacagacagccatcaaccaagtaagaagcctaattgggaatgagggatacaccgactatatgccctccatgaaacgcttccggagggaagaggaagaggccggtgtgctgtggtga

SEQ ID NO: 14292 - RNA, 9876 nt, synthetic construct
  misc_feature 1..9876: note = derived and/or modified CDS sequence (opt3) from DENV-2__JX286519__SS-prME
  source 1..9876: mol_type = other RNA
accgcaggcgtgatcgtcatgctgattcccacagctatggcattccacctcactacgaggaacggggagcctcatatgatagttggaaggcaggaaaagggtaaaagccttctgtttaagaccgaggacggcatcaatatgtgcacattgatggcaattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttatctgcaagcattctatggtggatagaggctggggtaacgggtgtggactattcggcaagggcgggattgtaacctgcgccatgtttacatgcaaaaagaatatggaaggaaaaatagtgcagcctgagaacctcgaatacaccatcgtgattactccacacagcggtgaggagcatgctgtcggcaatgacacggggaagcacggaaaagaaatcaagataacaccgcagtcctcaaccactgaggccgaactgaccggctatggtacagttaccatggagtgtagtcccaggactgggcttgatttcaacgaaatggtgctgttgcaaatggaggacaaagcatggctcgtacaccggcagtggtttctggatttacctctgccatggctccccggcgctgacacacagggaagcaattggattcagaaggagacgcttgtgaccttcaagaaccctcatgccaaaaagcaagacgtcgtggttctgggctctcaggaaggggcgatgcacactgccttgacaggagcaaccgagatccagatgtcctcaggtaatctactgtttacaggccatctcaaatgccgtctgcgcatggataaacttcaactgaaagggatgagctacagtatgtgtactggaaagttcaagatcgtgaaagaaattgctgagacccagcacggcacgatcgtcattagagtgcagtatgagggtgacgggtctccatgcaagatacccttcgaaatcaccgatttggagaaaaggcatgtactcggccggctgattacagttaacccgatcgtgactgaaaaggactcccctgtcaacatcgaggccgaacccccatttggagatagctacattatagtgggcgtcgagcctgggcagttaaaactgaattggttcaagaagggatcgtctatcggtcaaatgtttgagaccacaatgcgaggcgctaaacgcatggccattctaggggacactgcatgggatttcggatccctcggcggtgtgtttacctcaatcgggaaggccctgcaccaggttttcggcgctatttacggagcggcatttagtggcgtgagctggacgatgaaaatccttataggggtaatcattacatggatcggaatgaactccagatctaccagcttgtcagtcagtctggtgctcgttggcgtggtcactctgtatcttggtgccatggtgcaggctgactccgggtgtattgtaagctggaagaataaagaactgaagtgcggatctggcatcttcataacagataacgtgcacacctggactgagcagtacaagtttcaacccgaatcaccaagtaaattggccagcgcaattcagaaggcccatgaggaaggtatctgtggcattaggtccgttacccggctcgagaatctgatgtggaaacagatcacacccgagttaaaccacatactgtctgaaaatgaggtcaagctaacgatcatgaccggggacattaaaggaatcatgcaggctggcaagcgctcgctcagacctcaaccaactgaactgaaatatagctggaagacatgggggaaggccaaaatgctttccaccgagtcacataaccagacattcttgattgatggaccggaaactgcagagtgccccaataccaacagggcgtggaatagtctggaggtggaagactacggctttggtgtgttcacgacaaacatctggctcaagctgcgtgagaaacaggacgtcttttgtgattctaagttaatgagcgctgccataaaagacaatcgggcagttcacgccgatatggggtattggattgaatccgctctgaacgacacctggaagatggagaaggcctcattcatcgaggtgaaaagctgccactggcctaagtctcatactctttggtccaatggagtgttggaaagtgagatgatcattcccaagaatttcgcaggccccgtaagccagcacaactaccgacctggttatcatacccaaacagctggcccatggcacctcgggaagctggaaatggattttgacttctgtgagggaactaccgtcgtggttacagaagattgcggcaatagagggccctctctaaggacgaccactgcctccggaaaactgatcacagagtggtgctgtcgctcatgcaccctcccgcctctgcggtacagaggcgaggacggttgttggtacgggatggaaattaggccacttaaggagaaggaagagaacttggtgaatagtctggtcactgcgggacatggccagatagataactttagcttaggtgtgctcggcatggccctgttccttgaagagatgctgcgcacacgagttgggaccaaacacgctatcttgctcgtggcactgtcgtttgtaacgctaattactggaaatatgtccttccgggacctgggccgtgtcatggtgatggtgggggccaccatgacagatgacatcggaatgggcgtcacctatctcgctctgcttgccgcatttaaggttagacccactttcgcggccggtttgctgttaaggaaactcacatctaaggagctgatgatggctaccattgggatcgcccttctgagccagtcaacactacctgaaactatactcgagctgaccgatgcattggctctgggaatgatggccttaaaaatcgtgcgcaacatggaaaagtaccaactcgcagtaacgattatggccatcagttgcgtgcccaatgctgtcattctgcagaacgcgtggaaggtgtcctgtacaatccttgccgcagtttctgtgagcccactgttgctcacctcctcacagcagaaagctgactggatacctctggccctaactattaagggcctgaatcccaccgccatctttcttacaactctcagccggaccagtaaaaagagatcttggccactgaacgaggctatcatggcagtcggcatggtgtccattttggccagctcgctgctaaagaatgacataccgatgacggggcctctcgttgcgggaggtctgcttacagtgtgctatgtcctgaccggcaggtcagctgatttggaactcgagcgagccgcagacgtaaagtgggaggatcaagccgaaatctctgggagttcccccattctgagcatcactatttctgaggacggaagcatgtccatcaaaaacgaagaggaggaacagacactaaccatactgatccgcactggccttctcgtgatttcaggtgttttcccagtgagtatccccattacagctgcagcctggtacctgtgggaggtcaagaagcagcgggcgggggtgttgtgggatgtacctagcccaccccctgtgggaaaagctgaattagaggacggcgcctatagaatcaagcagaggggcatactggggtactctcaaattggagccggtgtctataaagaaggcacctttcacacgatgtggcatgttactcgtggggcagtgctcatgcaccgcggaaagcggatcgagccgtcctgggctgatgtgaaaaaggacctgatctcatacggcggtgggtggaaacttgagggagaatggaaagagggcgaagaggtccaggtgctggccttggaaccaggcaagaatcccagagcagttcagaccaaacctgggattttcaagacaaacaccggaacaatcggtgctgtaagtctagattttagcccaggcacttccgggtctcccatagtggacaggaaaggaaaggtcgtgggcctgtacggtaatggggttgtgacccgatcgggagcctatgtcagcgcgattgcccagacggagaagtcaatcgaggataaccctgaaattgaggacgatatcttccggaaaaagcgcctcacaataatggacctgcatccgggcgcaggcaaaactaagagataccttcccgctattgtgagggaagccatcaaacgggggttacgaaccctgatcctcgctccaacaagagtagtcgcagccgagatggaagaggccttgcgcggactgcctattaggtatcaaacccccgctatccgtgcggagcacactggtcgggaaattgtggacctcatgtgtcatgcaaccttcacaatgagactgctttccccagttagggtgcctaactacaatctgataatcatggatgaggcccactttacggaccccgctagtattgccgcacgcggctatatctctactcgagtcgaaatgggggaggccgctggaatcttcatgaccgcgacaccaccgggcagcagagatccttttccccagtccaacgccccaattatggacgaggaacgggagatacccgaaaggtcatggaactctggtcacgagtgggtgaccgatttcaaggggaagactgtttggtttgtgcctagcatcaaagcaggaaacgacattgctgcctgcttgcgcaagaatggcaaaaaggtcatccagctaagtcgtaaaacattcgattccgaatacgtgaagaccagagcaaacgactgggattttgtagtgacgactgacattagcgagatgggcgccaatttcaaggctgagcgggttatcgatccaaggcgctgtatgaaacccgtcatactgacagacggggaagaacgagtgatcctcgccggacctatgccggtgacccattcttcagcggcacaaagacggggtaggattggccgcaacccaaagaatgaaaacgaccagtatatctacatgggggagcccttagaaaatgatgaggactgcgcccactggaaagaggctaagatgctgcttgataacattaatacccctgaaggaatcgtcccctccatgtttgagccagaaagagagaaagtagacgccatagatggcgaatacaggctgcggggtgaggctcgtaagactttcgtggacctcatgcgccgaggggatttgcctgtttggctggcatataaagtggccgctgagggcattaactacgccgacagaaagtggtgttttgatggaatcaagaataaccagattctcgaagagaacgtcgaagtggagatctggacaaaagagggcgaaaggaagaaactgaagccccggtggcttgacgcacgcatatatagtgatccactagcgctgaaagagttcaaggagttcgccgctgggagaaagagcttgaccttaaatctgatcacagagatgggaaggctccctacttttatgacgcagaaagcccggtcggcactggacaaccttgctgttctgcataccgccgaagtgggtggcaaggcatacacacacgccctctctgagttgccggagactctggaaaccctactgctccttacactgttagctgcggtcaccgggggaattttcttgtttctgatgtccggcaaaggtatcgggaagatgactctcggcatgtgctgcattatcacggccagcatactgctttggtatgcacaaattcagccccactggatcgctgcctcaatcattctggagttctttctcatcgtgttgctgataccagaacctgagaaacagcgaaccccacaggataatcaattaacatacgtagtgattgccatcctaactgttgtcgcagctaccatggccaacgaaatgggattcctggagaagacaaagaaagacctcggctttgggagtattaccactcaggagtctgaatccaatatccttgacatagatctgagaccagcgagcgcttggacattgtatgccgtggcaacgaccttcgtgactcctatgctgcgccattcaatcgagaacagtagcgtcaatgtttccctcacagccattgctaaccaggcaaccgtgctgatgggacttggtaagggctggcccctctctaaaatggacatcggggtaccgctgttggccattggatgttacagccaggtgaatccaatcaccctgacagcggctttactactgctcgtcgcccactacgcaattatcggccctggtcttcaagccaaggctactagggaagcccagaaacgggcagctgccgggataatgaagaaccccacggtggatggcattaccgttatcgacctggagccaatcccctatgatcctaagtttgaaaaacagttgggacaggtgatgctgctcattctgtgcgtcacacaagtacttatgatgcgtactacctgggcgttatgtgaggccctgacactcgcaaccggcccgatatccactttgtgggaggggaatcccggaagattctggaacacgacaatcgctgtgtcaatggccaatatttttaggggctcttacctggccggtgctgggctactgttcagtatcatgaagaacaccactaatacccgccggggaacaggcaacgttggtgaaactctcggcgagaaatggaagtcgcgacttaatgccctggggaaaagcgaatttcagatttataagaaatccggaatccaggaggtggacagaaccttggccaaggagggcataaagagaggggaaacagatcatcacgcggtctctcgcggatcagctaaactgcggtggttcgtggagagaaacatggtcacgccagaaggcaaggtggttgacctcggttgcgggcgtggaggctggagctactattgtggtggcctgaaaaacgtgagggaggtaaaggggttaaccaaaggaggccctgggcatgaggaacccatccctatgtccacttacggatggaatcttgtgcggctgcaaagtggcgtcgatgttttctttacaccacccgagaagtgcgacaccctcctatgtgatattggtgaatctagccctaacccaactatcgaggcagggcgcacactgcgagtgttgaatctggtcgaaaactggctcaataacaatacccagttctgcattaaggtgcttaacccctatatgccgtcagtaatcgagaaaatggaaacgctgcagagaaagtacggaggcgccttggtgaggaatcctctgtcccggaacagtacccacgagatgtactgggttagcaatgctacaggcaacatagtgtcttccgtcaatatgatttcacgcatgctcatcaacagatttactatgaaacacaagaaagccacctatgagccagacgtggatttagggagcggaacaaggaatatcggtattgaatcggagatacccaacctggacatcattggcaagcgaatcgaaaagattaaacaggagcatgaaacttcttggcactacgaccaagatcatccttataagacctgggcataccacgggagttatgagacaaaacagaccggatccgccagctcaatggtcaacggcgtggttcggcttctgactaagccatgggacgtagtgcccatggtcacgcagatggctatgacagataccactccgttcggtcagcaacgtgtgtttaaagagaaggttgacaccagaacacaggaacctaaggaggggacgaaaaagctaatgaaaatcaccgcggaatggctctggaaggagctgggaaaagagaagactccccgcatgtgtacaagggaagagttcacccggaaagtgagatccaatgccgcattgggcgctgtctttactgatgaaaacaagtggaagtctgcccgcgaggcagtggaagacggcaggttctgggagctggtagatcgagagcggaatctccaccttgaagggaaatgcgagacatgtgtgtacaacatgatgggaaagagagagaaaaagctgggtgagtttggcaaagccaaggggagcagggctatatggtatatgtggttaggagcccgcttcctggaatttgaggcgttgggcttcctcaatgaggaccattggtttagtcgtggtaactccctgagcggggttgaaggagagggcctacaccggcttggctacatcctgagagaagtcgggaagaaagagggaggtgcaatgtacgccgatgacaccgctggctgggatacaaggattactctcgaagacctgaagaatgaggagatggtgaccaaccatatgaaaggggaacacaagaaattggccgaggcaatcttcaagctgacgtatcagaataaggtggtccgcgttcagcgaccaacccctcggggaacagtgatggacattatctctagaaaagatcaaaggggctcaggtcaggtagggacttacggactcaacaccttcacaaatatggaagctcagcttattcgccaaatggagggcgagggcatatttaagagtatccagcatctgactgccaccgaagagattgctgtgcagaactggttagccagagtcgggcgggaaaggctgtcccgtatggcaatcagcggagacgattgcgtggttaaacccatcgacgatcgattcgcgtctgccttgacggctctcaatgacatgggtaaggtgcgcaaagatattcagcaatgggagccatcgagaggctggaacgactggacacaggtccccttttgctcacaccacttccatgaactggtgatgaaggatgggcgggtcttagttgtgccttgtaggaatcaggacgagcttataggacgcgccagaatcagccagggcgcaggttggtccctgaaggagaccgcttgcctcgggaaaagttatgcccaaatgtggactctgatgtactttcaccggagggatttgcgattagcagccaacgcgatttgttctgctgtcccaagccattgggtgccgacatcccgtaccacttggtcaatccacgccaagcacgaatggatgaccacagaggacatgctggcagtgtggaacagagtctggattcaggaaaatccctggatggaggataaaacgcctgttgaaagttgggaggaggtgccatatctcggaaagcgcgaagaccagtggtgcggctctcttatcggcctgaccagccgggccacttgggctaaaaacatacagacagccatcaatcaagtaaggtccctaattgggaacgagggatacaccgactatatgccctcaatgaagagattccgccgggaagaggaagaggccggtgtgctgtggtga

SEQ ID NO: 14293 - RNA, 9876 nt, synthetic construct
  misc_feature 1..9876: note = derived and/or modified CDS sequence (opt3) from DENV-2__KP188549__SS-prME
  source 1..9876: mol_type = other RNA
accgccggcgtgatcgtcatgctgattccaacagctatggcgttccacctcactacgagaaacggggaacctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataaacttcaactgaaagggatgagctacagtatgtgtactggaaagttcaagatcgtcaaagaaatcgctgagacccagcacggcacgattgtgatcagagtacagtatgagggtgacgggtctccatgcaagattcccttcgaaataaccgatttggagaaaaggcatgttctcggccggctgatcacagtgaacccgattgtcactgaaaaggactcccctgtgaacatcgaggccgaacccccatttggagatagctacatcattgtcggcgtggagcctgggcagttaaaactgaattggttcaagaagggatcgtctataggtcaaatgtttgagaccacaatgcgaggcgctaaacgcatggccatcctaggggacactgcatgggatttcggatccctcggcggtgtttttacctcaattgggaaggccctgcaccaggtgttcggcgctatctacggagcggcatttagtggcgtaagctggacgatgaaaattcttatcggggtcataatcacatggattggaatgaactccagatctaccagcttgtcagtgagtctggttctcgtgggcgtcgtgactctgtatcttggtgccatggtacaggctgactccgggtgtatcgtgagctggaagaataaagaactgaagtgcggatctggcattttcatcacagataacgttcacacctggactgagcagtacaagtttcaacccgaatcaccaagtaaattggccagcgcaatacagaaggcccatgaggaaggtatttgtggcatcaggtccgtcacccggctcgagaatctgatgtggaaacagattacacccgagttaaaccacatcctgtctgaaaatgaggtgaagctaacgataatgaccggggacatcaaaggaattatgcaggctggcaagcgctcgctcagacctcaaccaactgaactgaaatatagctggaagacatgggggaaggccaaaatgctttccaccgagtcacataaccagacattcttgatcgatggaccggaaactgcagagtgccccaataccaacagggcgtggaatagtctggaggtggaagactacggctttggtgtcttcacgacaaacatttggctcaagctgcgtgagaaacaggacgtattttgtgattctaagttaatgagcgctgccatcaaagacaatcgggcagtgcacgccgatatggggtattggatagaatccgctctgaacgacacctggaagatggagaaggcctcattcattgaggtgaaaagctgccactggcctaagtctcatactctttggtccaatggagtattggaaagtgagatggtcatccccaagaacttcgcaggccccgtgagccagcacaactaccgacctggttatcatacccaaacagctggcccatggcacctcgggaagctggaaatggattttgacttctgtgagggaactaccgttgtggtcacagaagattgcgagaaaagaggcccctctctaaggacgaccactgcctccgggaagctgatcacagagtggtgctgtcgctcatgcaccctcccgcctctgcggtacagaggagaagacggctgttggtacggtatggagattaggccacttaaggaaaaagaggaaaatttggtgaacagtctggttactgcggggcatggacagatcgataattttagcttaggcgtgctcggtatggccctgttccttgaggagatgctgcgcacacgagtaggcaccaagcacgctattttgctcgtcgcactgtcgtttgtgacgctaataactgggaacatgtccttccgggacctgggacgtgtgatggtcatggttggcgccaccatgacagatgacatcgggatgggagtgacctatctcgctctgcttgccgcatttaaagtaagacccactttcgcggccggcttgctgttaaggaagctcacatctaaagaactgatgatggctaccattggtatcgcccttctgagccagtcaacactacctgagactattctcgaactgaccgatgcattggctctggggatgatggccttaaagatcgtgcgcaatatggagaagtaccaactcgcagtcacgataatggccatcagttgcgtgcccaacgctgttattctgcagaatgcgtggaaagtgtcctgtacaatccttgccgcagtctctgtgagcccactgttgctcacctcctcacagcagaaggctgactggattcctctggccctaactatcaaaggactgaaccccaccgccatatttcttacaactctcagccggaccagtaagaaaagatcttggccactgaatgaagctattatggcagttggcatggtgtccatcttggccagctcgctgttaaagaacgacatcccgatgacgggccctctcgtcgcagggggactgcttacagtatgctatgtgctgaccggtaggtcagctgatttggagctcgagcgagccgcagacgttaaatgggaagatcaagccgagatttctggcagttcccccatactgagcatcactatttctgaagacgggagcatgtccatcaagaatgaggaggaagaacagacactaaccattctgatccgcactggacttctcgtgatatcaggcgtcttcccagtgagtatccccattacagctgcagcctggtacctgtgggaagtaaagaaacagcgggcgggtgtgttgtgggatgtccctagcccaccccctgttgggaaggctgagttagaagacggagcctatagaatcaaacagaggggcattctgggctactctcaaatcggggcaggagtgtataaggagggtacctttcacacgatgtggcatgtgactcgtggcgccgtcctcatgcaccgcgggaaacggatagagccgtcctgggctgatgtgaagaaggacctgatttcatacggaggcggttggaaacttgaaggggagtggaaggaaggagaggaagttcaggtactggccttggagccaggcaaaaaccccagagcagtgcagaccaagcctggcatcttcaaaacaaataccgggacaatcggagctgtcagtctagattttagcccaggtacttccggctctcccattgtggacaggaaggggaaggttgtgggactgtacggcaacggtgtcgtgacccgatcgggggcctatgtaagcgcgatcgcccagacggagaaatcaatagaagataatcctgagattgaagacgatatcttccggaagaaacgcctcacaattatggacctgcatccgggagcaggcaagactaaaagataccttcccgctatcgtcagggaggccataaagcggggcttacgaaccctgattctcgctccaacaagagtggttgcagccgaaatggaggaggccttgcgcgggctgcctatcaggtatcaaacccccgctatccgtgcggaacacactggacgggagattgtggacctcatgtgtcatgcaaccttcacaatgagactgctttccccagtcagggtgcctaactacaacctgatcattatggatgaagcccactttacggaccccgctagtatagccgcacgcggttatatctctactcgagttgagatgggcgaggccgctgggattttcatgaccgcgacaccaccgggaagcagagatccttttccccagtccaatgccccaatcatggacgaagaacgggaaatccccgagaggtcatggaactctggccacgaatgggtgaccgatttcaagggtaaaactgtctggtttgtgcctagcattaaggcagggaatgacatagctgcctgcttgcgcaaaaacggaaagaaagtaatccagctaagtcgtaagacattcgattccgagtacgtgaagaccagagcaaatgactgggattttgttgtcacgactgacattagcgagatgggcgccaacttcaaagctgaacgggtgatcgatccaaggcgctgtatgaagcccgtgattctgacagacggcgaggaacgagtcatcctcgccgggcctatgccggtaacccattcttcagcggcacaaagacggggaaggataggtcgcaatcccaagaacgagaatgaccagtatatctacatgggcgaacccttagagaacgatgaggactgcgcccactggaaggaagctaaaatgctgcttgataatattaacacccctgaggggatcattccctccatgtttgaaccagagagagaaaaggtggacgccatcgatggagagtacaggctgcggggcgaggctcgtaaaactttcgttgacctcatgcgccgaggtgatttgcctgtgtggctggcatataaggtcgccgctgaagggataaattacgccgacagaaagtggtgttttgatggcattaaaaacaatcagatcctcgaggaaaacgtggaggttgagatttggacaaaggaaggagagaggaaaaagctgaaaccccggtggcttgacgcacgcatctatagtgatccactagcgctgaaggagttcaaggagttcgccgctggcagaaagagcttgaccttaaacctgataacagaaatggggaggctccctacttttatgacgcagaaggcccggaatgcactggacaaccttgctgtgctgcataccgccgaggtcggaggtaaagcatacacacacgccctctcggagttgccggaaactctggagaccctactgctccttacactgttagctgcggtgaccggcgggatcttcttgtttctgatgtctggaaagggcattggtaaaatgactctcgggatgtgctgcatcattacggcctccatcctgctttggtatgcacaaatacagccccactggattgctgccagcatcatcctggagttctttctcattgtattgctgatcccagagcctgaaaagcagcgaacaccacaggataatcaattaacatacgtggttatagccattctaactgtcgtggcagctaccatggccaacgagatgggcttcctggagaagaccaagaaagacctcggatttggctcaatcaccactcaggaaagtgagtctaatattcttgacatcgatctgagaccagcgtccgcttggacattgtatgccgtggcaacgaccttcgtcactcctatgctgcgccatagcatagaaaactcaagtgttaatgtgagcctcacagccatcgctaaccaggcaaccgtactgatggggcttggaaaaggttggcccctctccaaaatggacattggcgtgccgctgttggccatcgggtgttactctcaggtcaatccaattaccctgacagcggctttactactgctcgtggcccactacgcaatcattggacctggccttcaagccaaagctactagggaggcccagaagcgggcagctgccggtatcatgaagaaccccacggttgatgggataaccgtgattgacctggaaccaatcccctatgatcctaaatttgagaagcagttgggccaggtcatgctgctcatcctgtgcgtaacacaagtgcttatgatgcgtactacctgggcgttatgtgaggccctgacactcgcaaccggaccgattagcactttgtgggaaggcaatcccgggagattctggaacacgacaatagctgtttccatggccaatatctttaggggatcatacctggcaggcgctggtctactgttctctattatgaaaaacaccactaatacccgccgggggacaggaaacgtgggcgagactctcggtgaaaagtggaaaagtcgacttaatgccctgggcaagtcggagtttcagatctataaaaagagcgggattcaggaggtcgacagaaccttggccaaggaaggaatcaaaaggggcgagacagatcatcacgcggtgtcccgcgggtctgctaagctgcggtggttcgtcgaaagaaacatggtgacgccagagggaaaagttgtggacctcggctgcggtcgtgggggatggtcatactattgtggcggtctgaagaacgtaagggaagtgaaaggcttaaccaaagggggacctggccatgaggagcccatacctatgagcacttacgggtggaatcttgtccggctgcaatccggagttgatgtgttctttacaccacccgaaaagtgcgacaccctcctatgtgatatcggcgagagttctcctaacccaactattgaagcaggtcgcacactgcgagtcttgaatctggtggagaactggctcaataacaatacccagttctgcatcaaagtacttaacccctatatgccgagcgtgattgaaaagatggagacgctgcagagaaaatacgggggagccttggttaggaatcctctgtcacggaactccacccacgagatgtactgggtgagtaatgctacaggcaacatcgtcagctctgtgaatatgatatcccgcatgctcattaacagatttactatgaagcacaaaaaggccacctatgaaccagacgtcgatttaggctcagggacaaggaatatcggaatcgagagcgaaactcccaacctggacattataggtaagcgaatcgagaaaattaagcaggaacatgagacctcgtggcactacgaccaagatcatccttataaaacatgggcataccacggctcttatgagaccaagcagactgggagtgcctccagcatggtgaacggagttgtacggcttctgacgaaaccatgggacgtggtccccatggtgacacagatggctatgaccgatactaccccgttcggccagcaacgtgtttttaaggaaaaggtggacacaagaacgcaggagcctaaagaaggtaccaagaaactaatgaagatcactgcggagtggctctggaaagagctggggaaggagaaaacaccccgcatgtgtaccagggaggagttcactcggaaggtcagatcaaatgccgcattgggagctgtgtttacagatgagaacaagtggaaatccgcccgcgaagcagtagaggacggcaggttctgggagctggtggatcgagaacggaatctccaccttgagggcaagtgcgaaacctgtgtttacaacatgatggggaaaagagagaagaaactgggagaatttggtaaggccaagggctctagggctatttggtatatgtggttaggggcccgcttcctggagtttgaggcgttgggattcctcaatgaagaccattggtttagccgtggcaacagtctgtccggtgtcgagggggaaggactacaccggcttggctacatcctgagagaggtgggcaaaaaggaagggggagcaatgtacgccgatgacacagctggttgggatactaggataaccctcgaggacctgaaaaatgaggaaatggtgacgaaccatatgaagggcgagcacaaaaagttggccgaagcaatcttcaagctgacctatcagaataaagtcgttcgcgtgcagcgaccaacacctcgggggactgtaatggacattatcagcagaaaggatcaaaggggatctggccaggtgggtacctacgggctcaacacattcactaatatggaggctcagcttattcgccaaatggagggagaaggcatctttaaatcaattcagcatctgaccgccacggaggaaacagctgtccagaactggttagccagagtgggccgggagaggctgagtcgtatggcaatatccggggacgattgcgttgtgaagcccatcgacgatcgattcgcgagcgccttgaccgctctcaatgacatgggaaaagtccgcaaggatattcagcaatgggaaccatctagaggttggaacgactggactcaggtgcccttttgctcgcaccacttccatgagctggtaatgaaggatggccgggttctagtggtcccttgtaggaatcaggacgagcttatcgggcgcgccagaatctcacagggagcaggctggagcctgaaagaaacagcttgcctcggtaagtcctatgcccaaatgtggaccctgatgtactttcaccggagggatttgcgattagcagccaacgcgatttgtagtgctgtgccatctcattgggtgccgactagccgtaccacatggtccatacacgccaaacacgagtggatgacgaccgaagacatgctggcagtctggaacagagtttggatccaggagaatccctggatggaagataagactcctgtggagtcatgggaggaagtaccatatctcgggaaacgcgaggaccagtggtgcggaagtcttattggcctgacatctcgggccacctgggctaagaacatccagactgccattaatcaagtgaggagcctaatcggcaacgaagggtacacagactatatgccctccatgaagagattccgccgggaggaagaggaggcaggagtcctgtggtga

SEQ ID NO: 14294 - RNA, 9876 nt, synthetic construct
  misc_feature 1..9876: note = derived and/or modified CDS sequence (opt3) from DENV-2__KP188550__SS-prME
  source 1..9876: mol_type = other RNA
accgccggcgtgatcgtaatgctgattcccactgttatggctttccacctcactacgagaaacggggagcctcatatgatagtgggaaggcaggaaaagggtaaaagccttctgtttaagaccgaggacggcgtaaatatgtgcacattgatggctatcgatttaggggaactgtgtgaggacactattacctacaaatgcccactactccggcaaaacgaaccggaggatatcgactgttggtgcaattccacatctacctgggtgacttatggaacatgtaccacgactggcgagcaccgccgagaaaagcgttcagtcgccctggtgccccatgttggtatggggcttgagaccagaacagaaacttggatgagtagcgagggagcgtggaaacacgtgcagaggattgagacctggatcctgcggcatcctggcttcacaataatggctgccatcttggcatacaccattggcacgactcactttcagcgcgccctcatcttcattctgctgacagctgtcgcaccatccatgaccatgagatgcatcgggatatctaacagggattttgtggaaggagtatcgggtggctcatgggttgacattgtgctcgagcacgggagctgtgtcactacaatggccaagaataagcccaccttagatttcgaactgatcaaaacggaggctaagcagcctgccacccttcggaaatattgcattgaagcgaagttgacaaacactaccacagagagtcgctgtccaactcaaggagagccctccctgaatgaagaacaggacaaacgatttatctgcaagcattctatggtggatagaggctggggtaacgggtgtggactattcggcaagggcgggatcgtgacctgcgcaatgtttacatgcaaaaagaatatggaaggaaaaattgtccagcctgagaacctcgaatacaccatagttatcactccacacagcggtgaggagcatgccgtgggcaatgacacggggaagcacggaaaagaaattaagatcacaccgcagtcctcaaccactgaggctgaactgaccggctatggtacagtaaccatggagtgtagtcccaggactgggcttgatttcaacgaaatggtgctgttgcaaatggaggacaaagcctggctcgtccaccggcagtggtttctggatttacctctgccatggctccccggcgcagacacacagggaagcaattggatacagaaggagacgcttgtgaccttcaagaaccctcatgctaaaaagcaagacgttgtggtcctgggctctcaggaaggggccatgcacactgcgttgacaggagccaccgagattcagatgtcctcaggtaatctactgtttacaggccatctcaaatgccgtctgcgcatggataaacttcaactgaaagggatgagctacagtatgtgtactggaaagttcaagatcgtgaaagaaatcgcagagacccagcacggcacgattgtaatcagagttcagtatgagggtgacgggtctccatgcaagattcccttcgaaataaccgatttggagaaaaggcatgtgctcggccggctgatcacagtcaacccgattgtgactgaaaaggactcccctgtcaacatcgaggctgaacccccatttggagatagctacatcattgtgggcgttgagcctgggcagttaaaactgaattggttcaagaagggatcgtctataggtcaaatgtttgagaccacaatgcgaggcgccaaacgcatggctatcctaggggacactgcctgggatttcggatccctcggcggtgtgtttacctcaattgggaaggcactgcaccaggtattcggcgccatctacggagctgcgtttagtggcgtcagctggacgatgaaaattcttatcggggtgataatcacatggattggaatgaactccagatctaccagcttgtcagttagtctggtgctcgtcggcgtggtaactctgtatcttggtgcaatggtgcaggccgactccgggtgtatcgttagctggaagaataaagaactgaagtgcggatctggcattttcatcacagataacgtccacacctggactgagcagtacaagtttcaacccgaatcaccaagtaaattggctagcgccatacagaaggcacatgaggaaggtatttgtggcatcaggtccgtgacccggctcgagaatctgatgtggaaacagattacacccgagttaaaccacatcctgtctgaaaatgaggtgaagctaacgataatgaccggggacatcaaaggaattatgcaggccggcaagcgctcgctcagacctcaaccaactgaactgaaatatagctggaagacatgggggaaggctaaaatgctttccaccgagtcacataaccagacattcttgatcgatggaccggaaactgccgagtgccccaataccaacagggcatggaatagtctggaggtcgaagactacggctttggtgttttcacgacaaacatttggctcaagctgcgtgagaaacaggacgtgttttgtgattctaagttaatgagcgcggctatcaaagacaatcgggccgtgcacgcagatatggggtattggatagaatccgccctgaacgacacctggaagatggagaaggcttcattcattgaggtaaaaagctgccactggcctaagtctcatactctttggtccaatggagtcttggaaagtgagatgatcatccccaagaatttcgccggccccgtgagccagcacaactaccgacctggttatcatacccaaacagcaggcccatggcacctcgggaagctggaaatggattttgacttctgtgagggaactaccgttgtggtcacagaagattgcggcaatagagggccctctctaaggacgaccactgcttccggaaaactgattacagagtggtgctgtcgctcatgcaccctcccgcctctgcggtacagaggcgaggacggttgttggtacgggatggaaatcaggccacttaaggagaaggaagagaacttggtgaatagtctggttactgccggacatggccagattgataactttagcttaggtgtgctcggcatggcgctgttccttgaagagatgctgcgcacacgagtagggaccaaacacgccatattgctcgtcgctctgtcgtttgtgacgctaatcactggaaatatgtccttccgggacctgggccgtgtgatggtcatggttggggcaaccatgacagatgacattggaatgggcgtgacctatctcgccctgcttgctgcctttaaggtaagacccactttcgcagcgggtttgctgttaaggaaactcacatctaaggagctgatgatggccaccatcgggattgcacttctgagccagtcaacactacctgaaactatcctcgagctgaccgatgccttggcactgggaatgatggctttaaaaatagtgcgcaacatggaaaagtaccaactcgccgtcacgatcatggcaattagttgcgtgcccaatgccgttatcctgcagaacgcttggaaggtgtcctgtacaattcttgcggccgtctctgtgagcccactgttgctcacctcctcacagcagaaagcagactggatccctctggctctaactataaagggcctgaatcccaccgccatttttcttacaactctcagccggaccagtaaaaagagatcttggccactgaacgaggccatcatggctgttggcatggtgtccatcttggcaagctcgctgctaaagaatgacattccgatgacggggcctctcgtcgccggaggtctgcttacagtatgctatgtgctgaccggcaggtcagcggatttggaactcgagcgagctgccgacgttaagtgggaggatcaagcagaaatatctgggagttcccccatcctgagcattactatctctgaggacggaagcatgtccattaaaaacgaagaggaggaacagacactaaccatcctgatacgcactggccttctcgtgatctcaggtgtcttcccagtgagtattcccatcacagccgctgcatggtacctgtgggaggtaaagaagcagcgggccggggtgttgtgggatgtccctagcccaccccctgttggaaaagcggaattagaggacggcgcttatagaattaagcagaggggcatcctggggtactctcaaataggagccggtgtgtataaagaaggcacctttcacacgatgtggcatgtgactcgtggggcagtcctcatgcaccgcggaaagcggattgagccgtcctgggccgatgtgaaaaaggacctgatctcatacggcggtgggtggaaacttgagggagaatggaaagagggcgaagaggttcaggtactggctttggaaccaggcaagaatcccagagccgtgcagaccaaacctgggatcttcaagacaaacaccggaacaattggtgcagtcagtctagattttagcccaggcacttccgggtctcccatcgtggacaggaaaggaaaggttgtgggcctgtacggtaatggggtcgtgacccgatcgggagcttatgtaagcgccatagcgcagacggagaagtcaattgaggataaccctgaaatcgaggacgatattttccggaaaaagcgcctcacaatcatggacctgcatccgggcgccggcaaaactaagagataccttcccgcaatagtcagggaagctattaaacgggggttacgaaccctgatcctcgccccaacaagagtggttgctgcagagatggaagaggccttgcgcggactgcctatcaggtatcaaacccccgccattcgtgctgagcacactggtcgggaaatcgtggacctcatgtgtcatgcgaccttcacaatgagactgctttccccagtcagggtgcctaactacaatctgattataatggatgaggcacactttacggaccccgccagtatcgctgcccgcggctatatttctactcgagttgaaatgggggaggcagccggaatcttcatgaccgctacaccaccgggcagcagagatccttttccccagtccaacgcgccaatcatggacgaggaacgggagattcccgaaaggtcatggaactctggtcacgagtgggtgaccgatttcaaggggaagactgtctggtttgtgcctagcataaaagccggaaacgacatcgcagcttgcttgcgcaagaatggcaaaaaggtaattcagctaagtcgtaaaacattcgattccgaatacgtgaagaccagagccaacgactgggattttgttgtcacgactgacatcagcgagatgggcgcaaatttcaaggccgagcgggtgattgatccaaggcgctgtatgaaacccgtgatcctgacagacggggaagaacgagtcatactcgctggacctatgccggtaacccattcttcagccgcgcaaagacggggtaggatcggccgcaacccaaagaatgaaaacgaccagtatatttacatgggggagcccttagaaaatgatgaggactgcgcacactggaaagaggccaagatgctgcttgataacatcaatacccctgaaggaattatcccctccatgtttgagccagaaagagagaaagtggacgctatagatggcgaatacaggctgcggggtgaggcccgtaagactttcgttgacctcatgcgccgaggggatttgcctgtgtggctggcttataaagtcgcagccgagggcattaactacgctgacagaaagtggtgttttgatggaatcaagaataaccagattctcgaagagaacgtggaagttgagatctggacaaaagagggcgaaaggaagaaactgaagccccggtggcttgacgcccgcatatatagtgatccactagcactgaaagagttcaaggagttcgcggccgggagaaagagcttgaccttaaatctgatcacagagatgggaaggctccctacttttatgacgcagaaagctcggaacgccctggacaatcttgcagtgctgcataccgctgaagtcggtggccgagcccacacacacgcactctcggagttgccggagactctggaaaccctactgctccttacactgttagccaccgtgactgggggaattttcttgtttctgatgtctggcaagggtatcgggaaaatgacgctcggcatgtgctgcattatcaccgcttccatactgctttggtacgcgcaaattcagccccattggatcgccgcaagcatcattctggagttctttctcatcgtattgctgataccagaacctgagaagcagagaacaccccaggataaccaattaacttatgtggttattgctatcctaaccgtcgtggccgccacaatggcaaatgaaatgggattcctggagaaaaccaagaaggacctcggctttgggactattacaacgcaggagtcagaaagtaacatccttgacatagatctgcgcccagcttctgcctggaccttgtacgcggtggctactacattcgtcacccctatgctgaggcactccatcgagaatagctcagttaacgtgagtctcaccgccattgcaaatcaggccacagtactgatgggacttggtaaaggctggcccctcagcaagatggacatcggggtgccgctgttggctattggatgttattcccaggtcaacccaatcactctgacggcagccttactactgctcgtggcgcattacgctattatcggccctggtcttcaagccaaagcaacccgggaagcccagaagcgtgctgccgcagggataatgaaaaatcccacagttgatggcattactgtgatcgacctggagccaatcccctacgatcctaagtttgaaaagcagttgggacaggtcatgctgctcattctgtgcgtaacccaagtgcttatgatgagaacaacctgggctttatgtgaggccctgactctcgcgacgggcccgatatctacattgtgggaggggaaccccggaaggttctggaataccactatcgccgttagcatggcaaacatttttcgcggctcctatctggctggtgccgggctactgttctcaatcatgaaaaataccacaaacactcggcgaggaaccggcaatgtgggtgaaacactcggcgagaagtggaaatctagacttaacgcactggggaagagtgaatttcagatttacaaaaagtcgggaatccaggaggtcgacaggacgttggctaaagagggcataaagcgcggggaaaccgatcaccatgccgtgagccggggatccgccaagctgagatggttcgtcgagcgtaacatggtgactccagaaggcaaagttgtggacctcggttgcgggaggggaggctggtcttattactgtggtggcctgaagaatgtacgggaggtgaaagggttaacaaagggaggccctgggcacgaagaaccaatccctatgtcaacctatggatggaaccttgtccgcctgcaaagcggcgttgatgtgttctttactccacccgagaaatgcgacacactcctatgtgatattggtgaatccagtcctaatccaaccatcgaggcggggcgaacgctgagagtcttgaacctggtggaaaattggctcaacaataacacccagttctgcattaaggtacttaatccctacatgccgtctgtgatcgagaagatggaaacactgcagaggaaatatggaggcgctttggttcggaaccctctgagccgcaattcaactcacgagatgtactgggtgtccaacgcaaccggcaatatagtcagtagcgtgaacatgatttctagaatgctcatcaataggtttacaatgaagcataaaaaggccacttacgagccagacgtcgatttagggtccggaacccgaaacatcggtattgaatcagagatacccaacctggacatcattggcaaacggatcgaaaagattaagcaggagcacgaaacaagctggcattatgaccaagatcacccttacaaaacctgggcttatcacgggtcgtacgagactaagcagacgggatctgccagttccatggtgaatggcgttgtacgtcttctgacaaaaccatgggacgtggtccccatggtgacccagatggcaatgactgataccacaccgttcggtcagcaaagagtttttaaggagaaagtggacacgcgcacccaggaacctaaggaggggactaagaaactaatgaagatcacagccaaatggctctggaaggaactgggaaaagagaagacccccaggatgtgtactcgggaggagttcacaagaaaagtccgcagcaacgctgcgttgggcgccatatttaccgatgagaataagtggaagtcagcaagggaagctgtggaggacggccgattctgggaactggtagatcgggagagaaacctccatcttgaggggaaatgcgaaacatgtgtgtataatatgatgggaaagagggagaaaaagctgggtgaatttggcaaagccaaggggtcccgcgcaatctggtacatgtggttaggagcccgtttcctggagtttgaggctttgggcttcctcaacgaggaccactggttttctcggggtaatagcctgagtggggttgagggagaaggcctacatagacttggctatattctgagggaggtcgggaagaaagaaggaggtgccatgtacgcggatgacactgcaggctgggatacccgcatcacgctcgaggacctgaagaacgaagagatggtgaccaatcacatgaaaggggagcataagaaattggccgaagctattttcaagctgacataccagaacaaggtggtccgagttcagcggccaactcctagaggaaccgtgatggacatcatttccaggaaagatcaacgcggcagcggtcaggtagggacatatggactcaatactttcaccaacatggaggcccagcttataagacaaatggaaggcgagggcatctttaagaatattcagcacctgacggcaacagaggaaatcgctgtgcagaactggttagcccgggtcgggagggagcgtctgtctcgaatggctatctcaggagacgattgcgtggttaaacccattgacgatcgcttcgccagtgcattgaccgcgctcaatgacatgggtaaggtgagaaaagatatacagcaatgggaaccatcccggggctggaacgactggactcaggtccccttttgcagccaccatttccacgagctggtgatgaaggatgggagggtcttagttgtgccttgtcgcaaccaggacgaacttatcggcagagcacggatttctcagggagctggttggtcgctgaaggagacagcctgcctcgggaaatcatacgcacaaatgtggaccctgatgtattttcataggcgagatttgcgtttagctgccaatgcaatctgtagcgccgtcccatcccactgggtgccgacaagtagaaccacatggtctattcacgcgaagcatgagtggatgacgaccgaagacatgctggctgtgtggaaccgcgtctggatccaggagaatccctggatggaagataaaactcctgttgagagctgggaagaggtgccatacctcggaaagcgggaggaccagtggtgcggctcccttataggcctgacatcaagggccacctgggccaaaaacatccagactgccattaatcaagtaagaagtctaatcgggaacgaaggatatacagactacatgccctctatgaagcgcttccggagggaggaagaggaagctggtgtgctgtggtga

SEQ ID NO: 14295 - RNA, 9876 nt, synthetic construct
  misc_feature 1..9876: note = derived and/or modified CDS sequence (opt3) from DENV-2__KP188553__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataagcttcaactgaaagggatgagctacagtatgtgtactggaaagttcaagatcgtcaaagaaatcgctgagacccagcacggcacgattgtgatcagagtacagtatgagggtgacgggtctccatgcaagattcccttcgaaataaccgatttggagaaaaggcatgttctcggccggctgatcacagtgaacccgattgtcactgaaaaggactcccctgtgaacatcgaggccgaacccccatttggagatagctacatcattgtcggcgtggagcctgggcagttaaaactgaattggttcaagaagggatcgtctataggtcaaatgtttgagaccacaatgcgaggcgctaaacgcatggccatcctaggggacactgcatgggatttcggatccctcggcggtgtttttacctcaattgggaaggccctgcaccaggtgttcggcgctatctacggagcggcatttagtggcgtaagctggacgatgaaaattcttatcggggtcataatcacatggattggaatgaactccagatctaccagcttgtcagtgagtctggttctcgtgggcgtcgtgactctgtatcttggtgccatggtacaggctgactccgggtgtatcgtgagctggaagaataaagaactgaagtgcggatctggcattttcatcacagataacgttcacacctggactgagcagtacaagtttcaacccgaatcaccaagtaaattggccagcgcaatacagaaggcccatgaggaaggtatttgtggcatcaggtccgtcacccggctcgagaatctgatgtggaaacagattacacccgagttaaaccacatcctgtctgaaaatgaggtgaagctaacgataatgaccggggacatcaaaggaattatgcaggctggcaagcgctcgctcagacctcaaccaactgaactgaaatatagctggaagacatgggggaaggccaaaatgctttccaccgagtcacataaccagacattcttgatcgatggaccggaaactgcagagtgccccaataccaacagggcgtggaatagtctggaggtggaagactacggctttggtgtcttcacgacaaacatttggctcaagctgcgtgagaaacaggacgttttttgtgattctaagttaatgagcgctgccatcaaagacaatcgggcagtgcacgccgatatggggtattggatagaatccgctctgaacgacacctggaagatggagaaggcctcattcattgaggtgaaaagctgccactggcctaagtctcatactctttggtccaatggagtattggaaagtgagatggtcatcccaaaaaacttcgcaggccccgtgagccagcacaactaccgacctggttatcatacccaaacagctggcccatggcacctcgggaagctggaaatggattttgacttctgtgagggaactaccgttgtggtcacagaagattgcgagaaaagaggcccctctctaaggacgaccactgcctccgggaagctgatcacagagtggtgctgtcgctcatgcaccctcccgcctctgcggtacagaggagaagacggctgttggtacggtatggagattaggccacttaaggaaaaagaggaaaatttggtgaacagtctggttactgcggggcatggacagatcgataattttagcttaggcgtgctcggtatggccctgttccttgaggagatgctgcgcacacgagtaggcaccaagcacgctattttgctcgtcgcactgtcgtttgtgacgctaataactgggaacatgtccttccgggacctgggacgtgtgatggtcatggttggcgccaccatgacagatgacatcgggatgggagtgacctatctcgctctgcttgccgcatttaaagtaagacccactttcgcggccggcttgctgttaaggaagctcacatctaaagaactgatgatggctaccattggtatcgcccttctgagccagtcaacactacctgagactattctcgaactgaccgatgcattggctctggggatgatggccttaaagatcgtgcgcaatatggagaagtaccaactcgcagtcacgataatggccatcagttgcgtgcccaacgctgttattctgcagaatgcgtggaaagtgtcctgtacaatccttgccgcagtctctgtgagcccactgttgctcacctcctcacagcagaaggctgactggattcctctggccctaactatcaaaggactgaaccccaccgccatatttcttacaactctcagccggaccagtaagaaaagatcttggccactgaatgaagctattatggcagttggcatggtgtccatcttggccagctcgctgttaaagaacgacatcccgatgacgggccctctcgtcgcggggggactgcttacagtatgctatgtgctgaccggtaggtcagctgatttggagctcgagcgagccgcagacgttaaatgggaagatcaagccgagatttctggcagttcccccatactgagcatcactatttctgaagacgggagcatgtccatcaagaatgaggaggaagagcagacactaaccattctgatccgcactggacttctcgtgatatcaggcgtcttcccagtgagtatccccattacagctgcagcctggtacctgtgggaagtaaagaaacagcgggcgggtgtgttgtgggatgtccctagcccaccccctgttgggaaggctgagttagaagacggagcctatagaatcaaacagaggggcattctgggctactctcaaatcggggcaggagtgtataaggagggtacctttcacacgatgtggcatgtgactcgtggcgccgtcctcatgcaccgcgggaaacggatagagccgtcctgggctgatgtgaagaaggacctgatttcatacggaggcggttggaaacttgaaggggagtggaaggaaggagaggaagttcaggtactggccttggagccaggcaaaaaccccagagcagtgcagaccaagcctggcatcttcaaaacaaataccgggacaatcggagctgtcagtctagattttagcccaggtacttccggctctcccattgtggacaggaaggggaaggttgtgggactgtacggcaacggtgtcgtgacccgatcgggggcctatgtaagcgcgatcgcccagacggagaaatcaatagaagataatcctgagattgaagacgatatcttccggaagaaacgcctcacaattatggacctgcatccgggagcaggcaagactaaaagataccttcccgctatcgtcagggaggccataaagcggggcttacgaaccctgattctcgctccaacaagagtggttgcagccgaaatggaggaggccttgcgcgggctgcctatcaggtatcaaacccccgctatccgtgcggaacacactggacgggagattgtggacctcatgtgtcatgcaaccttcacaatgagactgctttccccagtcagggtgcctaactacaacctgatcattatggatgaagcccactttacggaccccgctagtatagccgcacgcggttatatctctactcgagttgagatgggcgaggccgctgggattttcatgaccgcgacaccaccgggaagcagagatccttttccccagtccaatgccccaatcatggacgaagagcgggaaatccccgagaggtcatggaactctggccacgaatgggtgaccgatttcaagggtaaaactgtctggtttgtgcctagcattaaggcagggaatgacatagctgcctgcttgcgcaaaaacggaaagaaagtaatcccatacagtcgtaagacattcgattccgagtatgtgaagaccagagcaaatgactgggattttgttgtcacgactgacattagcgagatgggcgccaacttcaaagctgaacgggtgatcgatcccaggcgctgtatgaagcctgtgattctaacagacggcgaggaacgagtcatcctggccgggccgatgccagtaacccattcttcagcggcacagagacggggaaggataggtcgcaatcccaaaaacgagaatgaccaatacatctacatgggcgaacctctcgagaacgatgaggactgcgcccactggaaggaagctaaaatgttactggataatattaacacccccgaggggatcattccatccatgtttgaacctgagagagaaaaggtggacgccatcgatggagagtataggcttcggggcgaggctcgtaaaactttcgttgacctgatgcgccgaggtgatctccccgtgtggttggcatacaaggtcgccgctgaagggataaattatgccgacagaaagtggtgttttgatggcattaaaaacaatcagatcctggaggaaaacgtggaggttgagatttggacaaaggaaggagagaggaaaaagctcaaaccacggtggctggacgcacgcatctacagtgatcctcttgcgctaaaggaattcaaggagttcgccgctggcagaaaaagcctgaccttgaacttaataacagaaatggggaggctgccgacttttatgacgcagaaggcccggaatgcactcgacaacctggctgtgcttcataccgccgaggtcggaggtaaagcatatacacacgccctgtcggagctccccgaaactttggagaccctgctactgctcacacttctggctgcggtgaccggcgggatcttcttatttttgatgtctggaaagggcattggtaaaatgactctggggatgtgctgcatcattacggcctccatcctcctgtggtacgcacagatacaaccacactggattgctgccagcatcatccttgaattctttctgattgtactcttgatccctgagcccgaaaagcagcgaaccccacaggataatcagctgacatatgtggttatagccattttaactgtcgtggcagctaccatggccaacgagatgggcttcctagagaagacaaaaaaggacctgggatttggctcaatcaccactcaagaaagtgagtctaatattctcgacatcgatcttagacctgcgtccgcttggacactgtacgccgtggcaacgaccttcgtcactcccatgttgcgccatagcatagaaaactcaagtgttaatgtgagcctgacagccatcgctaaccaggcaaccgtactcatggggctgggaaaaggttggccgctttccaagatggacattggcgtgccactcctggccatcgggtgttactctcaggtcaatcctattaccttgacagcggctctgttactactggtggcccactatgcaatcattggacccggcctccaggccaaagctactagggaggcccaaaagcgggcagctgccggtatcatgaagaacccaacggttgatgggataaccgtgattgaccttgaacccatcccttacgatccgaaatttgagaagcagctgggccaggtcatgttgctgatcctctgcgtaacacaggtgctgatgatgcgtactacctgggcgctttgtgaggccttaacactggcaaccggacccattagcactctctgggaaggcaatccagggagattctggaacacgacaatagctgtttccatggccaatatctttaggggatcatatttggcaggcgctggtctgctattctctattatgaaaaacaccactaatacccgccgggggacaggaaacgtgggcgagactctgggtgaaaagtggaaaagtcgactcaatgcccttggcaagtcggagtttcaaatctacaaaaagagcgggattcaggaggtcgacagaaccctggccaaggaaggaatcaaaaggggcgagacagatcatcacgcggtgtcccgcgggtctgctaagttgcggtggttcgtcgaaagaaacatggtgacgcctgagggaaaagttgtggacctgggctgcggtcgtgggggatggtcatattactgtggcggtctcaagaacgtaagggaagtgaaaggcctgaccaaggggggacccggccatgaggagcctataccaatgagcacttatgggtggaatttagtccggcttcagtccggagttgatgtgttctttacaccccctgaaaagtgcgacaccctgctctgtgatatcggcgagagttctccaaaccccactattgaagcaggtcgcacactacgagtcctgaatttggtggagaactggctgaataacaatacccaattctgcatcaaagtactcaacccgtacatgcctagcgtgattgaaaagatggagacgcttcagagaaaatacgggggagccctggttaggaatccattgtcacggaactccacccacgagatgtattgggtgagtaatgctacaggcaacatcgtcagctctgtgaatatgatatcccgcatgctgattaacagatttactatgaagcacaaaaaggccacctacgaacccgacgtcgatctcggctcagggacaaggaatatcggaatcgagagcgaaactcctaacttagacattataggtaagcgaatcgagaaaattaagcaggaacatgagacctcgtggcactatgaccaggatcatccatacaaaacatgggcatatcacggctcttacgagaccaagcaaactgggagtgcctccagcatggtgaacggagttgtacggctgcttacgaaaccctgggacgtggtcccgatggtgacacagatggctatgaccgatactacccctttcggccagcagcgtgtttttaaggaaaaggtggacacaagaacgcaagagcccaaagaaggtaccaagaaactgatgaagatcactgcggagtggctatggaaagagctcgggaaggaaaaaacaccacgcatgtgtaccagggaggaattcactcggaaggtcagatcaaatgccgcactgggagctgtgtttacagatgagaacaagtggaaatccgcccgcgaagcagtagaggacggcaggttctgggagttggtggatcgagaacggaatctgcacctcgagggcaagtgcgaaacctgtgtttataacatgatggggaaaagagagaagaaacttggagaatttggtaaggccaagggctctagggctatttggtacatgtggctgggggcccgcttcttagagtttgaggcgctgggattcttgaatgaagaccattggtttagccgtggcaacagtctctccggtgtcgagggggaaggactgcaccggctaggctacatccttagagaggtgggcaaaaaggaagggggagcaatgtatgccgatgacacagctggttgggatactaggataaccctggaggacctcaaaaatgaggaaatggtgacgaaccatatgaagggcgagcacaaaaagctggccgaagcaatcttcaagttgacctaccagaataaagtcgttcgcgtgcagcgacctacaccccgggggactgtaatggacattatcagcagaaaggatcagaggggatctggccaagtgggtacctatgggctgaacacattcactaatatggaggctcagctcattcgccagatggagggagaaggcatctttaaatcaattcaacatcttaccgccacggaggaaacagctgtccagaactggctggccagagtgggccgggagaggttaagtcgtatggcaatatccggggacgattgcgttgtgaagccaatcgacgatcgattcgcgagcgccctgaccgctttgaatgacatgggaaaagtccgcaaggatattcagcagtgggaaccctctagaggttggaacgactggactcaagtgcctttttgctcgcaccacttccatgagctcgtaatgaaggatggccgggttctggtggtcccatgtaggaatcaggacgagctaatcgggcgcgccagaatctcacagggagcaggctggagccttaaagaaacagcttgcctgggtaagtcctacgcccagatgtggaccctcatgtattttcaccggagggatctgcgattggcagccaacgcgatttgtagtgctgtgccgtctcattgggtgcccactagccgtaccacatggtccatacacgccaaacacgagtggatgacgaccgaagacatgttagcagtctggaacagagtttggatccaagagaatccttggatggaagataagactccagtggagtcatgggaggaagtaccctacctggggaaacgcgaggaccagtggtgcggaagtctcattggccttacatctcgggccacctgggctaagaacatccagactgccattaatcaggtgaggagcctgatcggcaacgaagggtatacagactacatgccttccatgaagagattccgccgggaggaagaggaggcaggagtcctatggtga

SEQ ID NO: 14296 - RNA, 9876 nt, synthetic construct
  misc_feature 1..9876: note = derived and/or modified CDS sequence (opt3) from DENV-2__KP188556__SS-prME
  source 1..9876: mol_type = other RNA
accgccggcgtgatcgtcatgctgattccaacagctatggcgttccacctcactacgagaaacggggaacctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataaacttcaactgaaagggatgagctacagtatgtgtactggaaagttcaagatcgtcaaagaaatcgctgagacccagcacggcacgattgtgatcagagtacagtatgagggtgacgggtctccatgcaagattcccttcgaaataaccgatttggagaaaaggcatgttctcggccggctgatcacagtgaacccgattgtcactgaaaaggactcccctgtgaacatcgaggccgaacccccatttggagatagctacatcattgtcggcgtggagcctgggcagttaaaactgaattggttcaagaagggatcgtctataggtcaaatgtttgagaccacaatgcgaggcgctaaacgcatggccatcctaggggacactgcatgggatttcggatccctcggcggtgtttttacctcaattgggaaggccctgcaccaggtgttcggcgctatctacggagcggcatttagtggcgtaagctggacgatgaaaattcttatcggggtcataatcacatggattggaatgaactccagatctaccagcttgtcagtgagtctggttctcgtgggcgtcgtgactctgtatcttggtgccatggtacaggctgactccgggtgtatcgtgagctggaagaataaagaactgaagtgcggatctggcattttcatcacagataacgttcacacctggactgagcagtacaagtttcaacccgaatcaccaagtaaattggccagcgcaatacagaaggcccatgaggaaggtatttgtggcatcaggtccgtcacccggctcgagaatctgatgtggaaacagattacacccgagttaaaccacatcctgtctgaaaatgaggtgaagctaacgataatgaccggggacatcaaaggaattatgcaggctggcaagcgctcgctcagacctcaaccaactgaactgaaatatagctggaagacatgggggaaggccaaaatgctttccaccgagtcacataaccagacattcttgatcgatggaccggaaactgcagagtgccccaataccaacagggcgtggaatagtctggaggtggaagactacggctttggtgtcttcacgacaaacatttggctcaagctgcgtgagaaacaggacgtattttgtgattctaagttaatgagcgctgccatcaaagacaatcgggcagtgcacgccgatatggggtattggatagaatccgctctgaacgacacctggaagatggagaaggcctcattcattgaggtgaaaagctgccactggcctaagtctcatactctttggtccaatggagtattggaaagtgagatggtcatccccaagaacttcgcaggccccgtgagccagcacaactaccgacctggttatcatacccaaacagctggcccatggcacctcgggaagctggaaatggattttgacttctgtgagggaactaccgttgtggtcacagaagattgcgagaaaagaggcccctctctaaggacgaccactgcctccgggaagctgatcacagagtggtgctgtcgctcatgcaccctcccgcctctgcggtacagaggagaagacggctgttggtacggtatggagattaggccacttaaggaaaaagaggaaaatttggtgaacagtctggttactgcggggcatggacagatcgataattttagcttaggcgtgctcggtatggccctgttccttgaggagatgctgcgcacacgagtaggcaccaagcacgctattttgctcgtcgcactgtcgtttgtgacgctaataactgggaacatgtccttccgggacctgggacgtgtgatggtcatggttggcgccaccatgacagatgacatcgggatgggagtgacctatctcgctctgcttgccgcatttaaagtaagacccactttcgcggccggcttgctgttaaggaagctcacatctaaagaactgatgatggctaccattggtatcgcccttctgagccagtcaacactacctgagactattctcgaactgaccgatgcattggctctggggatgatggccttaaagatcgtgcgcaatatggagaagtaccaactcgcagtcacgataatggccatcagttgcgtgcccaacgctgttattctgcagaatgcgtggaaagtgtcctgtacaatccttgccgcagtctctgtgagcccactgttgctcacctcctcacagcagaaggctgactggattcctctggccctaactatcaaaggactgaaccccaccgccatatttcttacaactctcagccggaccagtaagaaaagatcttggccactgaatgaagctattatggcagttggcatggtgtccatcttggccagctcgctgttaaagaacgacatcccgatgacgggccctctcgtcgcagggggactgcttacagtatgctatgtgctgaccggtaggtcagctgatttggagctcgagcgagccgcagacgttaaatgggaagatcaagccgagatttctggcagttcccccatactgagcatcactatttctgaagacgggagcatgtccatcaagaatgaggaggaagaacagacactaaccattctgatccgcactggacttctcgtgatatcaggcgtcttcccagtgagtatccccattacagctgcagcctggtacctgtgggaagtaaagaaacagcgggcgggtgtgttgtgggatgtccctagcccaccccctgttgggaaggctgagttagaagacggagcctatagaatcaaacagaggggcattctgggctactctcaaatcggggcaggagtgtataaggagggtacctttcacacgatgtggcatgtgactcgtggcgccgtcctcatgcaccgcgggaaacggatagagccgtcctgggctgatgtgaagaaggacctgatttcatacggaggcggttggaaacttgaaggggagtggaaggaaggagaggaagttcaggtactggccttggagccaggcaaaaaccccagagcagtgcagaccaagcctggcatcttcaaaacaaataccgggacaatcggagctgtcagtctagattttagcccaggtacttccggctctcccattgtggacaggaaggggaaggttgtgggactgtacggcaacggtgtcgtgacccgatcgggggcctatgtaagcgcgatcgcccagacggagaaatcaatagaagataatcctgagattgaagacgatatcttccggaagaaacgcctcacaattatggacctgcatccgggagcaggcaagactaaaagataccttcccgctatcgtcagggaggccataaagcggggcttacgaaccctgattctcgctccaacaagagtggttgcagccgaaatggaggaggccttgcgcgggctgcctatcaggtatcaaacccccgctatccgtgcggaacacactggacgggagattgtggacctcatgtgtcatgcaaccttcacaatgagactgctttccccagtcagggtgcctaactacaacctgatcattatggatgaagcccactttacggaccccgctagtatagccgcacgcggttatatctctactcgagttgagatgggcgaggccgctgggattttcatgaccgcgacaccaccgggaagcagagatccttttccccagtccaatgccccaatcatggacgaagaacgggaaatccccgagaggtcatggaactctggccacgaatgggtgaccgatttcaagggtaaaactgtctggtttgtgcctagcattaaggcagggaatgacatagctgcctgcttgcgcaaaaacggaaagaaagtaatccagctaagtcgtaagacattcgattccgagtacgtgaagaccagagcaaatgactgggattttgttgtcacgactgacattagcgagatgggcgccaacttcaaagctgaacgggtgatcgatccaaggcgctgtatgaagcccgtgattctgacagacggcgaggaacgagtcatcctcgccgggcctatgccggtaacccattcttcagcggcacaaagacggggaaggataggtcgcaatcccaagaacgagaatgaccagtatatctacatgggcgaacccttagagaacgatgaggactgcgcccactggaaggaagctaaaatgctgcttgataatattaacacccctgaggggatcattccctccatgtttgaaccagagagagaaaaggtggacgccatcgatggagagtacaggctgcggggcgaggctcgtaaaactttcgttgacctcatgcgccgaggtgatttgcctgtgtggctggcatataaggtcgccgctgaagggataaattacgccgacagaaagtggtgttttgatggcattaaaaacaatcagatcctcgaggaaaacgtggaggttgagatttggacaaaggaaggagagaggaaaaagctgaaaccccggtggcttgacgcacgcatctatagtgatccactagcgctgaaggagttcaaggagttcgccgctggcagaaagagcttgaccttaaacctgataacagaaatggggaggctccctacttttatgacgcagaaggcccggaatgcactggacaaccttgctgtgctgcataccgccgaggtcggaggtaaagcatacacacacgccctctcggagttgccggaaactctggagaccctactgctccttacactgttagctgcggtgaccggcgggatcttcttgtttctgatgtctggaaagggcattggtaaaatgactctcgggatgtgctgcatcattacggcctccatcctgctttggtatgcacaaatacagccccactggattgctgccagcatcatcctggagttctttctcattgtattgctgatcccagagcctgaaaagcagcgaacaccacaggataatcaattaacatacgtggttatagccattctaactgtcgtggcagctaccatggccaacgagatgggcttcctggagaagaccaagaaagacctcggatttggctcaatcaccactcaggaaagtgagtctaatattcttgacatcgatctgagaccagcgtccgcttggacattgtatgccgtggcaacgaccttcgtcactcctatgctgcgccatagcatagaaaactcaagtgttaatgtgagcctcacagccatcgctaaccaggcaaccgtactgatggggcttggaaaaggttggcccctctccaaaatggacattggcgtgccgctgttggccatcgggtgttactctcaggtcaatccaattaccctgacagcggctttactactgctcgtggcccactacgcaatcattggacctggccttcaagccaaagctactagggaggcccagaagcgggcagctgccggtatcatgaagaaccccacggttgatgggataaccgtgattgacctggaaccaatcccccatgatcctaaatttgagaagcagttgggccaggtcatgctgctcatcctgtgcgtaacacaagtgcttatgatgcgtactacctgggcgttatgtgaggccctgacactcgcaaccggaccgattagcactttgtgggaaggcaatcccgggagattctggaacacgacaatagctgtttccatggccaatatctttaggggatcatatctggcaggcgctggtctactgttctctattatgaaaaacaccactaatacccgccgggggacaggaaacgtgggcgagactctcggtgaaaagtggaaaagtcgacttaatgccctgggcaagtcggagtttcagatctacaaaaagagcgggattcaggaggtcgacagaaccttggccaaggaaggaatcaaaaggggcgagacagatcaccatgcggtgtcccgcgggtctgctaagctgcggtggttcgtcgaaagaaacatggtgacgccagagggaaaagttgtggacctcggctgcggtcgtgggggatggtcatattactgtggcggtctgaagaacgtaagggaagtgaaaggcttaaccaaagggggacctggccacgaggagcccatacctatgagcacttatgggtggaatcttgtccggctgcaatccggagttgatgtgttctttacaccacccgaaaagtgcgacaccctcctatgtgatatcggcgagagttctcctaacccaactattgaagcaggtcgcacactgcgagtcttgaatctggtggagaactggctcaataacaatacccagttctgcatcaaagtacttaacccctacatgccgagcgtgattgaaaagatggagacgctgcagagaaaatatgggggagccttggttaggaatcctctgtcacggaactccacccacgagatgtactgggtgagtaatgctacaggcaacatcgtcagctctgtgaatatgatatcccgcatgctcattaacagatttactatgaagcataaaaaggccacctacgaaccagacgtcgatttaggctcagggacaaggaatatcggaatcgagagcgaaactcccaacctggacattataggtaagcgaatcgagaaaattaagcaggaacacgagacctcgtggcattatgaccaagatcacccttacaaaacatgggcatatcacggctcttacgagaccaagcagactgggagtgcctccagcatggtgaacggagttgtacggcttctgacgaaaccatgggacgtggtccccatggtgacacagatggctatgaccgatactaccccgttcggccagcaacgtgtttttaaggaaaaggtggacacaagaacgcaggagcctaaagaaggtaccaagaaactaatgaagatcactgcggagtggctctggaaagagctggggaaggagaaaacaccccgcatgtgtaccagggaggagttcactcggaaggtcagatcaaatgccgcattgggagctgtgtttacagatgagaacaagtggaaatccgcccgcgaagcagtagaggacggcaggttctgggagctggtggatcgagaacggaatctccatcttgagggcaagtgcgaaacctgtgtttataacatgatggggaaaagagagaagaaactgggagaatttggtaaggccaagggctctagggctatttggtacatgtggttaggggcccgcttcctggagtttgaggcgttgggattcctcaatgaagaccactggtttagccgtggcaacagtctgtccggtgtcgagggggaaggactacatcggcttggctatatcctgagagaggtgggcaaaaaggaagggggagcaatgtacgccgatgacacagctggttgggatactaggataaccctcgaggacctgaaaaatgaggaaatggtgacgaaccacatgaagggcgagcataaaaagttggccgaagcaatcttcaagctgacctaccagaataaagtcgttcgcgtgcagcgaccaacacctcgggggactgtaatggacattatcagcagaaaggatcaaaggggatctggccaggtgggtacctatgggctcaacacattcactaatatggaggctcagcttattcgccaaatggagggagaaggcatctttaaatcaattcagcacctgaccgccacggaggaaacagctgtccagaactggttagccagagtgggccgggagaggctgagtcgtatggcaatatccggggacgattgcgttgtgaagcccatcgacgatcgattcgcgagcgccttgaccgctctcaatgacatgggaaaagtccgcaaggatattcagcaatgggaaccatctagaggttggaacgactggactcaggtgcccttttgctcgcaccatttccacgagctggtaatgaaggatggccgggttctagtggtcccttgtaggaatcaggacgagcttatcgggcgcgccagaatctcacagggagcaggctggagcctgaaagaaacagcttgcctcggtaagtcctacgcccaaatgtggaccctgatgtattttcatcggagggatttgcgattagcagccaacgcgatttgtagtgctgtgccatctcactgggtgccgactagccgtaccacatggtccatacacgccaaacatgagtggatgacgaccgaagacatgctggcagtctggaacagagtttggatccaggagaatccctggatggaagataagactcctgtggagtcatgggaggaagtaccatacctcgggaaacgcgaggaccagtggtgcggaagtcttattggcctgacatctcgggccacctgggctaagaacatccagactgccattaatcaagtgaggagcctaatcggcaacgaagggtatacagactacatgccctccatgaagagattccgccgggaggaagaggaggcaggagtcctgtggtga

SEQ ID NO: 14297 - RNA, 9876 nt, synthetic construct
  misc_feature 1..9876: note = derived and/or modified CDS sequence (opt3) from DENV-2__GU369819__SS-prME
  source 1..9876: mol_type = other RNA
accgccggagtgatagtcatgctgattcccacagctatggcattccacctcactacgagaaacggggagcctcatatgatagttggaaggcaggaaaagggtaaaagccttctgtttaagaccgaggacggagtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggttgacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggagaataaagcatggctcgtccaccggcagtggtttctggacttacctctgccatggctccccggcgctgatactcagggaagcaactggatacagaaggagacacttgtgacgttcaagaatcctcatgccaaaaagcaagacgttgtggtcctgggctctcaggaaggggcgatgcacaccgccttgactggagcaacagagattcagatgtcctcaggtaacctactgtttaccggccatctcaaatgccgtctgcgcatggacaaacttcaactgaaagggatgagctacagtatgtgtacaggaaagttcaagatcgtgaaagaaatcgctgagactcagcacggcaccattgtaatcagagttcagtatgagggtgatgggtctccatgcaagattcccttcgaaataacggacttggagaaaaggcatgtgctcggccggctgatcaccgtcaacccgattgtgacagaaaaggattcccctgtcaatatcgaggccgaacccccatttggagacagctacatcattataggcgtggagcctgggcagttaaaactgaactggttcaagaagggatcgtctatcggtcaaatgtttgagactaccatgcgaggcgctaaacgcatggccattctaggggatacagcatgggacttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccatggtaagggctgattccgggtgtgtggttagctggaagaacaaagaactgaagtgcggatctggcattttcatcactgacaatgtccacacatggaccgagcagtacaagtttcagcccgaatcaccaagtaaattggccagcgcaatacaaaaggcccatgaggaaggtatttgtggcatccggtccgtgactcgcctcgagaacctgatgtggaaacagattacccccgagttaaatcacatcctgtctgaaaacgaggtgaagctaacaataatgacgggggatatcaaaggaattatgcaggctggcaagagatcgctcaggcctcagccaaccgaactgaaatatagctggaagacttgggggaaggccaaaatgctttccacagagtcacataatcaaaccttcttgatcgacggaccggaaacagcagagtgccccaacactaatcgtgcgtggaacagtctggaggtcgaagattacggctttggtgttttcaccacgaatatttggctcaagctgcgggagaaacaggacgtgttttgtgactctaagttaatgagcgctgccatcaaagataaccgagcagtgcacgccgacatggggtattggatagaatccgctctgaatgatacatggaagatggagaaggcctcattcattgaggtaaaaagctgccactggcctaagtctcataccctttggtccaacggagtcttggaaagtgagatgatcatccccaagaatttcgcaggccccgtgagccagcacaattacagacctggttatcatactcagaccgctggcccatggcacctcgggaagctggaaatggactttgatctatgtgagggaacaactgttgtggtcaccgaagactgcggcaacagggggccctctctgcgcacaacgaccgcctccggaaaactcattactgagtggtgctgtcggtcatgcacactgccgcctcttagatacaggggcgaggatggttgttggtacgggatggaaatccgcccattgaaggagaaggaagagaatctggtgaacagtttagttaccgcgggacatggccaaattgacaatttcagcctcggtgtgctgggcatggccctttttctggaagagatgttgcgaactcggatagggacaaaacacgctatcctcctggtagcagtctcgttcgtgaccctaattacgggaaacatgtcctttcgtgatctgggcagagtgatggtcatggttggggccactatgaccgacgatatcggaatgggcgtgacatatctcgctctgcttgccgcattcaaggtaaggcccacctttgcggccggtttgctgttacgcaaactcacttctaaggagctgatgatggctacaattgggatcgcccttctgagccagtcaaccatacctgaaacaatcctagagctcactgacgcactggctttgggaatgatggtgctgaaaattgtccggaatatggaaaagtaccagttagccgtgaccatcatggcaattagttgcgttcccaacgccgtgatcctccaaaatgcttggaaggtctcctgtacgatactggcggccgtgtctgttagcccacttctgttgacatcctcacagcagaaagcagattggattcctctcgctctgaccatcaagggcctaaaccccactgccatcttcctgaccacacttagcagaacaagtaaaaagaggtcttggccactcaatgaggccattatggctgtgggcatggtctccatactggcaagctcgttgctgaaaaacgacatcccgatgaccgggcctttagtagccggaggtctcctgacggtgtgctatgttcttacaggccgatcagcggacctggaattggagcgcgctgccgatgtgaagtgggaggaccaggcagaaatttctgggagttcccccatcctcagcattaccatctctgaggatggaagcatgtccatcaaaaatgaagaggaggaacaaactctgacaatcctaattcggaccggcctgcttgtcatctcaggtgtgtttccagtaagtattcccatcactgccgctgcatggtacctctgggaggtgaagaagcagagagccggggtcctgtgggacgttcctagcccaccccctgtgggaaaagcggaattggaggatggcgcttataggataaagcagaaaggcattttagggtactctcagatcggagccggtgtgtataaggaaggcacattccacaccatgtggcatgtcacgcgtggggcagtgctgatgcaccgcggaaaacggatcgagccgtcctgggccgacgttaagaaggatctcatttcatacggcggtgggtggaaactggagggagaatggaaggagggcgaagaggtacaagtgcttgctctggaaccaggcaaaaaccccagagccgtccagactaagcctgggatctttaaaaccaatacaggaaccataggtgcagtgagtttggacttcagcccaggcacatccgggtctcccattgttgataggaagggaaaggtggtcggcctatacggtaacggggtggtaactcgatcgggagcttatgtcagcgccatcgcgcagaccgagaaatcaattgaggacaaccctgaaatcgaggatgacatatttcggaagaaacgcctgacgattatggatctccatccgggcgccggcaagacaaaaagatacctgcccgcaatcgtgagggaagctatcaagcgggggcttcgaactttaattctggccccaaccagagttgtggctgcagagatggaagaggccctccgcggattgcctatcaggtatcagacacccgccattaagaccgagcacactggtcgtgaaatagtcgacctgatgtgtcatgctaccttcacaatgcggctcctgtccccagtgagagttcctaattacaaccttatcattatggacgaggcgcacttcacggatcccgcaagtatcgccgctaggggctatatctctactcgcgtggaaatgggggaggccgcaggaatttttatgaccgccacaccaccgggcagccgagaccctttcccccaatccaatgctccaataatggatgaggaaagagagatccccgaacggtcatggaactctggtcacgagtgggtcaccgactttaaagggaagactgtgtggttcgtacctagcattaaagcgggaaatgatatcgccgcatgcctgaggaagaacggcaaaaaggtgattcagttgagtcgcaagacatttgactccgaatacgttaaaacccgtgctaatgattgggacttcgtcgtgacgactgatatcagcgagatgggcgccaactttaaggcagagagagtgatagacccacggaggtgtatgaaacccgtcatcctaacagatggggaagaacgcgtaattctggccggacctatgccggtgacccattcttcagctgcccagcgaagaggtcggatcggcaggaatccaaagaacgaaaatgaccaatatatttacatgggggagcccctcgaaaacgacgaggattgcgcgcactggaaagaggcaaagatgttactggacaatatcaacacccctgaaggaataattccctccatgttcgagccagaacgcgagaaagttgatgccatcgacggcgaatacagacttaggggtgaggctcggaagacttttgtggatctgatgcgtcgcggggacctccctgtctggttggcctataaggtggctgcagagggcattaattacgccgatcgaaaatggtgtttcgacggaatcaagaacaaccagatactggaagagaatatcgaagttgagatttggacaaaagagggcgaaagaaagaaactcaagcccaggtggctggatgctcggatctatagtgacccacttgccctaaaggagtttaaagagttcgcagcggggcgcaagagcctgaccttgaacttaattacagagatgggaagactgcctactttcatgacgcagaaagccaggaatgctctcgataacctggccgtgcttcataccgcagaagctggtggccgggcctacaatcacgcactgtcggagctcccggagacattggaaactctgctactgctcacccttctggccacagtcaccgggggaatctttttattcttgatgtctggccgaggtatagggaagatgactctgggcatgtgctgcattatcacggcttccatcctcctgtggtatgcgcagattcaaccccactggatcgccgcaagcataattcttgagtttttcctgatcgtgctcttgattccagaacctgagaaacagagaaccccacaggacaaccagctgacatacgtagtgatcgctatattaactgttgtcgccgccaccatggcaaatgaaatgggatttctagagaagacaaagaaagatctgggcctcgggtcaatcaccactcaagagagtgaatctaacattcttgacatcgacctgcgcccagcttccgcctggacattgtatgcggtggctacgaccttcgtgactcctatgctgaggcatagcattgaaaattcaagtgtcaacgttagcctcacagccatcgcaaatcaggccaccgtgctgatgggacttggtaagggctggcccctctccaaaatggatattggggtaccgctgttggctatcggatgttactctcaggtgaacccaataaccctgacagcagccttactactgctcgtcgcgcactacgctattatcggccctggtcttcaggccaaggcaactcgggaagcccaaaaacgtgctgccgcagggatcatgaagaatcccacggtggacggcattaccgttatagatctggagccaatcccctatgaccctaagtttgaaaaacagttgggacaggtgatgctgctcattctgtgcgtcacacaggtacttatgatgagaactacctgggctttatgtgaggccctgacactcgcgaccggcccgatcagcactttgtgggaggggaaccccggaaggttctggaatacgacaattgccgtgtccatggcaaacatctttcgcggctcatacctggctggtgccgggctactgttctctataatgaagaataccactaacacccggcgaggaacaggcaacatcggtgaaactctcggcgagaaatggaagagtagacttaatgcactggggaaatcggaatttcaagtttataagaaaagcggcattcaggaggtggataggaccttggctaaggagggcatcaagcgcggggaaacagaccatcacgccgtctcccggggatctgccaaactgagatggttcgtggagcgtaacatggtcacgccagaaggcaaggtggttgatctcggttgcgggaggggaggctggtcatactattgtggtggcctgaaaaatgtgcgggaggtaaaggggttaaccaaaggaggccctgggcatgaagaacccattcctatgagcacttacggatggaaccttgtgcgcctgcagtccggcgtcgacgtatttttcacaccacccgagaagtgcgataccctcctatgtgacatcggtgaaagttctcctaatccaactatagaggcggggcgaacactgagagtgttgaacctggtcgaaaattggctcaacaataacacccaattctgcattaaggtgcttaatccctatatgccgagcgtaatcgagaaaatggaagctctgcagaggaagtacggaggcgcattggtgcggaaccctctgtcacgcaattccacgcacgagatgtactgggttagtaacgccaccggcaatatcgtgagctctgtcaacatgatttccagaatgctcataaacaggtttacaatgaaacacaagaaagctacttatgagccagatgtggacttagggtcaggaacccgaaatatcggtattgaaagcgagatccccaacctggatattatcggcaagcggatagaaaagatcaaacaggagcatgaaacatcgtggcactacgaccaggaccatccttataagacttgggcctaccacgggtcttatgagaccaaacaaacaggaagtgcatccagcatggtcaatggcgtggttcgtcttctgaccaagccatgggatgtactacccatggtgactcagatggccatgacggacacaaccccgttcggtcagcagagagtctttaaagagaaggtggatactcgcacccaagaacctaaggaggggacgaaaaagctcatgaaaattacagctgaatggctgtggaaggagttgggcaaaaagaaaacccccaggatgtgtactcgggaggagttcacaagaaaggttcgctcaaacgcggccctgggcgcaatctttaccgacgagaataagtggaaatccgctagggaagccgtggaggatggccgattctgggaactcgtcgaccgggagagaaaccttcacctggaggggaagtgcgaaacttgtgtgtacaatatgatgggaaaaagggagaagaaattaggtgaatttggcaaggcaaaggggtctcgcgccatttggtatatgtggctgggagctcgtttcttggagtttgaagccctcggcttcctgaacgaggatcattggtttagccggggtaatagtctatccggggtagagggagaaggccttcacagactgggctacatcctcagggacgtggggaaaaaggagggaggtgcgatgtacgcagatgacacagccggctgggatacccgcattacactggaagacttgaaaaacgaggaaatggttactaatcatatgaagggggagcacaaaaagctggctgaggccatattcaagctcacctatcagaacaaagtcgtgcgagtgcagcggccaacgcctagaggaaccgtcatggacatcattagcaggcgcgatcagagaggctctggtcaagttgggacatacggacttaatacttttaccaacatggaagcacagctgatccggcagatggagggcgaaggcatcttcaagtcaattcaacatttaacagctactgaggagatagccgtgcagaattggctggctagggtagggcgtgaacgattgagtcgcatggccatctccggagacgattgcgtggtcaaacccattgacgatagattcgcaagcgcgctcaccgccctgaacgacatgggtaaggtgcggaaagatatccagcagtgggagccatctaggggctggaacgactggacgcaagttcccttttgctcgcaccacttccatgagctagtgatgaaggatgggcgcgtccttgtggtaccttgtagaaatcaggacgagctgattggacgggctaggatctcacagggcgccggttggagcctcaaggaaacagcatgcctggggaaatcctatgctcagatgtggaccttgatgtactttcaccgacgtgatttaagactggccgcaaacgccatatgtagtgcggttccaccgcattgggtgcccacttctcgcacaacctggagcatccacgctaagcacgagtggatgactaccgaggacatgctcgccgtctggaatcgggtgtggattcaagaaaacccttggatggaggataaaacaccagtggaatcctgggaggaagtcccctatcttggaaagagggaggaccagtggtgcggctcactgatcggcctaacgagtagagcaacctgggccaaaaatattcagactgctatcaaccaggttcgctctctgatagggaatgaggaatacacagactatatgcctagcatgaagcggttcaggcgagaggaagaggaagccggagtgctctggtga

SEQ ID NO: 14298 - RNA, 9876 nt, synthetic construct
  misc_feature 1..9876: note = derived and/or modified CDS sequence (opt3) from DENV-2__JX649147__SS-prME
  source 1..9876: mol_type = other RNA
accgcaggcgtgatcattatgctgatacccaccgctatggcattccacctcactacgcggaatggggagcctcatatgatcgtcgggaggcaggaaaagggtaaaagccttctgtttaagaccgaggacggcgttaatatgtgcaccttgatggccattgatttaggggaactgtgtgaggacactatcacctacaaatgcccactactccggcaatccgaaccggaggatattgactgttggtgcaactctacgtcaacctgggtgacttatggaacatgtaccacgactggcgagcaccgccgagaaaagcgtagtgtcgcgctggtgccccatgtcggtatggggcttgagacccggacagaaacttggatgagctccgagggagcttggaaacacgcccagaggatcgagacctggatactgcggcatcctggcttcacaatcatggcagccattttggcttacaccatcggcacgactcactttcagaaggcactcattttcatcctgctgacagccgtggctccatctatgaccatgcgctgcatagggatttcgaatagagattttgttgaaggagtgtcaggtggcagctgggtcgacatcgtgctcgagcacgggagttgtgtaactacaatggccaagaacaaacccaccttagatttcgaactgattaagacggaggcgaaagaacctgcaacccttaggaagtattgcatcgaggccaaattgacaaatactaccacagagtcccggtgtccaactcagggagaaccctctctgaacgaggaacaagacaagcgctttgtttgcaagcatagcatggtggatcgaggctggggtaatgggtgtggactattcggcaaaggcgggatcgtaacctgcgctatgtttacatgcaagaaaaacatggagggaaagattgtgcagcctgaaaatctcgagtacaccatagtgatcactccacactccggtgaggaacatgccgtcggcaacgacacggggaaacacggaaaggagattaaaatcacaccgcagtcaagtataaccgaagcagagctgactggctatggtaccgttacaatggaatgtagccccagaaccgggcttgatttcaatgagatggtgctgttgcagatggaggacaaggcttggctcgtacacaggcaatggtttctggatttacctctgccatggctccccggcgccgacactcagggatctaactggattcagaaggaaacacttgtgacgttcaaaaatcctcatgcgaagaaacaggacgtcgtggttctgggctcccaagagggggccatgcacaccgcattgactggagctacagaaatccagatgtcaagcggtaacctactgtttaccggccatctcaagtgccggctgcgtatggataaacttcagctgaaggggatgagttactctatgtgtacaggaaagttcaaaatcgtgaaggagattgccgagactcaacacggcaccatcgtcattcgcgtgcagtatgaaggtgacgggtccccatgcaaaatacccttcgagatcatggatttggaaaagagacatgtactcggcaggctgattacggttaatccgatcgtgaccgagaaagacagccctgtcaacatcgaagctgagcccccatttggagattcgtacattataatcggcgtggagcctgggcagttaaagctgaactggttcaagaaaggatcttccattggtcagatgtttgaaacaactatgcggggcgccaagcgaatggcaatcctaggggacaccgcctgggatttcggatcactcggcggtgtctttacaagtattgggaaagctctgcaccaagtgttcggcgcgatctacggagcagcctttagcggcgtttcctggactatgaagatacttatcggggtgattatcacctggattggaatgaactctcgcagcacgtcattgagtgtatccctggtcctcgtgggcgttatcacactgtatcttggtgctatggtgcaggccgacagcgggtgtgtcgtgtcttggaaaaacaaggagctgaagtgcggatcaggcatattcattaccgataatgtacacacttggacagaacagtacaaatttcagcccgagagtccaagcaagttggcatccgccatccaaaaagctcatgaagagggtatttgtggcatcagatctgtgaccaggctcgagaacctgatgtggaagcagataactcccgaattaaatcacatcctgtcggagaacgaagttaaactaaccattatgacaggggacatcaagggaattatgcaggccggcaaacggagcctccgccctcagccaacggagctgaagtattcctggaagacctgggggaaagcaaagatgctttcaactgaaagtcataatcaaacattcttgatcgatggaccggagaccgcggagtgccccaacaaaaatagagcttggaactctctggaagtcgaggactacggctttggtgtgttcacaactaatatatggctcaagctgagggaaaaacaggacgtgttttgtgatagcaagttaatgtccgccgcaattaaggacaaccgtgccgtccacgctgatatggggtattggatcgagtcagccctgaatgacacctggaaaatggagaaggccagcttcatcgaagttaaatcttgccactggcctaagtcccatacgctttggagtaacggagtgttggagagcgaaatgattatcccaaaatctttcgctggccccgtgtcccagcacaattaccggcctggttattacacacagaccgccggcccatggcatctcgggaagctggagatggattttgacttctgtgaaggaactaccgtagtcgtgacagaggattgcggcaaccgagggccctcactaagaactaccacagcgagtggaaagctgattacggagtggtgctgtaggagctgcaccctcccgcctctgcgctaccggggcgaagacggttgttggtatgggatggagataagaccacttaaagaaaaggaggaaaacttggttaattcgctggtgactgccggacacggccaaatcgataacttttccttaggtgtcctcggcatggctctgttccttgaggagatgctgaggacacgcgtggggaccaaacatgcaattttgctcgttgccgtgtcttttgtaactctgatcacaggaaatatgagcttccgagacctaggccgggtcatggtgatggtgggggctaccatgacggatgacattggaatgggcgtcacttacctggccctcctggcagcgtttaaggttcgtcccaccttcgccgctggtcttttgctgaaaaagttaacatcaaaggaactcatgatggccaccatcgggatagcactgcttagtcagtccactatccctgagacaattctggaactaaccgatgctctcgccctgggaatgatggtgttgaaaatcgtaagaaacatggagaagtatcagctggcagtgacaattatggccatctcttgcgtccccaatgctgtgatattacaaaacgcgtggaaagttagctgtactattctcgccgcagtgtccgtctcaccactgcttctgaccagcagtcagcagaaggctgactggatccctttggccctcacgatcaaaggcctgaatcccacagccatttttctaaccactctgtctaggacctccaagaaacgcagctggccacttaacgaagctataatggcagtgggcatggtttcgatcctcgcctcatctctgttgaagaatgacattccgatgacagggcctctggtggcgggaggtttactcactgtctgctacgtactgaccggccggagtgctgatcttgagctggagagagccacggacgtgaagtgggaagatcaggcagagatctccgggagctctcccattttgagcatcacaatatccgaagacggatcaatgagtatcaaaaacgaggaggaagaacaaaccctcactattctgatcaggacaggcctactggttattagcggtcttttcccaatgtctatccccataaccgccgctgcatggtatctctgggaagtgaagaaacagcgagccggggtcctgtgggatgtgccttccccaccccctgtaggaaaggcggagttggaagacggcgcttaccgcattaaacagaagggcatcttagggtattcacagatcggagccggtgtgtacaaggagggcacttttcacacaatgtggcacgtcaccagaggggcagttctgatgcatagaggaaaaaggattgagccgagttgggccgatgtgaagaaagacctcatcagctacggcggtgggtggaagctggaaggagagtggaaagaaggcgaggaagtgcaagtccttgctctggagccaggcaagaatccccgtgccgtgcagacgaagcctgggttgttcaaaactaacaccggaacaataggtgcagtttccctagatttttctccaggcacctcggggagccccattgtagaccgcaagggaaaagtggtcggcctgtatggtaatggggtggttacacggtcaggagcttacgtgtccgccatcgcgcagactgagaagagtattgaagataaccctgagatcgaagacgatatattcaggaagaagaggctcaccattatggacctgcacccgggcgccggcaagacgaaacgatatcttcccgcaatcgtccgggaggctatcaagcgcgggttaagaacactgattctcgccccaactagggtggtagctgcagaaatggaggaggccttgcggggactgcctatccgataccagacccccgccattagagctgaacatacaggtcgcgagatagtcgacctcatgtgtcacgcgaccttcactatgaggctgctttctccagtgcgtgttcctaattataacctgatcattatggatgaagcacattttaccgaccccgccagcatcgctgcccggggctacatctccacaagagtggagatgggggaggcagccggaattttcatgacggctactccaccgggctcaagggatccttttccccaatctaacgcgccaataatggacgaagaacgcgaaatccccgagcgaagctggaatagtggtcacgaatgggtcaccgatttcaaagggaagacagtgtggtttgttccttccattaaagccggaaacgacatcgcagcttgcttgagaaagaatggcaagaaagtgattcagctaagccggaagaccttcgattctgagtatgtcaaaactaggacaaacgactgggattttgtggtaaccacggacatctcagagatgggcgccaatttcaaggcagaacgcgtgatagatccacgtagatgtatgaaacccgttatcctgactgacggggaggaacgggtcattctcgccggacctatgccggtgacacactccagtgctgcccagaggcgcggtcgaatcggcagaaacccaaagaatgagaacgaccaatacatttacatgggggaacccttagagaatgatgaggactgcgcgcattggaaagaagcaaagatgctgcttgataacatcaatacccctgagggaataattcccagcatgtttgaaccagagcgggaaaaggtggacgccatcgatggcgagtataggctgcgcggtgaggctagaaaaaccttcgtcgacctcatgaggagaggggatttgcctgtatggctggcctaccgtgtggctgcagaaggcattaactatgccgaccgccgatggtgttttgatggagttaagaataaccagatcctcgaggaaaatgtggaggtcgagatatggactaaagaaggcgagagaaagaaactgaagcccaggtggcttgacgctcggatctactcggatccactagccctgaaggagttcaaagagttcgcagcggggcgcaagtctttgacattaaacctgattaccgaaatgggaagactccctacatttatgactcagaaagccagggacgctctggataaccttgccgtgctgcacacggcagaggctggtggccgggcctataatcatgcactctccgagttgccggaaaccctggagacactactgctccttactctgttagccaccgttacagggggaatcttcttgtttctgatgagcggcaagggtgtggggaaaatgaccctcggcatgtgctgcattatcactgcttcaatactgctttggtacgcgcagattcaaccccactggatcgccgcaagtatcattctggagttctttctcatcgtcttgctgataccagagcctgaaaagcagcgaacgccccaggacaaccagttaacctatgtggtaattgctatcctaacagtggttgccgccactatggcaaatgagatgggattcctggagaagaccaaaaaggacctcggccttgggtctattgctacacaagaaccagagtccaacatcctggatatagacttgagacctgccagcgcgtggaccctgtacgctgtcgccactacatttgtgacgcccatgctccgccactcaatcgaaaatagtagcgtgaacgtctccctgaccgcaattgccaatcaggctactgttcttatgggactcggtaaaggctggccgctgtctaagatggatatcggggtgccattgctggcaattggatgttacagccaggtaaaccctatcacattaaccgccgcgctactgctccttattgctcattatgccatcataggccccggtctgcaggcaaaagccaccagggaggctcaaaagcgggccgcagctgggattatgaagaatccaacagtggacggcatcactgtcatcgatttggaccccattccttacgatccgaaattcgaaaagcagctgggacaggtgatgctcctgatactttgcgttacacaggtgttaatgatgcgtaccacatgggccctgtgtgaggcgctcactttggccaccggccccatctccacactgtgggaggggaacccaggaagattttggaataccactattgcagtctcaatggctaacatcttcaggggctcttatctagccggtgcagggctgctctttagtattatgaaaaatacgacaaacacccgccggggaactggcaatatcggtgaaacccttggcgagaagtggaaatcgcgactgaacgctttgggaaagagcgagttccaaatatacaaaaagtccggaatccaggaggtagacagaacactggccaaggagggcattaaaagaggggaaactgatcaccatgccgtgtctcgcggatcagcgaagctccggtggtttgttgagagaaatatggtgacccctgaaggcaaagtcgtggacctgggttgcgggcgtggaggctggagctattactgtggtggcttaaagaacgtcagggaggtgaaagggcttacaaagggaggccccgggcacgaagaacctatcccaatgtccacgtatggatggaacctggttcggctccagagtggcgtggatgtattcttcacaccccctgagaagtgcgacactctactgtgtgatattggtgaatctagcccaaatcccacaatcgaggctgggcgcaccttgcgagtgctgtcactcgtcgaaaactggcttaataacgacactcaattttgcataaaagttctgaatccgtacatgccttccgtgattgagaagatggaaacattgcagagaaaatacggaggcgcactggtcaggaacccactcagtcggaatagcacccatgagatgtattgggtgtctaacgccacgggcaatatcgtatcctcagtgaacatgatcagccgcatgttaattaatagattcaccatgaagcacaaaaaggctacatacgagcccgacgttgatctggggtcgggaactaggaacataggtatcgaatctgagattcctaatcttgacatcattggcaagcgaatcgagaaaataaagcaggaacacgaaaccagttggcattatgatcaggaccacccatacaaaacatgggcctatcatgggtcctacgagactaagcaaaccggaagcgcatcatccatggtgaacggcgtcgtgcggctgctaacaaaaccctgggatgtcgtgccgatggttacccagatggccatgactgacacgacaccttttggtcagcagcgtgtattcaaggagaaggtggataccagaactcaagaacccaaagaggggaccaagaaactcatgaagatcacagctgaatggctgtggaaagagttgggaaagaaaaagacgccacgcatgtgtaccagggaggaatttactcggaaggtcagatctaatgcggccctgggcgcaattttcacagacgagaacaaatggaaaagcgctcgcgaagccgtggaggatagtaggttttgggaactcgttgacaaagagcgaaaccttcacctggagggcaagtgcgaaacctgtgtgtataatatgatggggaaacgggagaagaagttaggagagttcggtaaagcaaagggctccagagccatctggtacatgtggctgggggctaggtttttggagttcgaagccctcggatttctgaacgaggatcactggttcagccgcgaaaattctctatcaggcgtcgaaggtgaggggcttcataaactgggatacattctccgtgacgtgagtaagaaagaaggcggcgcgatgtatgcagacgatactgccgggtgggacacacggatcaccctggaggatttgaagaacgaagagatggtaacaaatcacatggagggagaacataagaaactggctgaggccatttttaagctcacttaccagaacaaagtggttagagtccagaggcctacaccccgcggtacggtgatggacataatctcccgacgggatcagagaggcagcgggcaagtgggaacctatggccttaatacattcactaacatggaagcacagctgattaggcagatggagggtgaggggatcttcaagtctatccaacacttaaccgtcacagaagagattgctgttcaggactggctggcccgcgtgggaagagaacggttgtcgaggatggctatatcaggcgatgactgcgtagtgaaaccactcgatgaccgttttgccagcgcactgactgcgctaaatgatatgggcaaggtccgaaaggacatccagcagtgggagccctcccgcgggtggaacgattggacccaagtgcctttctgcagtcatcactttcacgaacttattatgaaagacggaagagttctggtggtcccatgtcggaatcaggacgagctcatcggtagggcccgcatttctcagggcgctgggtggagcctgaaggagacggcctgcttgggaaaatcctacgcacagatgtggtcattaatgtatttccatagacgggatctgaggctcgctgccaacgcaatctgtagtgccgtgccgtctcactgggtacccacaagccgaaccacttggtccatacatgcgaagcacgaatggatgacaaccgaggacatgcttactgtttggaatcgtgtgtggatccaagaaaacccttggatggaggataaaaccccagtcgaatcatgggaggaggtgccctacctgggcaagagagaagaccagtggtgcggtagcctaattgggctgacatctcgcgctacgtgggccaagaatatccagaccgcaattaaccaggtgcggtccctcatcggaaacgaggaatatactgattacatgcctagtatgaaaaggtttagacgcgaggaagaggaggccggcgtcttgtggtga

SEQ ID NO: 14299 - RNA, 9876 nt, synthetic construct
  misc_feature 1..9876: note = derived and/or modified CDS sequence (opt3) from DENV-2__KF704356__SS-prME
  source 1..9876: mol_type = other RNA
accgccggaatgatcattatgctgatacccacagtgatggctttccacctcactacgaggaacggggaacctcatatgatcgtcagcaggcaggaaaagggaaaatcccttctgtttaataccggtgacggagttcacatgtgcacattgatggcaatgcatttaggggagctgtgtgaagatactattacctacaagtgcccactactccggcaaaacgagccggaagacatcgattgttggtgcaattctacatcaacctgggtgacttatggaacatgtaccacgactggcgagcaccgccgagagaaacgtagtgtcgccctggtgccccatgtcggtatggggcttgaaaccaggacagagacttggatgagctccgaaggagcgtggaagcacgctcagaggattgagacctggatcctgcggcaccctggcttcacaataatggccgcaatcttggcctacaccattggcacgactcattttcagcgcgctctcatcttcattctgctgacagcagtggccccatctatgaccatgagatgcatcgggatatcgaacagggactttgttgagggagtgtcaggtggcagctgggtcgatattgtgctcgaacacgggagttgtgtaactacaatggctaaaaataagcccaccttagacctggagcttatcaagacggaagccaaacagcctgcgaccttgcggaagtattgcattgaggcaaaactgacaaacactaccacagaatcccgctgtccaactcaaggagagccctctctaaatgaggaacaggataagcgattcgtttgcaaacatagcatggtggacagaggctggggtaacgggtgtggactctttggcaagggctccatcgtaacctgcgccatgttcacatgcaagaaaatcatgaaggggaaagtggtgcagcctgagaatctggaatacaccattgtcataactccacactcaggagaggaacacgctgttggtaacgatacgggcaagcatgggaaagagatcaagattacaccgcagagtagcatcaccgaggccgaacttactggatatggcaccgtgacaatggagtgttctcccaggaccggtctggactttaatgaaatggtattgctccaaatggaggataaagcatggctggtgcaccggcagtggttcttagacctgcctctcccatggcttcccggggctgatactcagggctccaactggatacagaaggaaacactggtcacgtttaagaatcctcatgccaaaaagcaagacgtggttgtgttgggatcacaggagggcgcgatgcacaccgccctaactggggcaacagagattcagatgagcagtggaaacgtcctgttcaccggtcatctcaaatgccgtctgcgcatggacaaacttcaactgaaaggcatgtcttactccatgtgtacagggaagtttaaggtggtaaaagaaatcgctgagactcagcacggaaccatcgttattagagtgcagtatgaaggcgatggtagcccatgcaagatccccttcgagattatggacttggagaaaaggcacgtcctcgggcggctgataacggtgaatccgatcgtcaccggcaaggattcgcctgtgaacattgaagccgagcccccattcggagactcttacatcatcattggcgttgaacctgggcagttaaaactgaactggtttaagaagggatcctcaataggtcaaatgttcgctacaactatgcgaggcgccaaacgcatggcaatcctaggggataccgcctgggactttggaagtctcggcggtgtgttcacaagcattgggaaggctctgcatcaggtatttggcgcgatctacggagcagccttctccggcgtctcttggactatgaaaattcttatcggggtgataatcacctggattggaatgaatagcagatcaacgagtttgtccgttagcctggtgctcgtcggcgtggtaacactgtatcttggtgtgatggttcaggctgattctgggtgtgtcgtgtcatggaagaacaaagagctgaagtgcggaagtggcatctttattaccgacaatgtgcacacttggacagaacagtacaagttccaacccgagagcccatccaaattggcctctgcaatccagaaggcccatgaggaaggtatatgtggcattaggtcggtcacccggctcgagaacctgatgtggaaacagatcactcccgaattaaatcacattctgagcgagaacgaagttaagctaaccatcatgacaggggatataaaaggaatcatgcaggctggcaagcgctccctcagacctcaaccaacggagctgaaatattcatggaagacctgggggaaggccaaaatgcttagtactgagtctcacaatcagacatttttgattgacggaccggaaaccgcagagtgccccaacacaaatagggcgtggaacagcctggaagtggaggattacggcttcggtgtgtttactaccaatatctggctcaagctgcgtgaagaacaggacgtattctgtgactccaaattaatgtcagctgccattaaggataaccgggcagtccatgccgacatggggtattggatcgagagcgctctgaatgatacgtggaaaatagaaaaggcctcttttattgaggtgaagtcctgccactggcctaaaagtcatacactttggagcaacggagttttggaatctgagatgatcatcccaaagaatttcgcaggccccgtgtcccagcacaactaccgacctggttatcatacccaaactgctggcccatggcacctcgggaaactggagatggacttcgatttttgtgaaggaaccacagtcgtggttactgaggactgcggcaacagagggccctcactaaggaccacaacggccagtggaaagctgattaccgaatggtgctgtcgcagctgcactctcccgcctctgcggtacagaggcgaggatggttgttggtacgggatggaaatcaggccacttaaagagaaggaggaaaatttggtgaactcgctggtaacagcgggacacggccagattgacaatttctccttaggtgtcctcggcatggccctgtttcttgaggaaatgctgcgcacccgagtggggactaagcatgctatattgctcgtggcagtctctttcgttacactgatcaccggaaacatgagctttcgggatctaggccgtgtgatggtaatggtgggggccacgatgactgacgatattggaatgggcgtcacctatctggctctcctggccgcattcaaagtgagacccacatttgcggccggtcttttgctgaggaagttaacctcaaaagagctcatgatgactacaatcgggattgttctgcttagtcagtccaccatccctgaaacaatactggagctaactgacgctctcgccctgggaatgatggtgttgaagatggtccgcaaaatggagaagtaccaactggcagtgaccatcatggctattttatgcgttcccaatgccgtgatcctccagaacacgtggaaggtctcttgtacaattctggcagtagtgagcgtttccccacttttcctgacctcaagccagcagaaagccgattggatccctttggctctcactataaagggcctgaatcccaccgcgatttttctaacaactctgagtcggaccaacaaaaagagatcttggccacttaatgaagccatcatggcagtgggcatggtctccatcctcgctagctcgctgttgaaaaacgacattccgatgacggggcctctggtggccggaggtttactcacagtatgctatgtgctgaccggcaggtcagccgaccttgagctggaacgagctgcagatgtcaagtgggaggaccaagccgaaatatctgggagttcccccatcttgagcattactatctctgaggatggaagcatgtccattaaaaatgaggaagaggaacagacactcaccatcctgatacgcactggcctactggttatctcaggtcttttcccagtgagtattcccatcacagcggctgcctggtacctctgggaggtgaagaagcagcgggcaggggtcctgtgggacgtgcctagcccaccccctgttggaaaagccgagttggaagatggcgcttatagaattaagcagaaaggcatcttagggtactctcaaataggagccggtgtatataaggagggcacctttcacacgatgtggcatgtgactagaggggcagtcctgatgcacaaaggaaagcgtattgaaccgtcctgggcggacgtgaagaaagatctcatctcatacggcggtgggtggaagctggagggagaatggaaagagggcgaggaagttcaggtgcttgctctggagccaggcaagaacccccgcgccgtccagaccaaacctgggttgttcaagacaaatgcaggaaccatcggtgccgtgagtctagactttagcccaggcacatccgggtctcccattatcgatcggaagggaaaagtagtcggcctgtacggtaacggggtggttactagatcgggagcttatgtgagcgccatagcacagaccgaaaagtcaattgaggacaatcctgaaatcgaggatgacattttcaggaaacgaaagctcacgatcatggatctgcatccgggcgctggcaaaacaaagcggtaccttcccgccatagtccgcgaggcgattaagagagggttaaggactctgatcctcgccccaacccgggtggttgcagctgaaatggaggaagccttgcgaggactgcctatcagatatcaaacacccgctattcgcgcagagcacaccggtagggaaatcgtggacctcatgtgtcacgccactttcaccatgcgtctgctttccccagtccgggtgcctaactacaacctgattataatggacgaggcccattttacagatcccgctagtatcgcggcaagaggctatatttctacgagggtagagatgggggaagccgctggaatcttcatgactgccaccccaccgggcagccgcgacccttttccccagtccaatgcaccaatcatggatgaggaacgagagattcccgagagatcatggtctagcggtcacgaatgggtgacagacttcaaagggaagaccgtttggtttgtccctagtatacgggccggaaacgatatcgctgcgtgcttgaggaaaaatggcaagaaagtgattcagctatcccgcaagactttcgacagcgagtacgtgaagacacgtaccaacgattgggactttgtcgtaacgactgatatctctgaaatgggcgccaatttcaaagcagagagagtgattgacccacggaggtgtatgaagcccgttatcctgacagatggggaagaacgcgtgatactcgctggacctatgccggtcacccattcatccgccgcacaacgaagaggtcggatcggcaggaaccccaagaatgagaacgaccagtatatttacatgggggaacccttagagaatgacgaagattgcgcccactggaaggaggctaaaatgctgcttgacaacatcaatacccctgaaggaattatccccagtatgtttgagccagagcgcgaaaaggtggatgccatagacggcgagtacagactgaggggtgaagcgcggaaaactttcgttgatctcatgcgtcgcggggacttgcctgtgtggctggcatatcgagtcgccgctgagggcattaactacgccgatagaaggtggtgttttgacggaatcaagaataaccagattctcgaagagaatgtggaggtagaaatctggacaaaggagggcgaacggaaaaagctgaaaccccgctggcttgatgctagaatatatagcgacccactagcactgaaggagttcaaagagttcgccgctgggaggaagtcgttgaccttaaacctgatcacagaaatgggacggctccctacttttatgacgcagaaggcccgagatgcactggacaaccttgcggtgctgcacaccgccgaggctggtggcagagcctacaatcatgcactctctgaattgccggagacactggaaactctactgctccttaccctgttagctacagttaccgggggaattttcttgtttctgatgtccggccgcggtatcgggaaaatgactctcggcatgtgctgcattatcacggccagcatactgctttggtatgcacaaattcagccccactggatcgccgcttcaatcattctggagttctttctcatcgtcttgctgataccagagcctgaaaagcagaggaccccacaggataaccaattaacatacgtggtgattgcgatcctaactgtcgttgccgcaaccatggctaatgagatgggattcctggagaaaacaaagaaagacctcggccttgggagtattaccactcagcagccagagtctaacatcctggacatagatttgcggcctgcctccgcctggacactgtatgcagtggctacgacctttgtaactcccatgctccgtcatagcatcgaaaattcaagtgtgaacgtcagcctgacagccattgcgaatcaggctaccgtgcttatgggactcggtaagggctggccgctgtccaagatggacatcggggttccattgctggccattggatgttactctcaagtgaaccctatcaccttaacagcagccctattcctgctcgtcgctcactacgcaattatcggccccggtcttcaggccaaagcgactagagaggctcagaagagggccgcagccgggataatgaaaaatccaacggtagatggcattaccgtgatcgacctggatcccatcccttatgacccgaagtttgagaaacagttgggacaagttatgctgctcgtgctgtgcgtcacacaggtgcttatgatgcgcactacctgggctttatgtgaagccctgacactcgcaaccggccccattagcactttgtgggaggggaacccaggacggttctggaatacgacaatagctgtctccatggccaacatctttcgaggctcatacctggcgggtgccgggctactgttctctattatgaagaataccactaacaccagaaggggaacaggcaatatgggtgaaactctcggcgagaagtggaaaagtcgccttaacgcactggggaagtcggaatttcagatctataaaaagagcggcattcaagaggtggatcggaccttggctaaagagggcatcaagagaggggaaacagaccatcacgccgtttcccgtggatctgcaaaactgaggtggttcgtggagcggaatatggtaacgcctgaaggcaaggtggtcgatctcggttgcgggcgcggaggctggtcatactattgtggtggcctgaagaacgttcgagaggtgaaagggttaaccaagggaggccccgggcacgaggaacctataccaatgagcacttacggatggaaccttgtcagactgcagtccggcgtggacgtattctttacaccccctgagaaatgcgataccctcctatgtgacatcggtgaaagttctccaaatcccactgtggaggctgggaggacactgcgggttttgaacctggtggaaaattggctcaacaataacacccagttctgcattaaggtccttaatccgtatatgcctagcgtgatcgagaaaatggaggccctgcagcgcaagtacggaggcgccttggtcagaaacccactgtcaagaaattccacgcatgaaatgtactgggtgagtaacgcgagcggcaatattgtttcttccgtaaacatgatctcacgaatgctcataaatcggtttaccatgcgtcacaagaaagctacattcgagcccgatgtggacttagggagcggaactagaaacattggtatcgaatcggagatccctaatctggacattataggcaagcgcatcgagaaaattaagcaagagtatgagacctcttggcattacgatcaggaccacccatataaaacatgggcataccacgggagttatgaaactaagcagaccggatccgccagctcaatggtcaacggcgtggttaggcttctgacaaagccctgggatgtggtcccgatggtgacccagatggctatgactgacacgacaccttttggtcaacagcgggtattcaaagagaaggtggataccagaactcaggaacccaaagaggggaccaagaaactaatgaagatcacagccgaatggctctggaaggagctgggcaaaaagaaaacgccacgcatgtgtaccagggaggaatttactcgaaaggttcggtccaacgcagccttgggcgctattttcacagacgagaataaatggaagtctgcgagagaagccgtcgaggatagcaggttttgggagctggtggacaaagaacgcaacctccatcttgagggcaagtgcgaaacctgtgtgtacaatatgatggggaagcgtgagaaaaagctgggagagttcggtaaagcaaagggcagtcgggctatctggtatatgtggttaggggccagatttctggagttcgaggcattgggatttctcaacgaagatcactggttctccagggagaatagcctgtctggcgtcgaaggtgaggggctacataaacttggatacatactgcgcgacgtttcaaagaaggaaggcggcgccatgtacgctgatgacactgccgggtgggacacacgaatcaccctcgaggatctgaaaaacgaggaaatggtgacaaatcacatggagggagaacataagaaattggcggaggcaattttcaagctgacttatcagaacaaagtagtgcgggtccaaagacctacccccaggggtacggtgatggacatcattagtcgcagagatcagcggggctccgggcaggttggaacctacggcctcaatacatttactaacatggaagcccaacttatcaggcagatggagggtgagggggtgttcaagaatattcagcacctgaccgtcacagaagagatagctgtgcagaactggttagcccgtgtaggacgagaacgcctgagcagaatggcaatctctggcgacgattgcgttgtgaagccattggacgatcggtttgcttcggccctcactgctctgaatgacatgggcaaagtcaggaaggatattcaacagtgggagccctcacgcgggtggaacgactggacccaggtgcctttctgcagccaccattttcacgagctaatcatgaaagatggaagagtgcttgtcgttccatgtcggaatcaggacgaactgatcggtagggcccgaatttcccaaggcgcagggtggagtctccgtgagacggcgtgcctgggaaagtcttatgcccagatgtggagcttgatgtacttccatagacgcgatttacggctggctgccaacgcaatatgttccgctgtgccgtcacactgggtacccacaagtaggaccacttggtctatccacgccaaacatgaatggatgacaaccgaggacatgctcactgtgtggaacagagtctggattcaggaaaatccttggatggaggacaagaccccagtggagagctgggaagagatcccctatcttggcaagcgcgaagatcagtggtgcggttccctgattgggctaacatcacgggcaacgtgggccaaaaacatccaaaccgcgataaatcaggttaggagcctgatcggaaacgaggaatacactgactatatgccttctatgaagcgatttagacgggaggaggaagaggctggcgtgctctggtga

SEQ ID NO: 14300 - RNA, 9876 nt, synthetic construct
  misc_feature 1..9876: note = derived and/or modified CDS sequence (opt3) from DENV-2__KF704355__SS-prME
  source 1..9876: mol_type = other RNA
accgccggcatgatcattatgctgatacccacagtgatggctttccacctcactacgaggaacggggagcctcatatgatcgtctcaaggcaggaaaagggaaaatcccttctgtttaagaccggtgacggcgttaatatgtgcacattgatggcgatggatttaggggagctgtgtgaagacactattacctacaaatgcccattcctacggcaaaacgagccggaagatatcgactgttggtgcaattctacatcaacctgggtgacttatggaacatgtaccacgactggcgagcaccgccgagagaagcgtagtgtcgccctcgtgccccatgtcggtatggggctggaaaccaggacagagacttggatgagctccgaaggagcgtggaaacacgctcagaggattgagacctggatccttcggcatcctggctttacaataatggccgcaatcctggcctacaccattggcacgactcacttccagcgcgctttgatctttattctcctgacagcagtggccccatctatgaccatgagatgcatcgggatatcgaacagggatttcgttgagggagtgtcaggtggcagctgggtcgacattgtgctggaacacgggagttgtgtaactacaatggctaagaataagcccaccctcgatttagagctgatcaaaacggaagccaagcagcctgcgacccttcggaaatattgcattgaggcaaagttgacaaacactaccacagaatcccgctgtccaactcaaggagagccctctctgaatgaggaacaggacaaacgatttgtttgcaagcatagcatggtggatagaggctggggtaacgggtgtggactattcggcaagggctccatcgtaacctgcgccatgtttacatgcaaaaagatcatgaaagggaaggtggtgcagcctgagaatctcgaatacaccattgtcataactccacactcaggagaggaacatgctgttggtaacgacacgggcaaatatgggaaggagatcaaaattacaccgcagagtagcatcaccgaggccgaactgactggatacggcaccgtgacaatggagtgttctcccaggaccggtcttgatttcaatgaaatggtactgttgcaaatggaggacaaggcatggctcgtgcaccggcagtggtttctggatttacctctgccatggctccccggggctgacactcagggctccaactggatacagaaggaaacacttgtcacgttcaaaaatcctcacgccaagaaacaagacgtggttgtgctgggatcacaggagggcgcgatgcataccgccttgactggggcaacagagattcagatgagcagtggaaacgtcctatttaccggtcacctgaagtgccgtctccgcatggataaactgcaacttaagggcatgtcttattccatgtgtacagggaagttcaaagtggtaaaggaaatcgctgagactcagcatggaaccatcgttattagagtgcagtacgaaggcgacggtagcccatgcaaaatccccttcgagattatggatctggagaagaggcacgtcttggggcggctcataacggtgaatccgatcgtcaccggcaaagactcgcctgtgaacattgaagccgagcccccatttggagattcttacatcatcattggcgttgaacctgggcagctgaagttaaactggttcaagaaaggatcctcaataggtcaaatgtttggcacaactatgcgaggggctaagcgcatggccatcctgggagacaccgcatgggatttcggcagtctaggtggggtgtttacaagcattggcaaagccctccatcaggtattcggagctatctatggcgcggcattttccggggtctcttggactatgaagattctgaccggagtgatcataacgtggatcggcatgaatagcagatcaacaagtctttccgttagcttggtgctggtcggtgtggtaaccctctacctgggggtgatggttcaggccgactctggatgtgtcgtgtcatggaaaaacaaggagcttaagtgcggcagtggtattttcatcactgataatgtgcacacatggaccgaacagtataaatttcaacccgagagcccatccaagctggcttctgccattcagaaagcacacgaggaaggcatctgtgggataaggtcggtcactcggttggagaacctcatgtggaagcagattacccccgaactgaatcatatcttaagcgagaacgaagttaaactgacaattatgacgggagacatcaagggcataatgcaggccgggaaacgctccctaagacctcaaccaaccgagctcaagtactcatggaagacttggggaaaagctaagatgctgagtacagagtctcacaatcagaccttccttatcgatggcccggaaacagccgagtgccccaacactaatagggcatggaacagcttggaagtggaggactatggttttggggtgttcaccacgaatatttggctgaaactccgtgaaaagcaggacgtattttgtgattccaaactgatgtcagcggctatcaaggacaaccgggccgtccatgcagatatgggatactggattgagagcgccttaaatgacacatggaagatcgagaaggcttctttcatagaagtgaagtcctgccactggcctaaaagtcacaccctgtggagcaacggcgttcttgagtctgaaatgattatcccaaagaatttcgccggtcccgtgtcccagcataactatcgacctggctaccacactcaaaccgcagggccatggcatttgggaaaactcgagatggattttgacttctgtgagggcacaactgtcgtggttaccgaagattgcgggaacagaggaccctcactgaggacaacgaccgctagtggcaagctaatcactgagtggtgctgtcgcagctgcacactgccgcctctccggtacagaggtgaagacgggtgttggtatggaatggagattaggccactgaaggaaaaagaggagaatcttgtgaactcgttggtaaccgccggccacggtcagatcgataatttttccctgggcgtcttagggatggcactcttcctggaagagatgcttcgcactcgagtgggaacaaagcatgccattctgttggtggctgtctcttttgttaccctcataacgggcaacatgagcttccgggacctggggcgtgtgatggtaatggtgggagcaactatgaccgatgacatcggcatgggtgtcacatacctagccctgctcgctgcctttaaagtgagacccaccttcgcagcggggctgcttttgaggaagctgacttcaaaagaattaatgatgacaaccattggaatcgttctcctgagtcagtccacaattcctgagactatccttgaactgaccgatgccctagctctcggcatgatggtgctgaagatggtccgcaagatggagaaatatcaattggccgtgacgataatggcaatcctgtgcgttcccaatgctgtgattttacagaacgcctggaaggtctcttgtacaatcctcgcagtagtgagcgtttccccactgtttcttacctcaagccagcagaaagccgactggattcctctggctttgactatcaagggcctcaatcccaccgcgatattcctgacaactctaagtcggaccaacaaaaagagatcttggccactgaatgaggccattatggcagtggggatggtctccatccttgctagctcgctcctgaaaaacgacatcccgatgacgggacctttggtggccggtggcctgttaacagtatgctacgtgctcaccgggaggtcagccgatctggaacttgagcgagctgcagacgtcaagtgggaagatcaagccgagatttctggaagttcccccatactgagcatcactatttctgaagacggcagcatgtccatcaagaatgaggaggaggaacagacattgaccattctcatccgcactggtctgctagttatatcagggctgtttccagtgagtatccccattacagcggctgcctggtatctttgggaagtgaaaaagcagcgggcaggagtcctctgggatgtgcctagcccaccccctgttggcaaagccgagctggaggacggcgcttacagaatcaagcagaaagggattttgggatattctcaaatcggtgcaggcgtatacaaggaagggaccttccacacgatgtggcacgtgactaggggagccgtcttaatgcataagggcaaacgtatagagccgtcctgggcggatgtgaagaaagacctgatttcatacggtgggggatggaagctcgaaggcgagtggaaagaaggcgaggaggttcaggtgctggctcttgaaccagggaagaacccccgcgccgtccagaccaagcctggactgtttaaaacaaatgcaggtaccatcggcgccgtgagtttggatttcagcccagggacatccggatctcccatcattgaccggaagggcaaagtagtcggtctatatgggaacggagtggttactagatcgggcgcttacgtgagcgccatcgcacagaccgagaagtcaatagaagataatcctgagattgaagacgatatcttcaggaaacgaaagctgacgattatggacctccacccgggcgctgggaagacaaaacggtatctgcccgccatcgtccgcgaggcgataaagagaggacttaggactttaattctggccccaacccgggtggttgcagctgagatggaagaggccctccgaggtttgcctatcagataccaaacacccgctatccgcgcagaacataccggcagggagattgtggacctgatgtgtcacgccacttttaccatgcgtctcctgtccccagtccgggtgcctaactataaccttatcattatggatgaagcccatttcacagaccccgctagtatagcggcaagagggtacatctctacgagggtagagatgggagaggccgctggcatttttatgactgccaccccaccgggtagccgcgatcctttcccccagtccaatgcaccaatcatggacgaagaacgagaaatccccgagagatcatggtctagcgggcacgagtgggtgacagattttaaaggaaagaccgtttggttcgtccctagtattcgggccggcaacgacatagctgcgtgcctgaggaaaaatggcaagaaggtgatccagttgtcccgcaaaacttttgatagcgaatatgtgaagacacgtaccaacgactgggatttcgtcgtaacgactgacatttctgagatgggggccaattttaaagcagaaagagtgatcgatccacggaggtgtatgaagcccgttattctaacagacggagaggaacgcgtgatcctggctggtcctatgccggtcacccactcatccgccgcacaacgaagaggccggatagggaggaaccccaaaaatgagaacgaccagtacatctacatgggagagcccctcgaaaatgatgaggactgcgcccattggaaggaagctaaaatgttactggataacattaatacccctgagggcatcattcccagtatgttcgaaccagagcgcgagaaggtggacgccatcgatggtgaatatagacttagaggggaagcgcggaagacttttgttgacctgatgcgtcgcggcgatctccctgtgtggttggcataccgagtcgccgctgaaggaataaactatgccgacagaaggtggtgtttcgatggcattaaaaataaccagatcctggaggaaaatgtggaggtagagatttggacaaaggaaggggagcggaaaaagctcaaaccccgctggctggacgctagaatctacagcgatccacttgcactaaaggagttcaaggagtttgccgctggaaggaaatcgctgaccttgaacttaataacagagatgggtcggctgcctactttcatgacgcagaaggcccgagacgcactcgataacctggcggtgcttcacaccgccgaagctggcgggagagcctataatcatgcactgtctgagctcccggaaacattggagactctgctactgctcacccttctggctacagttaccggaggcatctttttattcttgatgtccggtcgcgggattggcaaaatgactctgggaatgtgctgcatcattacggccagcatcctcctgtggtacgcacaaatacagccccactggattgccgcttcaatcatccttgaatttttcctgattgtcctcttgatcccagagcctgagaagcagaggaccccacaggacaaccaactgacatatgtggtgatagcgattttaactgtcgttgccgcaaccatggctaatgaaatgggctttctagagaaaacaaagaaggacctggggctcggaagtatcaccactcagcagccagaatctaacattcttgatatcgacctgcggcctgcctccgcctggacattgtacgcagtggctacgaccttcgtaactcccatgctgcgtcacagcatagaaaattcaagtgtgaacgtcagcctcacagccatcgcgaatcaggctaccgtgctgatgggtcttggcaaagggtggccgctctccaagatggatattggagttccactgttggccatcggctgttactctcaagtgaaccctattaccctgacagcagccttatttctactggtcgctcattatgcaatcattggtcccgggctccaggccaaagcgactagagaagctcagaagagggccgcagccggcatcatgaaaaatccaacggtagacggaataaccgtgattgatcttgaccccatcccttacgatccgaagttcgagaagcagctgggccaagttatgttgctggtgctctgcgtcacacaggtgctgatgatgcgcactacctgggctctttgtgaggccttaacactggcaaccgggcccatcagcactctctgggaaggaaacccaggccggttttggaatacgacaattgctgtctccatggccaacatattccgaggttcatatttggcgggggccggactgctattttctatcatgaaaaataccactaacaccagaaggggcacaggtaatattggcgagactctgggggaaaagtggaaaagtcgcctcaacgcacttggaaagtcggagttccagatctacaaaaagagcggcattcaagaagtggaccggaccctggctaaagaggggatcaagagaggagagacagatcaccatgccgtttcccgtggctctgcaaagttgaggtggttcgtggaacggaatatggtaacgcctgagggtaaagtggtcgacctggggtgcggacgcggcggttggtcatattactgtggcgggctcaagaacgttcgagaagtgaaaggactgaccaagggcgggcccggacacgaggagcctataccaatgagcacttatggctggaacttagtcagacttcagtccggtgtggatgtatttttcacaccccctgaaaaatgcgacaccctgctctgtgatatcggggagagttctccaaatcccactgtggaagctggaaggacactacgggttctgaacttggtggagaattggctgaacaataacacccagttttgcattaaggtcctcaatccgtacatgcctagcgtgatcgaaaagatggaggcccttcagcgcaaatacggcggcgccctggtcagaaacccattgtcaagaaattccacgcatgagatgtattgggtgagtaacgcgagcgggaatattgtttcttccgtaaacatgatctcacgaatgctgataaatcggttcaccatgcgtcacaagaaagctacatacgaacccgacgtggacctcggaagcggtactagaaacattggcatcgagtcggaaatccctaatttagatattatagggaagcgcatcgagaaaattaagcaagaatatgagacctcttggcactacgaccaggatcatccatataagacatgggcataccacggaagttatgagactaaacagaccggctccgccagctcaatggtcaacggtgtggttaggctgcttacaaagccctgggacgtggtcccgatggtgacccagatggctatgactgatacgacaccttttgggcaacagcgggtattcaaagaaaaggtggacaccagaactcaggagcccaaagaaggaaccaagaagctgatgaaaatcacagccgagtggctatggaaggaactcggcaaaaagaaaacgccacgcatgtgtaccagggaggagtttactcgaaaggttcggtccaacgcagccctgggcgctattttcacagatgaaaataaatggaagtctgcgagagaggccgtcgaagacagcaggttttgggagttggtggataaggagcgcaacctgcatctcgaagggaaatgcgagacctgtgtgtacaatatgatgggaaagcgtgagaagaaacttggtgagttcggcaaagcaaaagggagtcgggctatctggtacatgtggctgggagccagatttttagagttcgaggcactgggctttttgaacgaggaccactggttctccagggaaaatagcctctctggtgtcgagggggaaggactgcacaagctaggctatatacttcgcgatgttagcaaaaaggagggcggggccatgtacgctgacgacactgccggatgggatacacgaatcaccctggaagacctcaaaaacgaggagatggtgacaaatcatatggaaggtgagcacaagaaactggcggaagcaattttcaagttgacttatcagaacaaggtagtgcgggtccaaagacctacccccaggggcacggtgatggatatcattagtcgcagagaccagcgggggtccggacaggttggcacctacggtctgaatacatttactaacatggaggcccaactcatcaggcagatggaaggggagggagtgttcaaaaatattcagcatcttaccgtcacagaggaaatagctgtgcagaactggctggcccgtgtaggccgagagcgcttaagcagaatggcaatctctggcgatgactgcgttgtgaagccactggatgaccggtttgcttcggccttgactgctctcaatgatatggggaaagtcaggaaggacattcaacagtgggaaccctcacgcggatggaacgattggacccaggtgcctttctgcagccaccattttcacgagctgatcatgaaagacggtagagtgctagtcgttccatgtcggaatcaggatgagcttatcggcagggcccgaatttcccaaggggcaggatggagtctgcgtgaaacggcgtgcctcggcaagtcttatgcccagatgtggagcctgatgtacttccacagacgcgacttgcggttagctgccaacgcaatatgttccgctgtgccgtcacattgggtacccacaagtaggaccacttggtctatccacgccaagcatgagtggatgacaaccgaagacatgctgactgtgtggaacagagtctggattcaggagaatccttggatggaagataaaaccccagtggagagctgggaggaaatcccctatctcggtaagcgcgaggaccagtggtgcgggtcccttattggactgacatcacgggcaacgtgggccaaaaacatccaaaccgcgataaatcaggttaggagcctaatcggcaacgaagagtacactgattacatgccttctatgaagcgatttagacgggaagaggaggaagctggcgtgctgtggtga

SEQ ID NO: 14301 - RNA, 9876 nt, synthetic construct
  misc_feature 1..9876: note = derived and/or modified CDS sequence (opt3) from DENV-2__KF704354__SS-prME
  source 1..9876: mol_type = other RNA
accgccggaatgatcattatgctgataccaacagtgatggctttccacctcactacgaggaacggggagcctcatatgatcgtcagcaggcaggaaaagggaaaatcccttctgtttaagaccgaggacggtgttaatatgtgcacattgatggcaatggatttaggagaactgtgtgaggacactattacctacaaatgcccattcctacggcaaaacgaaccggaggatatcgactgttggtgcaattctacatcaacctgggtgacttatgggacatgtaccacgactggagagcaccgccgagaaaagcgtagtgtagccctcgtgccccatgtcggcatgggtctggagacccggacagaaacttggatgagctccgagggggcgtggaaacacgctcagaggattgagacctggatccttcggcatcctggatttacaataatggccgcaatcctggcctacaccattggcacgactcacttccagcgcgctttgatctttattctcctgacagcagtggccccatctatgaccatgagatgcatcggcatatcgaacagggatttcgttgaaggggtgtcaggaggtagctgggtcgacattgtgctggagcacggcagttgtgtaactacaatggctaagaataagcccaccctcgattttgaattaatcaaaacggaggccaagcagcctgcgaccctgcggaaatattgcattgaagcaaaacttacaaacactaccacagagtcccgctgtccaactcaaggggagccctctttgaatgaagaacaggacaaacgattcgtttgcaagcatagcatggtggatagaggatggggcaacggttgtgggctgtttggaaagggcggcatcgtaacctgcgccatgttcacatgcaaaaagatcatgaaagggaaggtggtgcagcctgaaaatctagagtacaccattgtcataactccacactccggagaagaacatgctgttggtaacgacacgggcaaacacgggaaggagatcaaaattacaccgcagtcaagtatcaccgaagccgagctcactggatatggcaccgtgacaatggaatgtagccccaggaccggtctggattttaatgagatggtacttctgcaaatggaaaacaaggcatggttggtgcaccggcagtggttcctcgacctgcctttaccatggctgcccggggctgatactcagggctctaattggatacagaaggagacactcgtcacgtttaaaaaccctcatgccaagaaacaagacgtggttgtgcttggatcccaggagggcgcgatgcacaccgccctgactggggcaacagaaattcagatgtcaagcggaaatgtcttgttcaccggtcatctaaagtgccgtctgcgcatggacaaactccaactgaagggcatgagttactctatgtgtacagggaagttcaaagtggtaaaggagatcgctgaaactcagcacggaaccatcgttattagagtgcagtatgagggcgatggttccccatgcaaaatcccctttgagattatggaccttgaaaagaggcatgtcctggggcggttgataacggtgaacccgatcgtcaccggcaaagatagccctgtgaacattgaggccgaacccccattcggagactcgtacatcatcattggcgttgagcctgggcagctcaagctgaattggtttaagaaaggatcttccataggtcaaatgttcgctacaactatgcgaggcgccaagcgcatggcaatcttaggggataccgcctgggactttggatcactgggcggtgtgttcacaagtattgggaaagctctacaccaggtatttggcgcgatctacggagcagccttcagcggcgtctcctggactatgaagattctcatcggggtgataatcacctggattggaatgaactctagaagcacgtcactgagtgtttcccttgtgttggtcggcgtggtaacactgtatctcggtgtgatggttcaggctgatagcgggtgtgtcgtgtcttggaaaaataaggaactgaagtgcggatcaggcatctttattaccgacaacgtgcacacttggacagagcagtacaaattccaacccgagagtccaagcaaacttgcctccgcaatccagaaagcccatgaagagggtatatgtggcattaggtctgtcacccggctggaaaatttgatgtggaagcagatcactcccgagctcaaccacattctgtcggaaaatgaggttaaattaaccatcatgacaggggatataaagggaatcatgcaggctggcaaacgcagcctgagacctcaaccaacggagctaaagtattcctggaagacctgggggaaagccaagatgctctcaactgaaagtcataaccagacatttctgattgacggaccggagaccgcagaatgccccaatacaaacagggcgtggaactctcttgaggtggaagattacggcttcggtgtgtttactaccaacatctggttgaaactgcgtgaggagcaggacgtattctgtgacagcaagctcatgtccgctgccattaaagataatcgggcagtccacgccgacatggggtattggatcgaatcagctctgaacgatacgtggaagatagagaaggccagcttcattgaagtgaaatcttgccactggcctaagtcccatacattatggagtaatggagttctggagagcgagatgatcatccccaagaattttgcaggccccgtgtctcagcacaactaccgacctggttatcatacccaaactgctggcccatggcaccttgggaagttggaaatggacttcgatttttgtgagggaaccacagtcgtggttactgaagactgcggcaatagagggccctccctcaggaccacaacggcctcaggaaaactgattaccgagtggtgctgtcgcagttgcactctaccgcctctgcggtacagaggcgaagatggttgttggtacgggatggagatcaggccactcaaggagaaggaagagaacctggtgaatagccttgtaacagcgggacatggccagattgacaacttctcgttgggtgtcctgggcatggccttatttctcgaagagatgctgcgcacccgagtggggactaaacacgctatacttctggtggcagtctccttcgttacattgatcaccggaaatatgtcttttcgggatctcggccgtgtgatggtaatggtgggggccacgatgactgacgatattggaatgggcgtcacctatctggctctactggccgcattcaaggtgagacccacatttgcggccggtctcctgcttaggaaattgaccagcaaggaactgatgatgactacaatcgggattgttttactctcacagagtaccatccctgagacaatactggagcttactgacgctctggccctaggaatgatggtgctcaaaatggtccgcaagatggaaaagtaccaactggcagtgaccatcatggctattttgtgcgttcccaacgccgtgatcctgcagaatacgtggaaagtctcctgtacaattttagcagtagtgtctgttagcccactcttcctgacctcctcacagcagaaggccgattggatccctcttgctctgactataaaaggcttgaaccccaccgcgatttttctcacaactctgagccggaccaataagaaaagaagttggccactaaacgaggccatcatggcagtgggcatggtctctatcctggcttccagccttctcaagaatgacattccgatgacggggcctctggtggccggaggtttgctgacagtatgctatgtgttaaccggcaggtcggccgacctcgaactggagcgagctgcagatgtcaaatgggaagaccaagccgagatatcagggtctagtcccatcctttccattactatcagcgaggatggatctatgagcattaagaacgaagaggaggaacagacactgaccatcttgatacgcactggcctcctggttatctccggtctattcccagtgtcaattcccatcacagcggctgcctggtacctgtgggaggtgaagaaacagcgggcaggggtcctttgggacgtgcctagtccaccccctgttggaaaggccgaactcgaggatggcgcttatagaattaaacagaagggcatcctggggtacagccaaataggagccggtgtctataaagaaggcacctttcacacgatgtggcatgtgactagaggggcagtcttgatgcacaagggaaagcgtattgagccgtcttgggcggacgtgaaaaaggatttaatctcctacggcggtgggtggcgcctggaaggagagtggaaagagggcgaagaggttcaggtgctcgctctggaaccaggcaagaatccccgggccgtccagaccaaacctgggcttttcaagacaaacgcaggaaccatcggtgccgtgtcactggacttcagtccaggcacaagcgggtcccccattatcgataagaaaggaaaggtagtcggcttgtacggtaatggggtggttactagatctggagcttatgtgtcggccatagcacagaccgagaaaagcattgaagacaaccctgagatcgaggatgacatttttaggaagcgaaaactaacgatcatggatctgcatccgggcgctggcaagacaaagcggtacctccccgccatagtccgcgaagcgattaaaagagggctgaggactcttatcttagccccaacccgggtggttgcagctgagatggaagaggccctgcgaggactccctatcagatatcaaacacccgctattcgcgcagaacacaccggtagggagatcgtggacttgatgtgtcatgccactttcaccatgcgtctgctctcaccagtccgggtgcctaactacaatctgattataatggacgaggcccactttacagatcccgcttccatcgcggcaagaggctatattagtacgagggtagaaatgggggaggccgctggaatcttcatgactgccaccccaccgggctctcgcgacccttttccccagagcaacgcaccaatcatggatgaggaacgagagattcccgaaagatcctggtcatctggtcacgagtgggtgacagacttcaaggggaaaaccgtttggtttgtccctagcataaaggccggaaatgatatcgctgcgtgccttcggaaaaacggcaagaaggtgattcagctgagtaggaaaactttcgactccgaatacgtgaagacacgcaccaatgattgggactttgtcgtaacgactgatatcagcgagatgggcgccaacttcaaagcagaacgtgtgattgacccaagacggtgtatgaagcccgttatcttgacagatggggaggagagggtgatactagctggacctatgccggtcacccattcttcagccgcacaacgccgaggtagaatcggccggaatcccaagaacgaaaatgaccagtatatttacatgggggagcccctggaaaacgacgaggattgcgcccactggaaggaagctaaaatgctcttagacaatatcaacacccctgagggaattatcccctccatgtttgagccagaaagggagaaggtggatgccatagacggcgaataccgcctgagaggtgaggcgaggaagactttcgttgatcttatgcggcgtggggacctgcctgtgtggctcgcatatcgcgtcgccgctgaaggcattaattacgccgatcgaagatggtgtttcgacggaatcaaaaacaatcagattttggaggagaacgtggaagtagagatctggacaaaggaaggcgagaggaaaaagctgaaaccccggtggctcgatgctcgcatatatagtgacccactggcacttaaggagtttaaggagttcgccgctgggagaaaaagcctaaccctgaacttgatcacagagatgggaaggttacctacttttatgacgcagaaggcccgggatgcactggacaatctcgcggtgctgcataccgccgaagctggtggccgagcctacaaccacgcactttcggagctgccggaaacactcgagactttgctgctactgaccctccttgctacagttaccgggggaattttcctgtttttaatgtctggcagaggtatcgggaaaatgactttgggcatgtgctgcattatcacggcctccatactgctctggtatgcacaaattcagccccactggatcgccgctagcatcattctggagttctttcttatcgtcctgctcataccagaacctgagaagcagcgcaccccacaggataatcaattgacatacgtggtgattgcgatcctgactgtcgttgccgcaaccatggctaacgaaatgggattcttagagaaaacaaagaaggacctaggctgggggtcaattaccactcagcagccagaaagtaatatcctggacatagatctcaggcctgcctctgcctggacactttatgcagtggctacgacctttgtaactcccatgctgcggcattccatcgagaacagctcagtgaatgtcagtttgacagccattgcgaaccaggctaccgtgctgatgggactcggtaaaggctggccgctgagcaagatggacatcggggttccacttctcgccattggatgttactcccaagtgaatcctatcaccctgacagcagccttgttcctgttagtcgctcactacgcaattatcggccccggtctacaggccaaagcgactcgtgaggctcagaagagagccgcagccgggataatgaaaaacccaacggtagatggcattaccgtgatcgacctggatcccatcccttatgacccgaagtttgaaaagcagctcggacaagttatgcttctggtgttgtgcgtcacacaggtgctgatgatgaggactacctgggctctctgtgaggccctgacacttgcaaccggccccatttctactttatgggaagggaatccaggacgcttctggaacacgacaatagctgtcagcatggccaatatctttcggggctcctacctggcgggtgccgggctcttgttctcaattatgaaaaacaccactaatacccgaagaggaacaggcaacatgggtgagactctgggcgaaaagtggaaatctaggctaaatgcactggggaagagtgagttccagatctataaaaagtcgggcattcaagaggtggatcgcaccctcgctaaagaaggcatcaagagaggggaaacagaccatcacgccgttagcagaggatccgcaaaacttcgttggtttgtggaaaggaacatggtaacgcctgagggcaaagtggtcgatctgggttgcgggcggggaggctggtcttactattgtggtggcttgaagaacgttcgcgaggtgaaagggctgaccaagggaggccccgggcatgaggagcctataccaatgtcaacttacggatggaatctcgtccgactgcagagcggcgtggacgtattctttacaccccctgaaaaatgcgataccttactttgtgacatcggtgagtccagtccaaaccccactgtggaagctgggagaacactgagggttctcaatctagtggagaactggctgaataacaatacccagttctgcattaaggtcttgaacccgtatatgccttctgtgatcgagaagatggaagccctgcagcggaaatacggaggcgccctcgtccgcaatccacttagcagaaactcaacgcacgagatgtactgggtgtccaatgcgagtggcaacattgttagctctgtaaatatgatctccaggatgctgataaaccgatttaccatgcggcacaagaaagctacattcgaacccgatgtggacttggggtcaggaactcgtaatattggtatcgagagcgaaatccctaacctggacattataggcaagagaatcgagaaaattaagcaagagtatgaaacctcgtggcattacgatcaggaccacccatataagacatgggcataccatgggtcttatgagactaaacagaccggaagtgcctccagcatggtcaacggcgtggttcgcctcttaacaaagccctgggatgtggtcccgatggtgacccagatggctatgactgacacgacaccttttggtcaacagagggtattcaaagaaaaggtggatacccggactcaggagcccaaagaagggaccaagaagctgatgaaaatcacagccgagtggctttggaaggagctgggcaagaagaaaacgccaagaatgtgtacccgcgaagagtttactaggaaggttcgatcaaatgcagccctaggcgctattttcacagacgaaaacaaatggaagtccgcgcgggaggccgtcgaggattctagattttgggaactcgtggacaaggagaggaatctgcacttggaaggcaaatgcgagacctgtgtgtacaacatgatggggaagcgcgagaaaaagctgggagagttcggtaaagcaaagggcagccgtgctatctggtatatgtggctcggggcccggtttcttgagttcgaagcactgggattcttaaatgaggatcactggtttagtagagaaaactccctgagcggcgtcgagggtgaagggttgcataagctcggatacatactgagggacgtttctaaaaaggagggcggcgccatgtacgctgatgacactgccgggtgggacacacgcatcaccctagaggatcttaaaaatgaagagatggtgacaaaccacatggaaggagagcataagaaactggcggaagcaattttcaagctcacttatcagaataaggtagtgcgagtccaacggcctacccccagaggtacggtgatggacatcatttcaaggcgcgatcagagaggcagtgggcaggttggaacctacggcctgaacacatttactaatatggaggcccaattgatccggcagatggagggtgaaggggtgttcaaaaacattcagcacctgaccgtcacagaggaaatagctgtgcagaattggctcgccagggtaggacgtgagcgactttcccgcatggcaatcagcggcgacgattgcgttgtgaagccactggacgatagatttgcttctgccttaactgctctgaacgacatgggcaaagtccggaaggatattcaacagtgggagccctcgagggggtggaatgactggacccaggtgcctttctgctcacatcactttcacgaattgatcatgaaagatggacgcgtgctcgtcgttccatgtagaaaccaggacgagctgatcggtcgggccaggattagccaaggcgcagggtggtccctacgagaaacggcgtgccttggaaagagttatgcccagatgtggtctctgatgtacttccatcgtagagatctccgcctggctgccaacgcaatatgtagcgctgtgccgtcccactgggtacccacatcacggaccacttggagtatccatgccaagcacgagtggatgacaaccgaagacatgttgactgtgtggaatagggtctggattcaggagaacccttggatggaggacaaaaccccagtggaatcttgggaggaaatcccctatttaggcaagagagaggatcagtggtgcggtagcctgattgggctcacatcccgcgcaacgtgggccaaaaatatccaaaccgcgataaaccaggttcggtcacttatcggaaatgaagagtacactgactatatgcctagcatgaagaggtttcgaagagaggaagaggaagctggcgtgctgtggtga

SEQ ID NO: 14302 - RNA, 9876 nt, synthetic construct
  misc_feature 1..9876: note = derived and/or modified CDS sequence (opt3) from DENV-2__KF704357__SS-prME
  source 1..9876: mol_type = other RNA
accgccggcatgatcattatgctgatacccacagtgatggctttccacctcactacgagaaacggggagcctcatatgatcgtcagcaggcaggaaaagggaaaatcccttctgtttaagaccggtgacggcgttaatatgtgcacattgatggcaatggatttaggggagctgtgtgaagacactattacctacaaatgcccactactccggcaaaacgagccggaagatatcgactgttggtgcaattctacatcaacctgggtgacttatggaacatgtaccacgactggcgagcaccgccgagagaagcgtagtgtagccctggtgccccatgtcggtatggggcttgaaaccagaacagagacttggatgagctccgaaggagcgtggaaacacgctcagaggattgagacctggatcctgcggcatcctggcttcacaataatggccgcaatcttggcctacaccattggcacgactcactttcagcgcgctctcatcttcattctgctgacagcagtggccccatctatgaccatgagatgcatcgggatatcgaacagggattttgttgagggagtgtcaggtggcagctgggtcgacattgtgctcgaacacgggagttgtgtaactacaatggctaagaataagcccaccttagatctggagcttatcaaaacggaagccaagcagcctgcgaccttgcggaaatattgcattgaggcaaagctgacaaacactaccacagaatcccgctgtccaactcaaggagagccctctctaaatgaggaacaggacaaacgattcgtttgcaagcatagcatggtggatagaggctggggtaacgggtgtggactctttggcaagggctccatcgtcacctgcgccatgttcacatgcaaaaagatcatgaaagggaaggtggtgcagcctgagaatctggaatacaccattgtcataactccacactcaggagaggaacatgctgttggtaacgacacgggcaaacacgggaaggagatcaaaattacaccgcagagtagcatcaccgaggccgaacttactggatatggcaccgtgacaatggagtgttctcccaggaccggtctggattttaatgaaatggtattgctccaaatggaggacaaggcatggctggtgcaccggcagtggttcttagatctgcctctcccatggcttcccggggctgacactcagggctccaactggatacagaaggaaacactggtcacgtttaaaaatcctcatgccaagaaacaagacgtggttgtgttgggatcacaggagggcgcgatgcacaccgccctaactggggcaacagagattcagatgagcagtggaaacgtcctgttcaccggtcatctcaagtgccgtctgcgcatggataaacttcaactgaagggcatgtcttactccatgtgtacagggaagtttaaagtggtaaaggaaatcgctgagactcagcacggaaccatcgttattagagtgcagtatgaaggcgacggtagcccatgcaaaatccccttcgagattatggatttggagaagaggcatgtcctcgggcggctgataacggtgaatccgatcgtcaccggcaaagactcgcctgtgaacattgaagccgagcccccattcggagattcttacatcatcattggcgttgaacctgggcagttaaagctgaactggtttaagaaaggatcctcaataggtcaaatgttcgctacaactatgcgaggcgccaagcgcatggcaatcctaggggacaccgcctgggattttggaagtctcggcggtgtgttcacaagcattgggaaagctctgcaccaggtatttggcgcgatctacggagcagccttctccggcgtctcttggactatgaagattcttatcggggtgataatcacctggattggaatgaatagcagatcaacgagtttgtccgttagcctggtgctcgtcggcgtggtaacactgtatcttggtgtgatggttcaggctgactctgggtgtgtcgtgtcatggaaaaacaaggagctgaagtgcggaagtggcatctttattaccgataatgtgcacacttggacagaacagtacaaattccaacccgagagcccatccaagttggcctctgcaatccagaaagcccatgaggaaggtatatgtggcattaggtcggtcacccggctcgagaacctgatgtggaagcagatcactcccgaattaaatcacattctgagcgagaacgaagttaaactaaccatcatgacaggggacataaagggaatcatgcaggctggcaaacgctccctcagacctcaaccaacggagctgaagtattcatggaagacctgggggaaagccaagatgcttagtactgagtctcataatcagacatttttgattgatggaccggaaaccgcagagtgccccaacacaaatagggcgtggaacagcctggaagtggaggactacggcttcggtgtgtttactaccaatatctggctcaaactgcgtgaagagcaggacgtattctgtgattccaagttaatgtcagctgccattaaagacaaccgggcagtccacgccgatatggggtattggatcgagagcgctctgaatgacacgtggaagatagaaaaggcctcttttattgaggtgaaatcctgccactggcctaagagtcatacactttggagcaacggagttttggaatctgagatgatcatcccaaaaaatttcgcaggccccgtgtcccagcacaactaccgacctggttatcatacccaaactgctggcccatggcacctcgggaagctggagatggatttcgacttttgtgaaggaaccacagtcgtggttactgaggattgcggcaacagagggccctcactaaggaccacaacggccagtggaaaactgattaccgaatggtgctgtcgcagctgcactctcccgcctctgcggtacagaggcgaggacggttgttggtacgggatggaaatcaggccacttaaggagaaggaggaaaatttggtgaactcgctggtaacagcgggacatggccagattgataatttctccttaggtgtcctcggcatggccctgtttcttgaggaaatgctgcgcacccgagtggggactaaacacgctatattgctcgtggcagtctctttcgttacactgatcaccggaaacatgagctttcgggacctaggccgtgtgatggtaatggtgggggccacgatgactgatgacattggaatgggcgtcacctatctggctctcctggccgcattcaaggtgagacccacatttgcggccggtcttttgctgaggaaattaacctcaaaggagctcatgatgactacaatcgggattgttctgcttagtcagtccaccatccctgaaacaatactggagctaactgatgctctcgccctgggaatgatggtgttgaaaatggtccgcaagatggagaagtaccaactggcagtgaccatcatggctattttatgcgttcccaatgccgtgatcctccagaacacgtggaaagtctcttgtacaattctggcagtagtgagcgtttccccacttttcctgacctcaagccagcagaaggccgactggatccctttggctctcactataaaaggcctgaatcccaccgcgatttttctaacaactctgagtcggaccaacaagaaaagatcttggccacttaatgaagccatcatggcagtgggcatggtctccatcctcgctagctcgctgttgaagaacgacattccgatgacggggcctctggtggccggaggtttactcacagtatgctatgtgctgaccggcaggtcagccgatcttgagctggaacgagctgcagacgtcaaatgggaggatcaagccgaaatatctgggagttcccccatcttgagcattactatctctgaggacggaagcatgtccattaagaatgaggaagaggaacagacactcaccatcctgatacgcactggcctactggttatctcaggtcttttcccagtgagtattcccatcacagcggctgcctggtacctctgggaggtgaagaaacagcgggcaggggtcctgtgggatgtgcctagcccaccccctgttggaaaggccgagttggaagacggcgcttatagaattaaacagaagggcatcttagggtactctcaaataggagcaggtgtatataaagagggcacctttcacacgatgtggcatgtgactaggggggccgtcctgatgcacaagggaaagcgtattgaaccgtcctgggcggatgtgaaaaaggacctcatctcatacggcggtgggtggaaactggagggagaatggaaggagggcgaggaagttcaggtgcttgctctggagccaggcaaaaacccccgcgccgtccagaccaagcctgggttgttcaagacaaatgcaggaaccatcggtgccgtgagtctagattttagcccaggcacatccgggtctcccattatcgaccggaaaggaaaggtagtcggcctgtacggtaacggggtggttactagatcgggagcttatgtgagcgccatagcacagaccgaaaaatcaattgaggataatcctgaaatcgaggacgatattttcaggaagcgaaaactcacgatcatggacctgcatccgggcgctggcaagacaaagcggtaccttcccgccatagtccgcgaggcgattaaaagagggttaaggactctgatcctcgccccaacccgggtggttgcagctgaaatggaggaagccttgcgaggactgcctatcagatatcaaacacccgctattcgcgcagagcacaccggtagggaaatcgtggacctcatgtgtcatgccactttcaccatgcgtctgctttccccagtccgggtgcctaactacaacctgattataatggatgaggcccactttacagaccccgctagtatcgcggcaagaggctatatttctacgagggtagagatgggggaagccgctggaatcttcatgactgccaccccaccgggcagccgcgatccttttccccagtccaatgcaccaatcatggacgaggaacgagagattcccgagagatcatggtctagcggtcacgaatgggtgacagatttcaaggggaaaaccgtttggtttgtccctagtatacgggccggaaacgacatcgctgcgtgcttgaggaagaatggcaaaaaggtgattcagctatcccgcaagactttcgatagcgagtacgtgaaaacacgtaccaacgactgggattttgtcgtaacgactgacatctctgaaatgggcgccaatttcaaggcagagagagtgattgatccacggaggtgtatgaaacccgttatcctgacagacggggaagagcgcgtgatactcgctggacctatgccggtcacccattcatccgccgcacaacgaagaggtcggatcggcaggaacccaaagaatgagaacgaccagtatatttacatgggggaacccttagagaatgatgaagactgcgcccactggaaagaggctaagatgctgcttgataacatcaatacccctgaaggaattatccccagtatgtttgagccagagcgcgaaaaagtggacgccatagatggcgagtacagactgaggggtgaagcgcggaagactttcgttgacctcatgcgtcgcggggatttgcctgtgtggctggcatatcgagtcgccgctgagggcattaactacgccgacagaaggtggtgttttgatggaatcaagaataaccagattctcgaagagaatgtggaggtagaaatctggacaaaagagggcgaacggaagaaactgaagccccgctggcttgacgctagaatatatagcgatccactagcactgaaagagttcaaggagttcgccgctgggaggaagtcgttgaccttaaacctgatcacagaaatgggacggctccctacttttatgacgcagaaagcccgagacgcactggataaccttgcggtgctgcataccgccgaggctggtggcagagcctacaatcacgcactctctgaattgccggagacactggaaactctactgctccttaccctgttagctacagttaccgggggaattttcttgtttctgatgtccggccgcggtatcgggaagatgactctcggcatgtgctgcattatcacggccagcatactgctttggtatgcacaaattcagccccactggatcgccgcttcaatcattctggagttctttctcatcgtcttgctgataccagagcctgaaaaacagaggaccccccaggacaaccaattaacatacgtggtgattgcgatcctaactgtcgttgccgcaaccatggctaatgagatgggattcctggaaaagacaaaaaaggacctcggccttgggagtattaccactcagcagccagagtctaacatcctggatatagacttgcggcctgcctccgcctggacactgtatgcagtggctacgacctttgtaactcccatgctccgtcatagcatcgaaaattcaagtgtgaacgtcagcctgacagccattgcgaatcaggctaccgtgcttatgggactcggtaagggctggccgctgtccaaaatggatatcggggttccattgctggccattggatgttactctcaagtgaaccctatcaccttaacagcagccctattcctgctcgtcgctcactacgcaattatcggccccggtcttcaggccaaggcgactagagaggctcagaaaagggccgcagccgggataatgaagaatccaacggtagacggcattaccgtgatcgatctggaccccatcccttatgatccgaaatttgagaagcagttgggacaagttatgctgctcgtgctgtgcgtcacacaggtgcttatgatgcgcactacctgggctttatgtgaagccctgacactcgcaaccggccccattagcactttgtgggaggggaacccaggacggttctggaatacgacaatagctgtctccatggccaacatctttcgaggctcatacctggcgggtgccgggctactgttctctattatgaagaataccactaacaccagaaggggaacaggcaatatgggtgaaactctcggcgagaaatggaagagtcgccttaacgcactggggaaatcggaatttcagatctataagaaaagcggaattcaagaggtggaccggaccttggctaaggagggcatcaaaagaggggaaacagatcatcacgccgtttcccgtggatctgcaaagctgaggtggttcgtggagcggaatatggtaacgcctgaaggcaaggtggtcgacctcggttgcgggcgcggaggctggtcatactattgtggtggcctgaaaaacgttcgagaggtgaaggggttaaccaaaggaggccccgggcatgaggaacctataccaatgagcacttacggatggaaccttgtcagactgcagtccggcgtggatgtattctttacaccccctgagaagtgcgacaccctcctatgtgatatcggtgaaagttctccaaatcccactgtggaggctgggaggacactgcgggttttgaacctggtggaaaattggctcaacaataacacccagttctgcattaaagtccttaatccgtatatgcctagcgtgatcgagaagatggaggccctgcagcgcaagtacggaggcgccttggtcagaaacccactgtcaaggaattccacgcacgaaatgtactgggtgagtaacgcgagcggcaatattgtttcttccgtaaacatgatctcacgaatgctcataaatcggtttaccatgcgtcacaaaaaggctacattcgagcccgacgtggacttagggagcggaactagaaacattggtatcgaatcggagatccctaatctggatattataggcaaacgcatcgaaaagattaaacaagagtatgagacctcttggcattacgaccaggatcacccatataagacatgggcataccatgggagttatgaaactaagcagaccggatccgccagctcaatggtcaacggcgtggttaggcttctgacaaaaccctgggacgtggtcccgatggtgacccagatggctatgactgatacgacaccttttggtcaacagcgggtattcaaggagaaagtggacaccagaactcaggaacccaaggaggggaccaaaaagctaatgaagatcacagccgaatggctctggaaagagctgggaaagaaaaagacgccacgcatgtgtaccagggaggaatttactcgaaaagttcggtccaacgcagccttgggcgctattttcacagatgagaataagtggaaatctgcgagagaagccgtcgaggacagcaggttttgggagctggtggataaggaacgcaacctccaccttgagggcaagtgcgaaacctgtgtgtacaatatgatggggaaacgtgagaagaaactgggagaattcggtaaggcaaaaggcagtcgggctatctggtatatgtggttaggggccagatttctggagttcgaggcattgggatttctcaacgaagaccactggttctccagggagaatagcctgtctggcgtcgaaggtgaggggctacataagcttggatacatactgcgcgatgtttcaaagaaagaaggcggcgccatgtacgctgacgacactgccgggtgggatacacgaatcaccctcgaggacctgaagaacgaggaaatggtgacaaatcacatggagggagaacataaaaagttggcggaggcaattttcaaactgacttatcagaacaaggtagtgcgggtccaaagacctacccccaggggtacggtgatggatatcattagtcgcagagaccagcggggctccgggcaggttggaacctacggcctcaatacatttactaacatggaagcccaacttatcaggcagatggagggtgagggggtgttcaagaatattcagcacctgaccgtcacagaagagatagctgtgcagaactggttagcccgtgtaggacgagaacgcctgagcagaatggcaatctctggcgatgactgcgttgtgaaaccattggatgaccggtttgcttcggccctcactgctctgaatgatatgggcaaggtcaggaaagacattcaacagtgggagccctcacgcgggtggaacgattggacccaggtgcctttctgcagccatcactttcacgagctaatcatgaaggacggaagagtgcttgtcgttccatgtcggaatcaggatgaactgatcggtagggcccgaatttcccaaggcgcagggtggagtctccgtgagacggcgtgcctgggaaaatcttatgcccagatgtggagcttgatgtacttccatagacgcgacttacggctggctgccaacgcaatatgttccgctgtgccgtcacactgggtacccacaagtaggaccacttggtctatccatgccaagcacgaatggatgacaaccgaggacatgctcactgtgtggaacagagtctggattcaggaaaatccttggatggaggataagaccccagtggagagctgggaagagatcccctatcttggcaaacgcgaagaccagtggtgcggttccctgattgggctaacatcacgggcaacgtgggccaagaacatccaaaccgcgataaatcaggttaggagcctgatcggaaacgaggaatacactgattatatgccttctatgaaacgatttagacgggaggaggaagaggctggcgtgctctggtga

SEQ ID NO: 14303 - RNA, 9876 nt, synthetic construct
  misc_feature 1..9876: note = derived and/or modified CDS sequence (opt3) from DENV-2__KF704358__SS-prME
  source 1..9876: mol_type = other RNA
accgccggaatgatcattatgctgataccaaccgtgatggctttccacctcactacgaggaacggggagcctcatatgatcgtctcaaggcaggaaaagggaaaatcccttctgtttaataccggtgacggcgttcacatgtgcacgttgatggcaatgcatttaggggagctgtgtgaagatactattacctacaagtgcccactactccggcaaaacgagccggaagacatcgattgttggtgcaattctacatcaacctgggtgacttatggaacatgtaccacgactggcgagcaccgccgagagaaacgtagtgtcgccctggtgccccatgtcggtatggggcttgaaacccggacagagacttggatgagctccgaaggagcgtggaagcacgctcagaggattgagacctggatcctgcggcaccctggcttcacaataatggccgcaatcttggcctacaccattggcacgactcattttcagcgcgctctcatcttcattctgctgacagcagtggccccatctatgaccatgagatgcatcgggatatcgaacagggactttgttgagggagtgtcaggtggcagctgggtcgatattgtgctcgaacacgggagttgtgtaactacaatggctaaaaataagcccaccttagacctggagcttatcaagacggaagccaaacagcctgcgaccttgcggaagtattgcattgaggcaaaactgacaaacactaccacagaatcccgctgtccaactcaaggagagccctctctaaatgaggaacaggataagcgattcgtttgcaaacatagcatggtggacagaggctggggtaacgggtgtggactctttggcaagggctccatcgtaacctgcgccatgttcacatgcaagaaaatcatgaaggggaaagtggtgcagcctgagaatctggaatacaccattgtcataactccacactcaggagaggaacacgctgttggtaacgatacgggcaagcatgggaaagagatcaagattacaccgcagagtagcatcaccgaggccgaacttactggatatggcaccgtgacaatggagtgttctcccaggaccggtctggactttaatgaaatggtattgctccaaatggaggataaagcatggctggtgcaccggcagtggttcttagacctgcctctcccatggcttcccggggctgatactcagggctccaactggatacagaaggaaacactggtcacgtttaagaatcctcatgccaaaaagcaagacgtggttgtgttgggatcacaggagggcgcgatgcacaccgccctaactggggcaacagagattcagatgagcagtggaaacgtcctgttcaccggtcatctcaaatgccgtctgcgcatggacaaacttcaactgaaaggcatgtcttactccatgtgtacagggaagtttaaggtggtaaaagaaatcgctgagactcagcacggaaccatcgttattagagtgcagtatgaaggcgatggtagcccatgcaagatccccttcgagattatggacttggagaaaaggcacgtcctcgggcggctgataacggtgaatccgatcgtcaccggcaaggattcgcctgtgaacattgaagccgagcccccattcggagactcttacatcatcattggcgttgaacctgggcagttaaaactgaactggtttaagaagggatcctcaataggtcaaatgttcgctacaactatgcgaggcgccaaacgcatggcaatcctaggggataccgcctgggactttggaagtctcggcggtgtgttcacaagcattgggaaggctctgcatcaggtatttggcgcgatctacggagcagccttctccggcgtctcttggactatgaaaattcttaccggggtgatcataacgtggatcggaatgaatagcagatcaacaagtttgtccgttagcctggtgctcgtcggcgtggtaaccctgtatcttggtgtgatggttcaggctgattctgggtgtgtcgtgtcatggaagaacaaagagctgaagtgcggaagtggcatttttatcactgacaatgtgcacacatggaccgaacagtacaagttccaacccgagagcccatccaaattggcctctgcaattcagaaggcccatgaggaaggtatctgtggcataaggtcggtcactcggctcgagaacctgatgtggaaacagattacccccgaattaaatcacatcctgagcgagaacgaagttaagctaacaattatgacgggggatatcaaaggaataatgcaggctggcaagcgctccctcagacctcaaccaaccgagctgaaatattcatggaagacttgggggaaggccaaaatgcttagtacagagtctcacaatcagacctttttgatcgacggaccggaaacagcagagtgccccaacactaatagggcgtggaacagcctggaagtggaggattacggcttcggtgtgtttaccacgaatatttggctcaagctgcgtgaaaaacaggacgtattctgtgactccaagttaatgtcagctgccatcaaagataaccgggcagtccatgccgacatggggtattggattgagagcgctctgaatgatacatggaagatcgagaaggcctcttttatagaagtgaaatcctgccactggcctaagagtcataccctttggagcaacggagttttggagtctgaaatgattatccccaagaatttcgcaggccccgtgtcccagcacaactaccgacctggttatcatactcaaaccgctggcccatggcacctcgggaagctggagatggacttcgatttttgtgagggaacaactgtcgtggttaccgaagactgcggcaacagagggccctcactaaggacaacgaccgccagtggaaaactgatcactgagtggtgctgtcgcagctgcacactcccgcctctgcggtacagaggcgaagatggttgttggtacgggatggagattaggccacttaaggaaaaggaggagaatttggtgaactcgctggtaaccgcgggacacggccagatcgacaatttctccttaggtgtcctcggcatggccctgtttcttgaagagatgctgcgcactcgagtggggacaaaacatgctattttgctcgtggcagtctctttcgttaccctgataacgggaaacatgagctttcgggatctaggccgtgtgatggtaatggtgggggccactatgaccgacgatatcggaatgggcgtcacatatctggctctcctggccgcattcaaggtgagacccacctttgcggccggtcttttgctgaggaaattaacttcaaaggaactcatgatgacaaccattgggatcgttctgcttagtcagtccacaattcctgagactatcctggaactaaccgacgctctcgccctgggaatgatggtgttgaaaatggtccgcaagatggagaagtaccaactggcagtgacgataatggctatcttatgcgttcccaatgccgtgattctccagaacacatggaaagtctcttgtaccatcctggcagtagtgagcgtttccccacttttcctgacttcaagccagcagaaggccgattggattcctttggctctcaccatcaaaggcctgaatcccacagcgatatttctaactaccctgagtcggacgaacaagaaaagatcttggccacttaatgaggccattatggcagtgggcatggtctccatcctcgctagctcgctgttgaagaacgacatcccgatgacagggcctctggtggccggaggtttactcaccgtatgctatgtgctgactggcaggtcagccgaccttgaactggagcgagctgcagatgtcaaatgggaagaccaagccgagatttctgggagttcccccatattgagcatcacaatttctgaagatggaagcatgtccatcaagaatgaggaggaagaacagaccctcactattctgatccgcacaggcctactggttatatcaggtcttttcccagtgagtatccccattaccgcggctgcctggtacctctgggaagtgaagaaacagcgggcaggggtcctgtgggacgtgcctagcccaccccctgttggaaaggccgagttggaggatggcgcttatagaatcaaacagaagggcattttagggtactctcaaatcggagccggtgtatataaagaaggcacgtttcacactatgtggcatgtgaccagaggggcagtcctgatgcacaagggaaagcgtatagagccgtcctgggcggacgtgaaaaaggatctcatttcatacggcggtgggtggaaactggaaggagagtggaaggaaggcgaggaggttcaggtgcttgctctggaaccaggcaaaaacccccgcgccgtccagacaaagcctgggttgttcaagaccaatgcaggaacaatcggtgccgtgagtctagactttagcccaggcacttccgggtctcccatcattgataaaaagggaaaagtagtcggcctgtacggtaacggggtggttacccggtcgggagcttatgtgagcgccatcgcacagacggagaagtcaatagaagacaatcctgagattgaagatgacatcttcagaaaaaggaagctcacaattatggatctgcatccgggcgctggcaagactaaacgataccttcccgccatcgtccgggaggcgataaagcgcgggttaagaaccctgattctcgccccaacaagggtggttgcagctgagatggaagaggccttgcggggactgcctatccgatatcaaacccccgctatcagagcagaacacactggtcgcgagattgtggacctcatgtgtcacgccaccttcacaatgaggctgctttccccagtccgtgtgcctaactacaacctgatcattatggacgaagcccattttacggatcccgctagtatagcggcacggggctatatctctactagagtagagatgggggaggccgctggaattttcatgaccgccacaccaccgggcagcagggacccttttccccagtccaatgcaccaatcatggatgaagaacgcgaaatccccgagcgatcatggtctagcggtcacgagtgggtgaccgacttcaaagggaagactgtttggtttgtccctagtattagagccggaaacgatatagctgcgtgcttgcggaaaaatggcaagaaggtgatccagctatccaggaaaacattcgacagcgaatacgtgaagacccgcacgaacgattgggactttgtcgtaactacagatatttctgagatgggcgccaatttcaaagcagaacgtgtgatcgacccaagacggtgtatgaagcccgttattctgaccgatggggaggaaagggtgatcctcgctggacctatgccggtcacccattcatccgccgcacaacgccgaggtagaataggccggaaccccaagaatgagaacgaccagtatatctacatgggggagcccttagaaaatgacgaggattgcgcccactggaaggaagctaaaatgctgcttgacaacattaatactcctgagggaatcattcccagtatgtttgaaccagagagggagaaggtggatgccatcgacggcgaataccgcctgagaggtgaggcgaggaagacattcgttgatctcatgcggcgtggggacttgcctgtgtggctggcatatcgcgtcgccgctgaaggcataaactacgccgatcgaagatggtgttttgacggaattaaaaataaccagatcctcgaggaaaatgtggaggtagagatttggaccaaggaaggcgagaggaaaaagctgaaaccccggtggcttgatgctcgcatctatagcgacccactagcactgaaggagttcaaggagttcgccgctgggagaaaatcgttgacattaaacctgataactgagatgggaaggctccctacgtttatgacccagaaggcccgggatgcactggacaaccttgcggtgctgcacacagccgaagctggtggccgagcctacaatcatgcactctctgagttgccggaaactctggagaccctactgctccttacactgttagctaccgttactgggggaatcttcttgtttctgatgtccggcagaggtattgggaaaatgacgctcggcatgtgctgcatcattaccgccagcatcctgctttggtatgcacaaatacagccccactggattgccgcttcaatcatcctggagttctttctcattgtcttgctgatcccagagcctgagaagcagcgcacaccccaggataaccaattaacttacgtggtgatagcgattctaaccgtcgttgccgcaacaatggctaatgaaatgggattcctggagaaaaccaagaaggacctcggccttgggagtatcactacacagcagccagaatctaacattctggacatcgatttgaggcctgcctccgcctggacgctgtatgcagtggctaccacttttgtaacacccatgctccggcatagcatagaaaattcaagtgtgaacgtcagcctgaccgccatcgcgaatcaggctaccgtgcttatgggactcggtaaaggctggccgctgtccaagatggacattggggttccattgctggccatcggatgttactctcaagtgaaccctattacattaactgcagccctattcctgctcgtcgctcactacgcaatcattggccccggtcttcaggccaaagcgacgcgtgaagctcagaagagagccgcagccgggatcatgaaaaatccaaccgtagatggcataacagtgattgacctggatcccatcccttatgacccgaagtttgagaagcagttgggacaagttatgctgctcgtgctgtgcgtcactcaggtgcttatgatgaggaccacatgggctttatgtgaggccctgaccctcgcaactggccccatcagcacgttgtgggaagggaacccaggacgcttctggaatacaaccattgctgtctccatggccaacatatttcggggctcatacctggcgggtgccgggctactgttctctatcatgaaaaatactaccaacacacgaagaggaactggcaatatgggtgagaccctcggcgaaaagtggaaaagtaggcttaacgcactggggaagtcggagtttcagatttataaaaagagcggaatccaagaagtggatcgcacattggctaaagagggcattaagagaggggaaacggaccatcacgccgtttccagaggatctgcaaagctgcgttggttcgtggaaaggaatatggtaacccctgagggcaaagtggtcgatctcggttgcgggcggggaggctggtcatactattgtggtggcctgaagaacgttcgcgaagtgaaagggttaactaagggaggccccgggcacgaggagcctatcccaatgagcacatacggatggaaccttgtccgactgcagtccggcgtggacgtattctttacaccacctgaaaaatgcgatactctcctatgtgacataggtgagagttctccaaatcccacagtggaagctgggagaaccctgagggttttgaacctggtggagaattggctcaacaataacacgcagttctgcatcaaggtccttaatccgtatatgcctagcgtgattgaaaagatggaggccctgcagcggaaatacggaggcgccttggtccgcaacccactgtcaagaaattccacccatgagatgtactgggtgagtaacgcgagcggcaatatcgtttcttccgtaaacatgatttcaaggatgctcatcaatcgatttacaatgcggcacaagaaagctactttcgaacccgatgtggacttagggagcggaacccgtaacataggtattgagtcggaaatccctaatctggacatcattggcaagagaatagagaaaatcaagcaagaatatgagacatcttggcattacgatcaggaccacccatataagacttgggcataccacgggagttatgagaccaaacagacaggatccgccagctcaatggtcaacggcgtggttcgccttctgaccaagccctgggatgtggtcccgatggtgactcagatggctatgacggacacaaccccttttggtcaacagagggtattcaaagaaaaggtggatactcggacccaggagcccaaagaagggacaaagaagctaatgaaaattacggccgagtggctctggaaggaactgggcaaaaagaaaaccccaagaatgtgtactcgcgaggagtttacaaggaaggttcgatccaacgcagccttgggcgctatcttcaccgacgaaaataaatggaagtctgcgcgggaggccgtcgaagatagcagattttgggagctggtggacaaggagaggaacctccatcttgaaggcaaatgcgagacttgtgtgtacaatatgatggggaagcgcgagaaaaagctgggagagttcggtaaagcaaagggcagtcgtgctatttggtatatgtggttaggggcccggtttctggagttcgaggcattgggatttctcaacgaggatcactggttctccagagaaaatagcctgtctggcgtcgagggtgaagggctacataaacttggatacatcctgagggacgttagcaaaaaggagggcggcgccatgtacgctgatgacacagccgggtgggacacccgcataacactcgaagatctgaaaaacgaggagatggtgactaatcacatggaaggagagcataagaaattggcggaagcaatcttcaagctgacctatcagaacaaggtagtgcgagtccaacggcctacgcccagaggtaccgtgatggacattatcagtaggcgcgatcagagaggctccgggcaggttggaacatacggcctcaatacttttaccaacatggaggcccaacttattcggcagatggaaggtgagggggtgttcaaaaatatccagcacctgacagtcactgaggaaattgctgtgcagaactggttagccagggtaggacgtgagcgactgagccgcatggcaatatctggcgacgattgcgttgtgaagccattggacgatagatttgcttcggccctcaccgctctgaatgacatgggcaaagtccggaaggatatccaacagtgggaaccctcaagggggtggaacgactggacacaggtgcctttctgcagccaccattttcacgagctaattatgaaagatggacgcgtgcttgtcgttccatgtagaaatcaggacgagctgatcggtcgggccaggatctcccaaggcgcagggtggagtctccgagaaacagcgtgcctgggaaagtcttatgcccagatgtggagcttgatgtacttccatcgtagagatttacgcctggctgccaacgcaatttgttccgctgtgccgtcacactgggtacccaccagtcggactacatggtctatacacgccaagcatgagtggatgaccactgaagacatgctcaccgtgtggaacagggtctggatccaggagaatccttggatggaagacaaaacaccagtggagagctgggaggaaattccctatcttggcaagagagaggatcagtggtgcggttccctgatcgggctaacgtcacgcgcaacctgggccaaaaacattcaaactgcgatcaatcaggttcggagcctgataggaaacgaagagtacacagactatatgccttctatgaagaggtttcgaagagaagaggaggaagctggcgtgctctggtga

SEQ ID NO: 14304 - RNA, 9876 nt, synthetic construct
  misc_feature 1..9876: note = derived and/or modified CDS sequence (opt3) from DENV-2__KF041232__SS-prME
  source 1..9876: mol_type = other RNA
accgcaggcgtgatcattatgctgatacccactgctatggcattccacctcactacgagaaatggggaacctcatatgatcgtcagcaagcaggaaaaaggaaagtcccttctgtttaaaaccgaagacggtgttaatatgtgcacattgatggccatggatttaggcgaactgtgtgaagacactattacctacaactgcccactgctcaggcaaaatgaaccggaagatatcgactgttggtgcaacgcgacatctacctgggtgacttatgggacatgtaccgctacgggagaacaccggcgcgaaaagcgatcagtagccctggtgccccatgtcggcatgggtcttgagactcgtaccgaaacatggatgagtagcgagggggcatggaaacacgcccagagaattgagacttggatcctgaggcatcctggattcaccataatggctgcaatcttggcctacacaattggcaccacgtattttcagcgggtgctcatcttcattctgctgactgctgttgccccatccatgacaatgcgctgcatcggcatatctaatagagattttgtggaaggggtctcgggaggttcatgggtggacattgtactcgagcacggcagctgtgttaccactatggcgaagaacaagcccacattagatttcgaactgatcaaaaccgaggcaaagcagcctgccacgcttaggaaatactgcattgaagctaagttgaccaatacaactaccgccagtcggtgtccaacacaaggggagccctccctgaacgaggaacaggacaaacgctttgtgtgcaagcactctatggtcgatcgaggatggggcaatggttgtgggctattcggaaagggcggcatcgtgacttgcgcaatgtttacctgcaaaaagaacatggaggggaaaatcgtgcagcctgaaaatctcgagtatacaattgtcgttaccccacatagcggagaagagaacgctgtgggtaatgacactggcaagcacgggaaagagataaaggtaacgccgcagtcctcaatcacagaagccgagctgaccggatacggcactgtgaccatggaatgtagtcccagaacaggtcttgatttcaacgagatggtcctgttgcaaatggaaaataaagcgtggctcgtgcataggcagtggtttctggacttacctctgccatggctccccggggccgatattcagggcagcaactggatccagaaggagacccttgttactttcaagaaccctcacgccaagaagcaagacgtggtcgtgctgggatctcaggagggcgctatgcacacagccttgacgggggctaccgaaatacagatgtcctcaggaaatctactgtttactggtcatctcaaatgccggctgcgtatggacaaacttcaactgaaaggcatgagctatagtatgtgtacagggaagttcaaggtagttaaagagattgccgaaacccagcacggaacaatcgtggtccgcgtgcagtacgagggcgatggttctccatgcaagatccccttcgagattatggacttggagaagagacatgtcctcgggaggctgatcactgtgaacccgattgttaccgagaaggattcccctgtgaatatagaagcagagcccccatttggcgacagctacatcattatcggagtagaacctggccagttaaaactgtcgtggttcaagaaggggtcttccatcggacaaatgtttgagacgaccatgcggggtgccaaacgaatggctattctaggcgatacagcgtgggacttcgggtcactcggaggcgtctttacaagtataggtaaggcactgcaccaggtgttcggggccatctatggcgctgcctttagcggagtttcctggaccatgaaaattcttatcggcgtggtcattacatggatcgggatgaactctcgcagcacttcattgagtgtgtccctggtactcgtgggagttgtcaccctgtaccttggcgcaatggtgcaggccgatagcggttgtgtggtctcttggaagaataaagagctgaagtgcgggtcaggaatattcatcacggacaacgttcatacatggaccgaacagtataagtttcaacccgagagtccaagcaaattggcttccgccattcagaaggcacacgaagagggcatctgtggtattagatctgtgactaggctcgaaaatctgatgtggaaacagatcacacccgagttaaaccacatactgtcggagaatgaagtgaagctaagcattatgaccggcgatatcaaagggattatgcaggcgggaaagcggtccctccgccctcaaccaactgagctgaaatactcatggaagacctggggcaaggctaaaatgcttagtacagaaccgcataaccagacgttcttgatcgacgggcccgagaccgccgaatgccctaatactaacagagcatggaactctctggaggtagaggattatggatttggcgtcttcacaaccaacatatggctcaagctgaaagaaaggcaggacgtgttttgtgacagcaagttaatgtccgccgctatcaaagataatcgtgccgttcacgcagacatgggttactggattgagtcagctctgaacgatacatggaagatcgaaaaggccagcttcattgaggtgaaatcttgccattggccaaagtcccacactctttggagtaacggggtcttggagagcgaaatgatcatacccaaaaatttcgcgggacctgtgtctcagcacaactatcggccaggctaccatacccaaacggccggtccctggcacctcggcaagctggagatggactttgatttctgtgaagggacaaccgttgtggtaactgaggactgcggaaatcgaggcccgtccctaagaaccacaactgcttcagggaaactgattaccgaatggtgctgtaggagttgcacactccctccactgcgctaccggggagaggatggctgttggtatggtatggagatcagaccccttaaggaaaaggaggaaaacttggtcaatagcctggtgacggcagggcatggacagatcgacaacttttcgttaggcgtgctcggtatggccctgttccttgaggaaatgctgaggacccgcgtcggcactaaacacgctgttttgctcgtggccgtatcctttatgacactgattaccgggaatatgtctttccgagatctaggacgggtgatggtcatggtgggcgcagcgatgactgacgatatcgggatgggagttacatacctggccctcctggctgcctttaaggtgcgtcctaccttcgcagctggccttttgctgagaaaattaacgagcaaggagctcatgatgactaccattggtatagtcctgctttcacagagtacaacccccgagactatcctggaactaacagacgccctcgcactggggatgatgattttgaaaatcgtgaggaacatggagaagtatcaactggccgttaccattatggctatcttatgcgtgccaaatgcggtcatactccagaacgcctggaaggtatcctgtacaatcctggcagctgtgtctgttagccctcttctgttgacttcctcacagcagaaagccgattggattcccctcgccctgaccatcaagggactaaatccaacggctatttttctgacaacccttagccgcactaacaaaaagcggagttggccgctcaatgaagcaatcatggccgtgggcatggtctctatactggcgtccagcttgctgaaaaacgacattcctatgaccggccccttagtggctgggggactcctgacagtatgctacgtgcttactggtagatcggccgacctggagttggaaagggcagccgatgtccgatgggaggaccaagctgagatctcaggctctagtccaatcctctccattaccataagcgaagatgggtctatgagcatcaagaatgaggaagaggagcagacgctgacaattctaatccgcaccggactgcttgttatttccggcctcttccccgtgtcaatccctataactgcagccgcgtggtatctgtgggaagtgaaaaagcagcgggctggtgtcttgtgggacgtgccaagtccccctccggttgggaaggccgagttagaagatggagcatacagaatcaaacagaagggcattctgggctatagccaaatcggggccggagtatacaaagagggtacatttcataccatgtggcacgtgactaggggcgctgtcctcatgcacaaggggaaacgtattgaaccatcttgggccgacgtgcgcaaggatctgatctcctacggaggcggttggaaacttgagggggagtggaaagaaggagaggaagttcaggtgctggcattggagcccggcaagaaccctcgggctgtccagacaaaaccaggcctattcaagaccaacacggggactataggagccgtgtcactggactttagtcccggtaccagcggctcccctattgtagataaaaaggggaaggtcgtgggactctatggcaatggtgttgtgacaagatctgggacctacgtctcggcgatcgcccagacagagaaaagcatcgaggacaacccggagattgaagatgacatcttcaggaagaaacgactgactataatggatcttcatcccggagcaggcaagaccaaacggtatttaccagctattgtgcgcgaggccatcaagagaggcctgaggacgctcattttggctcctacacgggttgtggcagccgaaatggaggaagccctgcgagggctccccatcagataccaaactccagctatacgcgcggagcacaccggaagggagattgtcgacctgatgtgtcatgcaacattcaccatgcgtcttctgtcacctgtgcgggtacccaattataacttgatcatcatggacgaagcccactttactgatccagcttccattgccgcaagaggttacatcagtaccagggtggagatgggcgaagccgctgggattttcatgacagcgacgccgcctggatctcgcgacccctttccacagagcaatgcccccataatggatgaggagcgagaaatccctgagagatcctggaactcaggccatgaatgggttactgacttcaagggtaaaaccgtctggtttgtgccatctattaaggcagggaatgatatcgctgcctgcctacggaaaaacggaaagaaagtgatccagctgagcaggaagacattcgacagtgagtatattaagacccgcactaatgattgggactttgtcgtaacaaccgatatatccgaaatgggcgcaaacttcaaagccgagcgtgtgatcgaccccagacggtgtatgaagcctgttattctcacggatggcgaggaaagggtgatcttagctgggccgatgccagtcactcacagctctgccgcgcaacgccgaggaagaattggtcggaatcccaaaaacgagaatgaccagtacatctacatgggcgaacctctggagaacgacgaagattgcgcacactggaaggaggccaaaatgcttctggacaatataaacacacccgaggggatcattccatcaatgtttgaacctgagagggaaaaggtggatgctatcgacggagagtatcgcctcagaggcgaagccaggaaaaccttcgttgatttgatgcggcgtggtgacctgcccgtgtggctcgcttaccgcgtcgcagccgaggggattaactatgctgatcgaagatggtgttttgacggcatcaagaataaccagatactggaggaaaatgtggaggtagaaatttggaccaaggagggagagaggaagaaacttaaaccacggtggctagatgcccgcatctactccgaccctctggcattgaaggagttcaaagagttcgcggccggcagaaagagtttaactctgaacctcattacagaaatggggaggctgccgacctttatgacacagaaggctcggaatgcccttgataacctggcagtgctccatactgctgaggccggaggtcgagcatataatcacgccttgagcgaactgcccgagacgctagagaccctgctccttctgacattattggctactgttaccggcgggatcttcctgtttctcatgtcgggaaaaggcataggtaagatgacactggggatgtgctgcatcattaccgcgtctatccttctgtggtacgcccaaattcagccacattggatcgcagcttccataattctcgagttctttttgatcgtcctgttaatccctgagcccgaaaaacagagaactccacaggacaaccaactaacgtatgtggtgattgccatcctgaccgtcgttgccgcaacaatggctaatgagatgggcttcctcgaaaagactaaaaaggattttggacttggcagcatagccacccagcagcctgagtcaaacattctggacatcgacttgcgccccgcgagtgcttggacactgtacgccgtggcaaccactttcattacaccgatgctcaggcactctatcgaaaattccagcgtaaacgtgtcactgacggccatagctaatcaggcaaccgtccttatggggctcggaaagggttggccactgagtaaaatggatatcggcgtgcctttgctggccattgggtgttacagccaagttaaccccatcactttaacagcggctctactgctccttgtggcccactatgcaattatcggaccaggcctgcaggccaaggctacccgggaagcccagaaacgtgcagctgccggtattatgaagaatcccaccgtcgacgggatcacagtaatagatttggaccctattccgtacgatcccaaatttgagaagcagctgggccaagtgatgctcctggttctttgcgtgactcaggtcttaatgatgagaacgacctgggcgctgtgtgaagccctcacattggcaactggaccaatctccaccctgtgggagggcaaccctgggaggttctggaatacaaccatcgctgtgtctatggccaacatttttcgcggaagctatctagcaggcgctggtctactcttctccataatgaagaacactacgaatacacggcgagggaccggaaacactggcgaaacccttggtgagaaatggaagaatagactgaactcattgggcaaatctgagtttcagatctacaagaggagtgggattcaagaagtcgaccgcacactggccaaagagggaatcaagcggggcgaaactgatcatcacgccgtgtcgagagggagcgcgaaactccgttggttcgttgagaggaatctggtgacccccgagggaaaggtagtggacttaggctgcggtcgcgggggatggtcctattactgtggcggtcttaagaacgtccgggaagttaaaggcctgacaaaagggggacctggccatgaggaaccaattcccatgtctacgtatgggtggaatctcgtgcgactacagtcaggagtcgatgtgttctttacccctccagagaaatgcgacactctgttgtgtgatatcggcgaaagctcccccaacccgacagtagaggctggtagaaccctgagggtgctcaatcttgttgagaactggctgaataacaatactcagttctgcataaaggtgttgaacccttacatgccaagtgtcatcgagaagatggagacactgcagcggaagtacgggggagcactcgtgcgcaatcccttatctagaaacagcacccacgaaatgtattgggtctcaaacgcctccggcaatattgtgagtagcgttaacatgatctctaggatgctgattaatcgatttacgatgcggcataagaaagctacctacgagcctgacgtagatcttggctccgggacacgtaacatcggaatagaatcagagactccaaatctggacattatcggtaagagaatcgagaaaattaagcaagaacacgagaccagctggcactatgaccaggatcatccctacaaaacatgggcctatcacggctcgtacgaaactaagcagaccgggtctgcaagttccatggtgaacggagtcgtgcgcctactcacaaagccgtgggacgttatacctatggtgacccagatggccatgactgatacgacacccttcggccaacagagggtctttaaagagaaggtggacacccggactcaggaaccaaaagagggtaccaagaaactgatgaagatcacagctgagtggttgtggaaggaactggggaaaaagaaaacgcctagaatgtgtacccgcgaggagttcgcgaggaaggtacgaagcaatgccgcactcggagctatttttactgatgagaacaaatggaagtcagcccgggaggcagtggaagactccagattctgggagcttgttgataaagaaaggaatctgcatttagagggcaagtgcgaaacatgtgtctataacatgatgggcaagcgcgagaaaaagatcggggagtttggaaaagccaagggttctcgtgctatttggtacatgtggctgggcgcccggttcttggaatttgaggcgctcgggttcctgaatgaagaccactggtttagcagagagaacagtctatccggagtggaaggcgagggtcttcacaaactggggtacatcctcagggaggtgagcaagaaggaaggaggcgcaatgtatgccgatgacaccgctggctgggatactcgcataacactggaggacttgaaaaatgaagagatggtcaccaaccatatggaaggggagcacaagaaactggccgaggcaatcttcaagctcacataccagaataaagttgtgcgagtacaacggcccactccaagaggaaccgtgatggacattatctctaggcgcgatcagagaggttcaggccaggtcgggacgtatggacttaacaccttcacaaacatgggcgctcaactgattcggcagatggaaggtgagggggtgtttaagggaatccagcatttaactgccaccgaagaggttgctgtgcaggactggctggccagggtcggccgtgagcgattgagtcgcatggcaatttccggcgatgactgcgtggtaaagcccctcgatgacagattcgcgaatgccctgacagctctaaacgatatggggaaagttcggaaggacatacaacagtgggaacctagcaggggatggaatgattggactcaggtgccattttgctctcaccatttccacgagcttatcatgaaagacggtcgcgtcctggtggtgccgtgtagaaaccaggatgaactcattggccgggccaggatctcgcaaggggcaggatggtcactgcgagagaccgcttgcttgggcaagagctacgcccagatgtggtccttaatgtattttcaccgtagagacctgcgcctcgcagccaatgcgatctgtagtgctgtcccctctcattgggttcctacgagccggacaacctggtccattcacgccaggcatgaatggatgactacagaggatatgcttaccgtgtggaacagagtatggatacaggagaatccatggatggaagacaaaactcccgtggagtcatgggaagagatcccttacctgggtaagcgcgaagaccagtggtgcgggagtctaattggactgacctctcgggcaacatgggccaggaacatccaaacggctattaatcaggtccgaagcctcatcggctccgaggagtataccgattacatgccatcaatgaagagattccggagggaagaggaagaggccggcgtgttgtggtga

SEQ ID NO: 14305 - RNA, 9876 nt, synthetic construct
  misc_feature 1..9876: note = derived and/or modified CDS sequence (opt3) from DENV-2__KF041233__SS-prME
  source 1..9876: mol_type = other RNA
accgccggagtgatcattatgctgatacccactgctatggcgttccacctcactacgagaaatggggaacctcatatgatcgtcagcaagcaggaaaaaggaaagtcccttctgtttaaaaccgaagacggtgttaatatgtgcacattgatggccatggatttaggagaactgtgtgaagacactattacctacaactgcccactgctcaggcaaaatgaaccggaagatatcgactgttggtgcaactctacatcaacctgggtgacttatgggacatgtaccgcgacgggagaacaccggcgcgaaaagcgaagtgttgctctggtgccccatgtcggcatgggtcttgagactcgtaccgaaacatggatgagctccgagggggcctggaaacacgcacagagaattgagacttggatcctgaggcatcctggattcaccataatggccgctatcttggcatacacaattggcaccacgtattttcagcgggtgctcatcttcattctgctgactgccgttgctccatctatgacaatgcgctgcatcggcatatcgaatagagattttgtggaaggggtctcaggaggtagctgggtggacattgtactcgagcacggcagttgtgttaccactatggccaagaacaagcccacattagatttcgaactgatcaaaaccgaggcgaagcagcctgcaacgcttaggaaatactgcattgaagccaagttgaccaatacaactaccgcttcccggtgtccaacacaaggggagccctctctgaacgaggaacaggacaaacgctttgtgtgcaagcacagcatggtcgatcgaggatggggcaatggttgtgggctattcggaaagggcggcatcgtgacttgcgccatgtttacctgcaaaaagaacatggaggggaaaatcgtgcagcctgaaaatctcgagtatacaattgtcgttaccccacattccggagaagagaacgcagtgggtaatgacactggcaagcacgggaaagagataaaggtaacgccgcagtcaagtatcacagaagctgagctgaccggatacggcactgtgaccatggaatgtagccccagaacaggtcttgatttcaacgagatggtcctgttgcaaatggaaaataaagcctggctcgtgcataggcagtggtttctggacttacctctgccatggctccccggggcggatattcagggctctaactggatccagaaggagacccttgttactttcaagaaccctcacgccaaaaagcaagacgtggtcgtgctgggatcccaggagggcgcaatgcacacagctttgacgggggccaccgaaatacagatgtcaagcggaaatctactgtttactggtcatctcaaatgccggctgcgtatggacaaacttcaactgaaaggcatgagttattctatgtgtacagggaagttcaaggtagttaaagagattgctgaaacccagcacggaacaatcgtggtccgcgtgcagtacgagggcgatggttccccatgcaagatccccttcgagattatggacttggagaagagacatgtcctcgggaggctgatcactgtgaacccgattgttaccgagaaggatagccctgtgaatatagaagccgagcccccatttggcgactcgtacatcattatcggagtagaacctggccagttaaaactgtcttggttcaagaaggggtcctcaatcggacaaatgtttgagacgaccatgcggggtgcaaaacgaatggccattctaggcgatacagcttgggacttcgggagtctcggaggcgtctttactagcataggtaaggcgctgcaccaggtgttcggggcaatctatggcgccgctttttccggagtttcttggaccatgaaaattcttatcggcgtggtcattacatggatcgggatgaacagccgctcaacaagtttgtccgtgagcctggtactcgtgggagttgtcaccctgtaccttggcgtgatggtgcaggccgattctggttgtgtcgtttcatggaagaataaagagctgaagtgcgggagtggaatattcatcacggacaacgtgcatacatggaccgaacagtataagtttcaacccgagagcccatccaaattggcagccgctattcagaaggcccacgaagagggcatctgtggtattagatctgtgactaggctcgaaaatctgatgtggaaacagatcacacccgagttaaaccacatactgtcggagaatgaagtaaagctaagcattatgaccggcgatatcaaagggattatgcaggcaggaaagcggtccctccgccctcaaccaactgagctgaaatactcatggaagacctggggcaaggcgaaaatgcttagtacagaaccgcataaccagacgttcttgatcgacgggcccgagaccgctgaatgccctaatactaacagagcctggaactctctggaggtcgaggattatggatttggcgtgttcacaaccaacatatggctcaagctgaaagaaaggcaggacgtattttgtgacagcaagttaatgtccgcagccatcaaagataatcgtgctgtgcacgccgacatgggttactggattgagtcagcactgaacgatacatggaagatcgaaaaggctagcttcattgaggtcaaatcttgccattggccaaagtcccacactctttggagtaacggggtgttggagagcgaaatgatcatacccaaaaatttcgccggacctgtttctcagcacaactatcggccaggctaccatacccaaacggcgggtccctggcacctcggcaagctggagatggactttgatttctgtgaagggacaaccgtggtagtcactgaggactgcggaaatcgaggcccgtccctaagaaccacaactgcctcagggaaactgattaccgaatggtgctgtaggagttgcacactccctccactgcgctaccggggagaggatggctgttggtatggtatggagatcagaccccttaaggaaaaggaggaaaacttggtgaatagcctggtgacggctgggcatggacagatcgacaacttttcgttaggcgtcctcggtatggcactgttccttgaggaaatgctgaggacccgcgttggcactaaacacgccgtgttgctcattgctgtatcctttatgacactgatcaccgggaatatgtctttccgagatctaggacgggtgatggtcatggtgggcgccgcaatgactgacgatattgggatgggagttacatacctggcgctcctggccgcttttaaggtgcgtcctaccttcgccgcaggccttttgctgagaaaattaacgagcaaggagctcatgatgactaccataggtatcgtcctgctttcacagagtacaacccccgagactattctggaactaacagacgctctcgccctggggatgatgatcttgaaaattgtgaggaacatggagaagtatcaactggcagttaccatcatggccatattatgcgtgccaaatgctgtcatcctccagaacgcgtggaaggtatcctgtacaattctggccgcagtgtctgttagccctcttctgttgacttcctcacagcagaaagctgattggatccccctcgccctgaccattaagggactaaatccaacggccatctttctgacaacccttagccgcactaacaaaaagcggagttggccgctcaatgaagctataatggcagtgggcatggtctctattctggcctccagcttgctgaaaaacgacatccctatgaccggccccttagtggcagggggactcctgacagtatgctacgtgcttactggtagatcggctgacctggagttggaaagggccgcagatgtccgatgggaggaccaagccgagatctcaggctctagtccaattctctccataaccatcagcgaagatgggtctatgagcattaagaatgaggaagaggagcagacgctgacaatcctaattcgcaccggactgcttgttatctccggcctcttccccgtgtcaatacctatcactgctgcagcctggtatctgtgggaagtgaaaaagcagcgggcgggtgtcttgtgggacgtgccaagtccccctccggttgggaaggctgagttagaagatggagcctacagaattaaacagaagggcatcctgggctatagccaaattggggcaggagtatacaaagagggtacatttcataccatgtggcacgtgactaggggcgccgtcctcatgcacaaggggaaacgtatcgaaccatcttgggctgacgtgcgcaaggatctgatatcctacggaggcggttggaaacttgagggggagtggaaagaaggagaggaagttcaggtgctggccttggagcccggcaagaaccctcgggcagtccagacaaaaccaggcctattcaagaccaacacggggactattggagctgtgtcactggactttagtcccggtaccagcggctcccctatcgtagataaaaaggggaaggtcgtgggactctatggcaatggtgttgtgacaagatctgggacctacgtctcggccatcgcgcagacagaaaagagcattgaggacaacccggagatcgaggatgacatattcaggaagaaaaagctgactattatggatcttcatcccggagccggcaaaaccaagcgatatttaccagcaatcgtgcgggaggctattaagcgcggcctgagaacgctcatcttggcccctacaagggttgtggctgcagaaatggaggaagccctgcgggggctccccatacgataccaaactccagccattagagctgagcacaccggacgcgagatcgtcgacctgatgtgtcatgcgacattcaccatgaggcttctgtcacctgtgcgtgtacccaattataacttgatcattatggacgaagcacactttactgatccagcctccatcgctgcccggggttacattagtaccagagtggagatgggcgaagcagccgggatattcatgacagctacgccgcctggatctagggacccctttccacagagcaatgcgcccatcatggatgaggagcgcgaaattcctgagcgatcctggaactcaggccatgaatgggttactgacttcaaaggtaagaccgtctggtttgtgccatctatcaaagccgggaatgatatcgcagcttgcctaagaaagaacggcaaaaaggtgattcagctgagccggaagacattcgacagtgagtatataaaaaccaggactaatgattgggactttgtcgtaacaaccgatatctccgaaatgggcgccaacttcaaggcagagcgcgtgattgacccccgtagatgtatgaaacctgttatcctcacggatggcgaggaacgggtgattttagccgggccgatgccagtcactcacagctctgctgcccaaaggcgcggacgaatcggtagaaatcccaagaacgagaatgaccagtacatatacatgggcgaacctctggagaacgacgaagattgcgcgcactggaaagaggcaaagatgcttctggacaatatcaacacacccgaggggattatcccatcaatgtttgaacctgagcgggaaaaagtggatgccattgacggagagtataggctccgcggcgaagctagaaagaccttcgttgatttgatgaggcggggtgacctgcccgtgtggctcgcctaccgtgtcgctgcagaggggatcaactatgccgatcgccgatggtgttttgacggcataaagaataaccagattctggaggaaaatgtggaggtagaaatctggaccaaagagggagagagaaagaaacttaagccaaggtggctagatgctcggatttactccgaccctctggccttgaaagagttcaaggagttcgcagcgggccgcaagagtttaactctgaacctcatcacagaaatggggagactgccgacctttatgacacagaaagccaggaatgctcttgataacctggccgtgctccatactgcagaggctggaggtcgggcctataatcacgcattgagcgaactgcccgagacgctagagaccctgctccttctgacattattggccactgttaccggcgggatattcctgtttctcatgtcgggaaagggcatcggtaaaatgacactggggatgtgctgcattatcaccgcttctattcttctgtggtacgcgcaaatccagccacattggatagccgcatccattatcctcgagttctttttgatcgtcctgttaattcctgagcccgaaaagcagcgaactccacaggacaaccaactaacgtatgtggtgatcgctatactgaccgtcgttgccgccacaatggcaaatgagatgggcttcctcgagaaaactaagaaggattttggacttggcagcattgctacccagcagcctgagtcaaacatcctggacattgacttgagacccgccagtgcgtggacactgtacgctgtggccaccactttcatcacaccgatgctccgccactctatagaaaattccagcgtaaacgtgtcactgacggcaatcgccaatcaggctaccgtccttatggggctcggaaaaggttggccactgagtaagatggatattggcgtgcctttgctggcaatcgggtgttacagccaagttaaccccattactttaacagccgcgctactgctccttgtggctcactatgccatcattggaccaggcctgcaggcaaaagccaccagggaagctcagaagcgggccgcagctggtatcatgaaaaatcccaccgtcgacgggataacagtaattgatttggaccctatcccgtacgatcccaagtttgagaagcagctgggccaagtgatgctcctggttctttgcgtgactcaggtcttaatgatgcgtacgacctgggccctgtgtgaagcgctcacattggccactggaccaatctccaccctgtgggagggcaaccctgggagattctggaatacaaccattgcagtgtctatggctaacatatttaggggaagctatctagccggcgcaggtctactcttctccatcatgaaaaacactacgaatacacgccgggggaccggaaacactggcgaaacccttggtgagaagtggaaaaatcgactgaactcattgggcaagtctgagtttcagatttacaaaagaagtgggatccaagaagtcgacaggacactggctaaggagggaattaaacgcggcgaaactgatcatcacgccgtgtcgcgggggagcgccaagctcagatggttcgttgagcgtaatctggtgacccccgagggaaaggtagtggacttaggctgcggtaggggagggtggtcctattactgtggcggtcttaaaaacgtccgggaagttaagggcctgacaaaagggggacctggccatgaggaaccaatccccatgtctacgtatgggtggaatctcgtgcgcctacagtcaggagtcgatgtgttctttacccctccagagaagtgcgacactctgttgtgtgatataggcgaaagctcccccaacccgacagtagaggcgggtcgaaccctgagagtgctcaatcttgttgagaactggctgaataacaatactcagttctgcatcaaagtgttgaacccttacatgccaagtgtcattgaaaagatggagacactgcagaggaagtacgggggagctctcgtgcggaatcccttatctcgcaacagcacccacgaaatgtattgggtctcaaacgcatccggcaatatcgtgagtagcgttaacatgatttctagaatgctgatcaataggtttacgatgcgacataaaaaggccacctacgagcctgacgtagatcttggctccgggacacggaacataggaattgaatcagagactccaaatctggacatcatcggtaaacgtattgagaagataaaacaagaacacgagaccagctggcactatgaccaggatcatccctacaagacatgggcttatcacggctcgtacgaaactaagcagaccgggtctgccagttccatggtgaacggagtcgtgagactactcacaaaaccgtgggacgttatccctatggtgacccagatggcaatgactgatacgacacccttcggccaacagcgcgtctttaaggagaaagtggacaccaggactcaggaaccaaaggagggtaccaaaaagctgatgaagattacagccgagtggttgtggaaagaactggggaagaaaaagacgcctcggatgtgtaccagagaggagttcgctcgcaaagtaaggagcaatgcggccctcggagcaatctttactgatgagaacaagtggaaatcagctcgagaggccgtggaagactcccggttctgggagcttgttgataaggaaagaaatctgcatttagagggcaagtgcgaaacatgtgtctataacatgatgggcaaaagggagaagaaaattggggagtttggaaaggcaaaaggttctcgcgccatctggtacatgtggctgggcgctcgtttcttggaatttgaggccctcgggttcctgaatgaagaccactggtttagccgggagaacagtctatccggagtggaaggcgagggtcttcacaagctggggtacatactcagagaggtgagcaagaaagaaggaggcgcgatgtatgcagatgacaccgccggctgggatactaggatcacactggaggacttgaagaatgaagagatggtcaccaaccatatggaaggggagcacaaaaagctggctgaggccattttcaaactcacataccagaataaggttgtgcgcgtacaacgacccactccacggggaaccgtgatggacatcatttctagaagggatcagcgcggttcaggccaggtcgggacgtatggacttaacaccttcacaaacatgggcgcacaactgatcagacagatggaaggtgagggggtgtttaagggcattcagcatttaactgctaccgaagaggttgccgtgcaggactggctggctcgggtcggcagggagcgtttgagtcgaatggccatatccggcgatgactgcgtggtaaaacccctcgatgaccgcttcgcaagcgcgctgacagccctaaatgatatggggaaggttagaaaagacatccaacagtgggaaccttctcggggatggaacgattggactcaggtgccattttgctcgcaccatttccacgagcttattatgaaggacggtagggtcctggtggtgccgtgtcgcaatcaggatgaactcatcggcagagctcggatctcacaaggggccggatggagcctgagggagaccgcatgcttgggcaaatcctacgctcagatgtggagtttaatgtattttcaccgacgtgacctgagactcgccgcaaacgccatttgttctgcggtccccagccattgggttcctacgtcccgcacaacctggtcaatacacgctcggcatgaatggatgactacagaggatatgcttaccgtgtggaatagggtatggatccaggagaacccatggatggaagacaagactctggtggagagttgggaagagattccctacctaggtaagagagaagaccagtggtgcgggtctctgatcggactcaccagccgcgccacatgggcacggaatattcaaacggccatcaaccaggtcaggtccttgataggctcagaggagtataccgattacatgcctagcatgaaacgattcagacgggaagaggaagaggctggcgtgctgtggtga

SEQ ID NO: 14306 - RNA, 9876 nt, synthetic construct
  misc_feature 1..9876: note = derived and/or modified CDS sequence (opt3) from DENV-2__KF041234__SS-prME
  source 1..9876: mol_type = other RNA
accgcaggagtgatcattatgctgatacccactgctatggcattccacctcactacgagaaatggggaacctcatatgatcgtcagcaagcaggaaaaaggaaagtcccttctgtttaaaaccgaagacggtgttaatatgtgcacattgatggccatggatttaggcgaactgtgtgaagacactattacctacaactgcccactgctcaggcaaaatgaaccggaagatatcgactgttggtgcaacgcgacatctacctgggtgacttatgggacatgtaccgctacgggagaacaccggcgcgaaaagcgatcagtagccctggtgccccatgtcggcatgggtcttgagactcgtaccgaaacatggatgagtagcgagggggcatggaaacacgcccagagaattgagacttggatcctgaggcatcctggattcaccataatggctgcaatcttggcctacacaattggcaccacgtattttcagcgggtgctcatcttcattctgctgactgctgttgccccatccatgacaatgcgctgcatcggcatatctaatagagattttgtggaaggggtctcgggaggttcatgggtggacattgtactcgagcacggcagctgtgttaccactatggcgaagaacaagcccacattagatttcgaactgatcaaaaccgaggcaaagcagcctgccacgcttaggaaatactgcattgaagctaagttgaccaatacaactaccgccagtcggtgtccaacacaaggggagccctccctgaacgaggaacaggacaaacgctttgtgtgcaagcactctatggtcgatcgaggatggggcaatggttgtgggctattcggaaagggcggcatcgtgacttgcgcaatgtttacctgcaaaaagaacatggaggggaaaatcgtgcagcctgaaaatctcgagtatacaattgtcgttaccccacatagcggagaagagaacgctgtgggtaatgacactggcaagcacgggaaagagataaaggtaacgccgcagtcctcaatcacagaagccgagctgaccggatacggcactgtgaccatggaatgtagtcccagaacaggtcttgatttcaacgagatggtcctgttgcaaatggaaaataaagcgtggctcgtgcataggcagtggtttctggacttacctctgccatggctccccggggccgatattcagggcagcaactggatccagaaggagacccttgttactttcaagaaccctcacgccaagaagcaagacgtggtcgtgctgggatctcaggagggcgctatgcacacagccttgacgggggctaccgaaatacagatgtcctcaggaaatctactgtttactggtcatctcaaatgccggctgcgtatggacaaacttcaactgaaaggcatgagctatagtatgtgtacagggaagttcaaggtaattaaagagatcgccgaaacccagcacggaacaatcgttgtgcgcgtccagtacgagggcgatggttctccatgcaagattcccttcgagatcatggacttggagaagagacatgtgctcgggaggctgattactgtcaacccgatagtgaccgagaaggattcccctgttaatatcgaagcagagcccccatttggcgacagctacattatcatcggagtggaacctggccagttaaaactgtcgtggttcaagaaggggtcttccattggacaaatgtttgagacgaccatgcggggtgccaaacgaatggctatactaggcgatacagcgtgggacttcgggtcactcggaggcgtatttacaagtatcggtaaggcactgcaccaggtcttcggggccatttatggcgctgcctttagcggagtgtcctggaccatgaaaatccttattggcgttgtgatcacatggatagggatgaactctcgcagcacttcattgagtgtctccctggtgctcgtaggagtggttaccctgtaccttggcgtcatggtgcaggcagatagcggttgtgtggtctcttggaagaataaagagctgaagtgcgggtcaggaatcttcattacggacaacgttcatacatggaccgaacagtataagtttcaacccgagagtccaagcaaattggcctccgctatccagaaggcccacgaagagggcatttgtggtatcagatctgtgactaggctcgaaaatctgatgtggaaacagataacacccgagttaaaccacattctgtcggagaatgaagtgaagctaagcatcatgaccggcgatattaaagggatcatgcaggcaggaaagcggtccctccgccctcaaccaactgagctgaaatactcatggaagacctggggcaaggcgaaaatgcttagtacagaaccgcataaccagacgttcttgatagacgggcccgagaccgctgaatgccctaatactaacagagcctggaactctctggaggtagaggattatggatttggcgtcttcacaaccaacatctggctcaagctgaaagaaaggcaggacgtgttttgtgacagcaagttaatgtccgcagccattaaagataatcgtgctgttcacgccgacatgggttactggatcgagtcagcactgaacgatacatggaagattgaaaaggctagcttcatcgaggtgaaatcttgccattggccaaagtcccacactctttggagtaacggggtcttggagagcgaaatgataattcccaaaaatttcgccggacctgtgtctcagcacaactatcggccaggctaccatacccaaacggcgggtccctggcacctcggcaagctggagatggactttgatttctgtgaagggacaaccgttgtggtaactgaggactgcggaaatcgaggcccgtccctaagaaccacaactgcctcagggaaactgatcaccgaatggtgctgtaggagttgcacactccctccactgcgctaccggggagaggatggctgttggtatggtatggagatcagaccccttaaggaaaaggaggaaaacttggtcaatagcctggtgacggctgggcatggacagattgacaacttttcgttaggcgtgctcggtatggcactgttccttgaggaaatgctgaggacccgcgtcggcactaaacacgccgttttgctcgtggctgtatcctttatgacactgatcaccgggaatatgtctttccgagatctaggacgggtgatggtcatggtgggcgccgcaatgactgacgatattgggatgggagttacatacctggcgctcctggccgcttttaaggtgcgtcctaccttcgccgcaggccttttgctgagaaaattaacgagcaaggagctcatgatgactaccataggtatcgtcctgctttcacagagtacaacccccgagactattctggaactaacagacgctctcgccctggggatgatgatcttgaaaattgtgaggaacatggagaagtatcaactggcagttaccatcatggccatattatgcgtgccaaatgctgtcatcctccagaacgcgtggaaggtatcctgtacaattctggccgcagtgtctgttagccctcttctgttgacttcctcacagcagaaagctgattggatccccctcgccctgaccattaagggactaaatccaacggccatctttctgacaacccttagccgcactaacaaaaagcggagttggccgctcaatgaagctataatggcagtgggcatggtctctattctggcctccagcttgctgaaaaacgacatccctatgaccggccccttagtggctgggggactcctgacagtatgctacgtgcttactggtagatcggcggacctggagttggaaagggccgcagatgtccgatgggaggaccaagccgagatctcaggctctagtccaattctctccataaccatcagcgaagatgggtctatgagcattaagaatgaggaagaggagcagacgctgacaatcctaattcgcaccggactgcttgttatctccggcctcttccccgtgtcaatacctatcactgctgcagcctggtatctgtgggaagtgaaaaagcagcgggcgggtgtcttgtgggacgtgccaagtccccctccggttgggaaggctgagttagaagatggagcctacagaattaaacagaagggcatcctgggctatagccaaattggggcaggagtatacaaagagggtacatttcataccatgtggcacgtgactaggggcgccgtcctcatgcacaaggggaaacgtatcgaaccatcttgggctgacgtgcgcaaggatctgatatcctacggaggcggttggaaacttgagggggagtggaaagaaggagaggaagttcaggtgctggccttggagcccggcaagaaccctcgggcagtccagacaaaaccaggcctattcaagaccaacacggggactattggagctgtgtcactggactttagtcccggtaccagcggctcccctatcgtagataaaaaggggaaggtcgtgggactctatggcaatggtgttgtgacaagatctgggacctacgtctcggccatcgcgcagacagagaaaagcattgaggacaacccggagatcgaagatgacatattcaggaagaaacgactgactattatggatcttcatcccggagccggcaagaccaaacggtatttaccagcaatcgtgcgcgaggctattaagagaggcctgaggacgctcatcttggcccctacacgggttgtggctgcagaaatggaggaagccctgcgagggctccccataagataccaaactccagccattcgcgctgagcacaccggaagggagatcgtcgacctgatgtgtcatgcgacattcaccatgcgtcttctgtcacctgtgcgggtacccaattataacttgatcattatggacgaagcacactttactgatccagcctccatcgctgccagaggttacattagtaccagggtggagatgggcgaagcagccgggatattcatgacagctacgccgcctggatctcgcgacccctttccacagagcaatgcgcccatcatggatgaggagcgagaaattcctgagagatcctggaactcaggccatgaatgggttactgacttcaagggtaaaaccgtctggtttgtgccatctatcaaggccgggaatgatatcgcagcttgcctacggaaaaacggaaagaaagtgattcagctgagcaggaagacattcgacagtgagtatataaagacccgcactaatgattgggactttgtcgtaacaaccgatatctccgaaatgggcgccaacttcaaagcagagcgtgtgattgaccccagacggtgtatgaagcctgttatcctcacggatggcgaggaaagggtgattttagccgggccgatgccagtcactcacagctctgctgcccaacgccgaggaagaatcggtcggaatcccaaaaacgagaatgaccagtacatatacatgggcgaacctctggagaacgacgaagattgcgcgcactggaaggaggcaaaaatgcttctggacaatatcaacacacccgaggggattatcccatcaatgtttgaacctgagagggaaaaggtggatgccattgacggagagtatcgcctcagaggcgaagctaggaaaaccttcgttgatttgatgcggcgtggtgacctgcccgtgtggctcgcctaccgcgtcgctgcagaggggatcaactatgccgatcgaagatggtgttttgacggcataaagaataaccagattctggaggaaaatgtggaggtagaaatctggaccaaggagggagagaggaagaaacttaaaccacggtggctagatgctcgcatttactccgaccctctggccttgaaggagttcaaagagttcgcagcgggcagaaagagtttaactctgaacctcatcacagaaatggggaggctgccgacctttatgacacagaaggcccggaatgctcttgataacctggccgtgctccatactgcagaggctggaggtcgagcctataatcacgcattgagcgaactgcccgagacgctagagaccctgctccttctgacattattggccactgttaccggcgggatattcctgtttctcatgtcgggaaaaggcatcggtaagatgacactggggatgtgctgcattatcaccgcttctattcttctgtggtacgcgcaaatccagccacattggatagccgcatccattatcctcgagttctttttgatcgtcctgttaattcctgagcccgaaaaacagagaactccacaggacaaccaactaacgtatgtggtgatcgctatactgaccgtcgttgccgccacaatggcaaatgagatgggcttcctcgaaaagactaaaaaggattttggacttggcagcattgctacccagcagcctgagtcaaacatcctggacattgacttgcgccccgccagtgcgtggacactgtacgctgtggccaccactttcatcacaccgatgctcaggcactctatagaaaattccagcgtaaacgtgtcactgacggcaatcgccaatcaggctaccgtccttatggggctcggaaagggttggccactgagtaaaatggatattggcgtgcctttgctggcaatcgggtgttacagccaagttaaccccattactttaacagccgcgctactgctccttgtggctcactatgccatcattggaccaggcctgcaggcaaaggccacccgggaagctcagaaacgtgccgcagctggtatcatgaagaatcccaccgtcgacgggataacagtaattgatttggaccctatcccgtacgatcccaaatttgagaagcagctgggccaagtgatgctcctggttctttgcgtgactcaggtcttaatgatgagaacgacctgggccctgtgtgaagcgctcacattggccactggaccaatctccaccctgtgggagggcaaccctgggaggttctggaatacaaccattgcagtgtctatggctaacatatttcgcggaagctatctagccggcgcaggtctactcttctccatcatgaagaacactacgaatacacggcgagggaccggaaacactggcgaaacccttggtgagaaatggaagaatagactgaactcattgggcaaatctgagtttcagatttacaagaggagtgggatccaagaagtcgaccgcacactggctaaagagggaattaagcggggcgaaactgatcatcacgccgtgtcgagagggagcgccaaactccgttggttcgttgagaggaatctggtgacccccgagggaaaggtagtggacttaggctgcggtcgcgggggatggtcctattactgtggcggtcttaagaacgtccgggaagttaaaggcctgacaaaagggggacctggccatgaggaaccaatccccatgtctacgtatgggtggaatctcgtgcgactacagtcaggagtcgatgtgttctttacccctccagagaaatgcgacactctgttgtgtgatataggcgaaagctcccccaacccgacagtagaggcgggtagaaccctgagggtgctcaatcttgttgagaactggctgaataacaatactcagttctgcatcaaggtgttgaacccttacatgccaagtgtcattgagaagatggagacactgcagcggaagtacgggggagctctcgtgcgcaatcccttatctagaaacagcacccacgaaatgtattgggtctcaaacgcatccggcaatatcgtgagtagcgttaacatgatttctaggatgctgatcaatcgatttacgatgcggcataagaaagccacctacgagcctgacgtagatcttggctccgggacacgtaacataggaattgaatcagagactccaaatctggacatcatcggtaagagaattgagaaaataaagcaagaacacgagaccagctggcactatgaccaggatcatccctacaaaacatgggcttatcacggctcgtacgaaactaagcagaccgggtctgccagttccatggtgaacggagtcgtgcgcctactcacaaagccgtgggacgttatccctatggtgacccagatggcaatgactgatacgacacccttcggccaacagagggtctttaaagagaaggtggacacccggactcaggaaccaaaagagggtaccaagaaactgatgaagattacagccgagtggttgtggaaggaactggggaaaaagaaaacgcctagaatgtgtacccgcgaggagttcgctaggaaggtacgaagcaatgcggccctcggagcaatctttactgatgagaacaaatggaagtcagctcgggaggccgtggaagactccagattctgggagcttgttgataaagaaagggacctgcatttagagggcaagtgcgaaacatgtgtctataatatgatgggcaagcgcgagaaaaagattggggagtttggaaaagcaaagggttctcgtgccatctggtacatgtggctgggcgctcggttcttggaatttgaggccctcgggttcctgaacgaagatcactggtttagcagagagaatagtctatccggagtggaaggcgagggtcttcacaaactggggtacatactcagggaggtgagcaagaaggaaggaggcgcgatgtatgcagacgataccgccggctgggacactcgcatcacactggaggacttgaaaaacgaagagatggtcaccaatcatatggaaggggagcacaagaaactggctgaggccattttcaagctcacataccagaacaaagttgtgcgagtacaacggcccactccaagaggaaccgtgatggatatcatttctaggcgcgaccagagaggttcaggccaggtcgggacgtatggacttaataccttcacaaacatgggcgcacaactgatccggcagatggaaggtgagggggtgtttaagggcattcagcatttaactgctaccgaagaggttgccgtgcaggattggctggctagggtcggccgtgagcgattgagtcgcatggccatatccggcgacgattgcgtggtaaagcccctcgacgatagattcgcaaacgcgctgacagccctaaatgacatggggaaagttcggaaggatatccaacagtgggaacctagcaggggatggtctgactggactcaggtgccattttgctcgcaccatttccacgagcttattatgaaagatggtcgcgtcctggtggtgccgtgtagaaaccaggacgaactcatcggccgggctaggatctcacaaggggccggatggagcctgcgagagaccgcatgcttgggcaagtcctacgctcagatgtggagtttaatgtattttcaccgtagagatctgcgcctcgccgcaaatgccatttgttctgcggtccccagccattgggttcctacgtcccggacaacctggtcaatacacgctaggcatgaatggatgactacagaggacatgcttaccgtgtggaacagagtatggatccaggagaatccatggatggaagacaaaactcccgtggagagttgggaagagattccttacctgggtaagcgcgaagatcagtggtgcgggtctctaatcggactgaccagccgggccacatgggcaaggaacattcaaacggccatcaatcaggtccgatccctcataggctcagaggagtataccgactacatgccaagcatgaagagattccggagggaagaggaagaggctggcgtgttgtggtga

SEQ ID NO: 14307 - RNA, 9876 nt, synthetic construct
  misc_feature 1..9876: note = derived and/or modified CDS sequence (opt3) from DENV-2__KF041235__SS-prME
  source 1..9876: mol_type = other RNA
accgccggcgtgatcattatgctgatacccactgctatggcattccacctcactacgcggaacggggaacctcatatgatcgtcagcaagcaggaaaagggaaagtcccttctgtttaagaccgaagacggtgttaatatgtgcacattgatggccatggatttaggcgaactgtgtgaagacactattacctacaactgcccactgctcaggcaaaatgaaccggaagatatcgactgttggtgcaactctacatcaacctgggtgacttatgggacatgtaccgcgacgggagaacaccggcgcgaaaagcgaagtgttgctctggtgccccatgtcggcatgggtcttgagactcgtaccgaaacatggatgagctccgagggggcctggaaacacgcacagagaattgagacttggatcctgaggcatcctggattcaccataatggccgctatcttggcatacacaattggcaccacgtattttcagcgggtgctcatcttcattctgctgactgccgttgctccatctatgacaatgcgctgcatcggcatatcgaatagagattttgtggaaggggtctcaggaggtagctgggtggacattgtgctcgagcacggcagttgtgttaccactatggccaagaacaagcccacattagatttcgaactgatcaaaaccgaggcgaagcagcctgcaacgcttaggaaatactgcattgaagccaagttgaccaatacaactaccgcttcccggtgtccaacacaaggggagccctctctgaacgaggaacaggacaaacgctttgtgtgcaagcacagcatggtcgatcgaggatggggcaatggttgtgggctattcggaaagggcggcatcgtgacttgcgccatgtttacctgcaaaaagaacatggaggggaaaatcgtgcagcctgaaaatctcgagtatacaattgtcgttaccccacattccggagaagagaacgcagtgggtaatgacactggcaagcacgggaaagagataaaggtaacgccgcagtcaagtatcacagaagctgagctgaccggatacggcactgtgaccatggaatgtagccccagaacaggtcttgatttcaacgagatggtcctgttgcaaatggaaaataaagcctggctcgtgcataggcagtggtttctggacttacctctgccatggctccccggggcggatattcagggctctaactggatccagaaggagacccttgttactttcaagaaccctcacgccaaaaagcaagacgtggtcgtgctgggatcccaggagggcgcaatgcacacagctttgacgggggccaccgaaatacagatgtcaagcggaaatctactgtttactggtcatctcaaatgccggctgcgtatggacaaacttcaactgaaaggcatgagttattctatgtgtacagggaagttcaaggtagttaaagagattgctgaaacccagcacggaacaatcgtggtccgcgtgcagtacgagggcgatggttccccatgcaagatccccttcgagattatggacttggagaagagacatgtcctcgggaggctgatcactgtgaacccgattgttaccgagaaggatagccctgtgaatatagaagccgagcccccatttggcgactcgtacatcattatcggagtagaacctggccagttaaaactgtcttggttcaagaaggggtcctcaatcggacaaatgtttgagacgaccatgcggggtgcaaaacgaatggccattctaggcgatacagcttgggacttcgggagtctcggaggcgtctttactagcataggtaaggcgctgcaccaggtgttcggggcaatctatggcgccgctttttccggagtttcttggaccatgaaaattcttatcggcgtggtcattacatggatcgggatgaacagccgctcaaccagcttgtccgtgagcctggtactcgtgggagttgtcacactgtaccttggcgtgatggtgcaggccgattctggttgtgtcgtttcatggaagaataaagagctgaagtgcgggagtggaatattcatcacggacaacgtgcatacatggaccgaacagtataagtttcaacccgagagcccatccaaattggcatctgccattcagaaggctcacgaagagggcatctgtggtattagatcggtgactaggctcgaaaatctgatgtggaaacagatcacacccgagttaaaccacatactgagcgagaatgaagtaaagctatccattatgaccggcgatatcaaagggattatgcaggccggaaagcggtcactccgccctcaaccaactgagctgaaatacagttggaagacctggggcaaggcaaaaatgctttctacagaaccgcataaccagacgttcttgatcgacgggcccgagaccgcggaatgccctaatactaacagagcttggaatagcctggaggtcgaggattatggatttggcgtgttcacaaccaacatatggctcaagctgaaagaaaggcaggacgtattttgtgactccaagttaatgtcagccgcaatcaaagataatcgtgccgtgcacgctgacatgggttactggattgagagcgccctgaacgatacatggaagatcgaaaaggcatctttcattgaggtcaaatcctgccattggccaaagagtcacactctttggagcaacggggtgttggagtctgaaatgatcatacccaaaaatttcgctggacctgtttcccagcacaactatcggccaggctaccatacccaaacggccggtccctggcacctcggcaagctggagatggactttgatttctgtgaagggacaaccgtggtagtcactgaggactgcggaaatcgaggcccgtcactaagaaccacaactgcgagtgggaaactgattaccgaatggtgctgtaggagctgcacactccctccactgcgctaccggggagaggatggctgttggtatggtatggagatcagaccccttaaggaaaaggaggaaaacttggtaaattcgctggtgacggccgggcatggacagatcgacaacttttccttaggcgtcctcggtatggctctgttccttgaggaaatgctgaggacccgcgttggcactaaacacgcagtgttgctcgtagccgtgtcttttatgacactgattaccgggaatatgagcttccgagatctaggacgggtcatggtgatggttggcgctgccatgactgacgatatcgggatgggagtgacatacctggcactcctggcggcctttaaggtccgtcctaccttcgctgccggccttttgctgagaaaattaacgtcaaaggagctcatgatgactaccattggtatagtgctgcttagtcagtccacaacccccgagactatcctggaactaacagacgcactcgctctggggatgatgattttgaaaatcgttaggaacatggagaagtatcaactggccgtgaccattatggcaatcttatgcgtcccaaatgccgtaatactccagaacgcttggaaggtgtcttgtacaatcctggcggccgttagcgtgtcccctcttctgttgacttcaagccagcagaaagcagattggattcccctcgctctgaccatcaagggactaaatccaacggccatttttctgacaacccttagtcgcactaacaaaaagcggtcttggccgctcaatgaagccatcatggctgtcggcatggtgtccatactggcaagctcgttgctgaaaaacgacattcctatgaccggccccttagtagccgggggactcctgacagtgtgctacgtccttactggtagatcagcggacctggagttggaaagggctgccgatgttcgatgggaggaccaagcagagatctctggcagttccccaatcctcagcattaccatatctgaagatgggagcatgtccatcaagaatgaggaagaggagcagacgctgacaattctaatccgcaccggactgcttgtgatttcaggcctcttccccgtgagtatccctataactgccgctgcatggtatctgtgggaagtcaaaaagcagcgggccggtgtgttgtgggacgttccaagtccccctccggtagggaaggcggagttagaagatggagcttacagaatcaaacagaagggcattctgggctattctcaaatcggggccggagtgtacaaagagggtacatttcataccatgtggcacgtcactaggggcgcagtgctcatgcacaaggggaaacgtattgaaccatcctgggccgacgttcgcaaggatctgatctcatacggaggcggttggaaacttgagggggagtggaaagaaggagaggaagtgcaggtcctggctttggagcccggcaagaaccctcgggccgtgcagacaaaaccaggcctattcaagaccaacacggggactataggagcagtaagtctggactttagccccggtacctccggctctcctattgtcgataaaaaggggaaggtggttggactctatggcaatggtgtggtcacaagatcggggacctacgtgagcgctatcgcccagacagaaaaatcaatcgaggacaacccggagattgaagatgacatcttcaggaagaaacgactgactataatggatcttcatcccggagcgggcaagaccaaacggtatttaccagccattgttcgcgaggcaatcaagagaggcctgaggacgctcattttggctcctacacgggtggtcgccgctgaaatggaggaagcactgcgagggctccccatcagataccaaactccagccatacgcgccgagcacaccggaagggagattgtggacctgatgtgtcatgctacattcaccatgcgtcttctgtcccctgtacgggtgcccaattataacttgatcatcatggacgaagcgcactttactgatccagcaagtattgccgctagaggttacatctctaccagggttgagatgggcgaagccgcagggattttcatgacagccacgccgcctggaagccgcgacccctttccacagtccaatgctcccataatggatgaggagcgagaaatccctgagagatcatggaactctggccatgaatgggtcactgacttcaagggtaaaaccgtgtggtttgtgccaagcattaaggcggggaatgatatcgccgcatgcctacggaaaaacggaaagaaagtcatccagctgagtaggaagacattcgactccgagtatattaagacccgcactaatgattgggactttgtagtgacaaccgatataagcgaaatgggcgctaacttcaaagccgagcgtgttatcgaccccagacggtgtatgaagcctgtgattctcacggatggcgaggaaagggtcatcttagcagggccgatgccagtgactcactcttcagccgctcaacgccgaggaagaattggtcggaatcccaaaaacgagaatgaccagtacatctacatgggcgaacctctggagaacgacgaagattgcgcccactggaaggaggcgaaaatgcttctggacaatataaacacacccgaggggatcattccatccatgtttgaacctgagagggaaaaggttgatgcaatcgacggagagtatcgcctcagaggcgaagccaggaaaaccttcgtggatttgatgcggcgtggtgacctgcccgtctggctcgcttaccgcgtggccgctgaggggattaactatgcagatcgaagatggtgttttgacggcatcaagaataaccagatactggaggaaaatgtagaggtggaaatttggaccaaggagggagagaggaagaaacttaaaccacggtggctagatgcccgcatctacagtgaccctctggctttgaaagagttcaaagagttcgccgcaggcagaaagagcttaactctgaacctcattacagaaatggggaggctgccgacctttatgacacagaaggcgcggaatgcccttgataacctggctgttctccatactgccgaggcaggaggtcgagcttataatcacgccttgtcggaactgcccgagacgctagagaccctgctccttctgacattattggcaactgtcaccggcgggatcttcctgtttctcatgtctggaaaaggcataggtaagatgacactggggatgtgctgcatcattaccgcctccatccttctgtggtacgctcaaattcagccacattggatcgcggccagcataattctcgagttctttttgatcgtgctgttaatccctgagcccgaaaaacagagaactccacaggacaaccaactaacgtatgtggtcattgcaatcctgaccgttgtggctgccacaatggccaatgagatgggcttcctcgaaaagactaaaaaggattttggacttggctcaatagcaacccagcagcctgagagtaacattctggacatcgacttgcgccccgcttctgcctggacactgtacgcggtagctaccactttcattacaccgatgctcaggcactccatcgagaatagctcagtgaacgtcagtctgacggccatagcaaatcaggccaccgtgcttatggggctcggaaagggttggccactgagcaaaatggatatcggcgttcctttgctggctattgggtgttactcccaagtgaaccccatcactttaacagcagccctactgctccttgtcgcgcactatgctattatcggaccaggcctgcaggccaaggcaacccgggaagcccagaaacgtgctgccgcaggtattatgaagaatcccaccgtagacgggatcacagtgatagatttggaccctattccgtacgatcccaaatttgagaagcagctgggccaagttatgctcctggtgctttgcgtcactcaggtgttaatgatgagaacgacctgggctctgtgtgaagccctcacattggcgactggaccaatctctaccctgtgggagggcaaccctgggaggttctggaatacaaccatcgccgtcagcatggcaaacatttttcgcggatcctatctagctggcgccggtctactcttctcaataatgaagaacactacgaatacacggcgagggaccggaaacactggcgaaacccttggtgagaaatggaagaatagactgaactctttgggcaaaagtgagtttcagatctacaagaggtcggggattcaagaagtggaccgcacactggcaaaagagggaatcaagcggggcgaaactgatcatcacgctgttagcagagggtccgccaaactccgttggttcgtggagaggaatctggtaacccccgagggaaaggtggtcgacttaggctgcggtagagggggatggtcttattactgtggcggtcttaagaacgttcgcgaagtgaaaggcctgacaaaagggggacctggccatgaggaaccaattcccatgtcaacgtatgggtggaatctcgtccgactacagagcggagtggatgtattctttacccctccagagaaatgcgacactctgttgtgtgatatcggcgaatccagtcccaacccgacagtggaggccggtagaaccctgagggttctcaatcttgtggagaactggctgaataacaatactcagttctgcataaaggtcttgaacccttacatgccatctgtgatcgagaagatggagacactgcagcggaagtacgggggagcgctcgtccgcaatcccttaagcagaaactcaacccacgaaatgtattgggtgtccaacgctagtggcaatattgttagctctgtaaacatgatctccaggatgctgattaatcgatttacgatgcggcataagaaagcaacctacgagcctgacgtggatcttggctcagggacacgtaacatcggaatagaaagcgagactccaaatctggacattatcggtaagagaatcgagaaaattaagcaagaacacgagacctcgtggcactatgaccaggatcatccctacaaaacatgggcctatcacggctcttacgaaactaagcagaccgggagtgcttccagcatggtcaacggagtggttcgcctactcacaaagccgtgggacgtgatacctatggtcacccagatggccatgactgatacgacacccttcggccaacagagggtgtttaaagagaaggtagacacccggactcaggaaccaaaagagggtaccaagaaactgatgaagatcacagcagagtggttgtggaaggaactggggaaaaagaaaacgcctagaatgtgtacccgcgaggagttcgccaggaaggtgcgatcaaatgctgcgctcggagccatttttactgatgagaacaaatggaagtccgcacgggaggctgttgaagactctagattctgggagcttgtcgataaagaaaggaatctgcatttagagggcaagtgcgaaacatgtgtgtataacatgatgggcaagcgcgagaaaaagatcggggagtttggaaaagccaagggtagccgtgcaatttggtacatgtggctgggcgcccggttcttggaatttgaggctctcgggttcctgaatgaagaccactggtttagtagagagaactccctaagcggagtggaaggcgagggtcttcacaaactggggtacatcctcagggaggtctctaagaaggaaggaggcgccatgtatgcggatgacaccgcaggctgggatactcgcataacactggaggacttgaaaaatgaagagatggttaccaaccatatggaaggggagcacaagaaactggccgaggctatcttcaagctcacataccagaataaagtggtacgagtgcaacggcccactccaagaggaaccgtcatggacattatctcaaggcgcgatcagagaggtagtggccaggtggggacgtatggacttaacaccttcacaaacatgggcgcccaactgattcggcagatggaaggtgagggggtttttaagggaatccagcatttaactgcaaccgaagaggtggctgtccaggactggctggccagggtgggccgtgagcgattgtcccgcatggctattagcggcgatgactgcgtagttaagcccctcgatgacagattcgcctctgcactgacagcgctaaatgatatggggaaagtgcggaaggacatacaacagtgggaaccttcgaggggatggaacgattggactcaggtcccattttgctcacaccatttccacgagcttatcatgaaagacggtcgcgtgctggtggtcccgtgtagaaatcaggatgaactcattggccgggccaggatcagccaaggggctggatggtccctgcgagagaccgcctgcttgggcaagagttacgcacagatgtggtctttaatgtattttcaccgtagagacctgcgcctcgctgccaacgcaatctgtagcgccgttccctcccattgggtgcctacgtcacggacaacctggagtattcacgcgaggcatgaatggatgactacagaggatatgcttaccgtatggaatagagtgtggatacaggagaacccatggatggaagacaaaactcccgtcgagtcttgggaagagatcccttacctgggtaagcgcgaagaccagtggtgcgggagcctaattggactgacctcccgggctacatgggccaggaatatccaaacggcaattaaccaggtgcgatcactcatcggcagcgaggagtataccgattacatgccatctatgaagagattccggagggaagaggaagaggccggcgttttgtggtga

SEQ ID NO: 14308 - RNA, 9876 nt, synthetic construct
  misc_feature 1..9876: note = derived and/or modified CDS sequence (opt3) from DENV-2__KF041237__SS-prME
  source 1..9876: mol_type = other RNA
accgccggcgtgatcattatgctgatacccactgctatggcattccacctcactacgcggaacggggaacctcatatgatcgtcagcaagcaggaaaagggaaagtcccttctgtttaagaccgaagacggtgttaatatgtgcacattgatggccatggatttaggcgaactgtgtgaagacactattacctacaactgcccactgctcaggcaaaatgaaccggaagatatcgactgttggtgcaactctacatcaacctgggtgacttatgggacatgtaccgcgacgggagaacaccggcgcgaaaagcgaagtgttgctctggtgccccatgtcggcatgggtcttgagactcgtaccgaaacatggatgagctccgagggggcctggaaacacgcacagagaattgagacttggatcctgaggcatcctggattcaccataatggccgctatcttggcatacacaattggcaccacgtattttcagcgggtgctcatcttcattctgctgactgccgttgctccatctatgacaatgcgctgcatcggcatatcgaatagagattttgtggaaggggtctcaggaggtagctgggtggacattgtgctcgagcacggcagttgtgttaccactatggccaagaacaagcccacattagatttcgaactgatcaaaaccgaggcgaagcagcctgcaacgcttaggaaatactgcattgaagccaagttgaccaatacaactaccgcttcccggtgtccaacacaaggggagccctctctgaacgaggaacaggacaaacgctttgtgtgcaagcacagcatggtcgatcgaggatggggcaatggttgtgggctattcggaaagggcggcatcgtgacttgcgccatgtttacctgcaaaaagaacatggaggggaaaatcgtgcagcctgaaaatctcgagtatacaattgtcgttaccccacattccggagaagagaacgcagtgggtaatgacactggcaagcacgggaaagagataaaggtaacgccgcagtcaagtatcacagaagctgagctgaccggatacggcactgtgaccatggaatgtagccccagaacaggtcttgatttcaacgagatggtcctgttgcaaatggaaaataaagcctggctcgtgcataggcagtggtttctggacttacctctgccatggctccccggggcggatattcagggctctaactggatccagaaggagacccttgttactttcaagaaccctcacgccaaaaagcaagacgtggtcgtgctgggatcccaggagggcgcaatgcacacagctttgacgggggccaccgaaatacagatgtcaagcggaaatctactgtttactggtcatctcaaatgccggctgcgtatggacaaacttcaactgaaaggcatgagttattctatgtgtacagggaagttcaaggtagttaaagagattgctgaaacccagcacggaacaatcgtggtccgcgtgcagtacgagggcgatggttccccatgcaagatccccttcgagattatggacttggagaagagacatgtcctcgggaggctgatcactgtgaacccgattgttaccgagaaggatagccctgtgaatatagaagccgagcccccatttggcgactcgtacatcattatcggagtagaacctggccagttaaaactgtcttggttcaagaaggggtcctcaatcggacaaatgtttgagacgaccatgcggggtgcaaaacgaatggccattctaggcgatacagcttgggacttcgggagtctcggaggcgtctttactagcataggtaaggcgctgcaccaggtgttcggggcaatctatggcgccgctttttccggagtttcttggaccatgaaaattcttatcggcgtggtcattacatggatcgggatgaacagccgctcaaccagcttgtccgtgagcctggtactcgtgggagttgtcacactgtaccttggcgtgatggtgcaggccgattctggttgtgtcgtttcatggaagaataaagagctgaagtgcgggagtggaatattcatcacggacaacgtgcatacatggaccgaacagtataagtttcaacccgagagcccatccaaattggcatctgccattcagaaggctcacgaagagggcatctgtggtattagatcggtgactaggctcgaaaatctgatgtggaaacagatcacacccgagttaaaccacatactgagcgagaatgaagtaaagctatccattatgaccggcgatatcaaagggattatgcaggccggaaagcggtcactccgccctcaaccaactgagctgaaatacagttggaagacctggggcaaggcaaaaatgctttctacagaaccgcataaccagacgttcttgatcgacgggcccgagaccgcggaatgccctaatactaacagagcttggaatagcctggaggtcgaggattatggatttggcgtgttcacaaccaacatatggctcaagctgaaagaaaggcaggacgtattttgtgactccaagttaatgtcagccgcaatcaaagataatcgtgccgtgcacgctgacatgggttactggattgagagcgccctgaacgatacatggaagatcgaaaaggcatctttcattgaggtcaaatcctgccattggccaaagagtcacactctttggagcaacggggtgttggagtctgaaatgatcatacccaaaaatttcgctggacctgtttcccagcacaactatcggccaggctaccatacccaaacggccggtccctggcacctcggcaagctggagatggactttgatttctgtgaagggacaaccgtggtagtcactgaggactgcggaaatcgaggcccgtcactaagaaccacaactgcgagtgggaaactgattaccgaatggtgctgtaggagctgcacactccctccactgcgctaccggggagaggatggctgttggtatggtatggagatcagaccccttaaggaaaaggaggaaaacttggtaaattcgctggtgacggccgggcatggacagatcgacaacttttccttaggcgtcctcggtatggctctgttccttgaggaaatgctgaggacccgcgttggcactaaacacgcagtgttgctcgtagccgtgtcttttatgacactgattaccgggaatatgagcttccgagatctaggacgggtcatggtgatggttggcgctgccatgactgacgatatcgggatgggagtgacatacctggcactcctggcggcctttaaggtccgtcctaccttcgctgccggccttttgctgagaaaattaacgtcaaaggagctcatgatgactaccattggtatagtgctgcttagtcagtccacaacccccgagactatcctggaactaacagacgcactcgctctggggatgatgattttgaaaatcgttaggaacatggagaagtatcaactggccgtgaccattatggcaatcttatgcgtcccaaatgccgtaatactccagaacgcttggaaggtgtcttgtacaatcctggcggccgttagcgtgtcccctcttctgttgacttcaagccagcagaaagcagattggattcccctcgctctgaccatcaagggactaaatccaacggccatttttctgacaacccttagtcgcactaacaaaaagcggtcttggccgctcaatgaagccatcatggctgtcggcatggtgtccatactggcaagctcgttgctgaaaaacgacattcctatgaccggccccttagtagccgggggactcctgacagtgtgctacgtccttactggtagatcagcggacctggagttggaaagggctgccgatgttcgatgggaggaccaagcagagatctctggcagttccccaatcctcagcattaccatatctgaagatgggagcatgtccatcaagaatgaggaagaggagcagacgctgacaattctaatccgcaccggactgcttgtgatttcaggcctcttccccgtgagtatccctataactgccgctgcatggtatctgtgggaagtcaaaaagcagcgggccggtgtgttgtgggacgttccaagtccccctccggtagggaaggcggagttagaagatggagcttacagaatcaaacagaagggcattctgggctattctcaaatcggggccggagtgtacaaagagggtacatttcataccatgtggcacgtcactaggggcgcagtgctcatgcacaaggggaaacgtattgaaccatcctgggccgacgttcgcaaggatctgatctcatacggaggcggttggaaacttgagggggagtggaaagaaggagaggaagtgcaggtcctggctttggagcccggcaagaaccctcgggccgtgcagacaaaaccaggcctattcaagaccaacacggggactataggagcagtaagtctggactttagccccggtacctccggctctcctattgtcgataaaaaggggaaggtggttggactctatggcaatggtgtggtcacaagatcggggacctacgtgagcgctatcgcccagacagaaaaatcaatcgaggacaacccggagattgaagatgacatcttcaggaagaaacgactgactataatggatcttcatcccggagcgggcaagaccaaacggtatttaccagccattgttcgcgaggcaatcaagagaggcctgaggacgctcattttggctcctacacgggtggtcgccgctgaaatggaggaagcactgcgagggctccccatcagataccaaactccagccatacgcgccgagcacaccggaagggagattgtggacctgatgtgtcatgctacattcaccatgcgtcttctgtcccctgtacgggtgcccaattataacttgatcatcatggacgaagcgcactttactgatccagcaagtattgccgctagaggttacatctctaccagggttgagatgggcgaagccgcagggattttcatgacagccacgccgcctggaagccgcgacccctttccacagtccaatgctcccataatggatgaggagcgagaaatccctgagagatcatggaactctggccatgaatgggtcactgacttcaagggtaaaaccgtgtggtttgtgccaagcattaaggcggggaatgatatcgccgcatgcctacggaaaaacggaaagaaagtcatccagctgagtaggaagacattcgactccgagtatattaagacccgcactaatgattgggactttgtagtgacaaccgatataagcgaaatgggcgctaacttcaaagccgagcgtgttatcgaccccagacggtgtatgaagcctgtgattctcacggatggcgaggaaagggtcatcttagcagggccgatgccagtgactcactcttcagccgctcaacgccgaggaagaattggtcggaatcccaaaaacgagaatgaccagtacatctacatgggcgaacctctggagaacgacgaagattgcgcccactggaaggaggcgaaaatgcttctggacaatataaacacacccgaggggatcattccatccatgtttgaacctgagagggaaaaggttgatgcaatcgacggagagtatcgcctcagaggcgaagccaggaaaaccttcgtggatttgatgcggcgtggtgacctgcccgtctggctcgcttaccgcgtggccgctgaggggattaactatgcagatcgaagatggtgttttgacggcatcaagaataaccagatactggaggaaaatgtagaggtggaaatttggaccaaggagggagagaggaagaaacttaaaccacggtggctagatgcccgcatctacagtgaccctctggctttgaaagagttcaaagagttcgccgcaggcagaaagagcttaactctgaacctcattacagaaatggggaggctgccgacctttatgacacagaaggcgcggaatgcccttgataacctggctgttctccatactgccgaggcaggaggtcgagcttataatcacgccttgtcggaactgcccgagacgctagagaccctgctccttctgacattattggcaactgtcaccggcgggatcttcctgtttctcatgtctggaaaaggcataggtaagatgacactggggatgtgctgcatcattaccgcctccatccttctgtggtacgctcaaattcagccacattggatcgcggccagcataattctcgagttctttttgatcgtgctgttaatccctgagcccgaaaaacagagaactccacaggacaaccaactaacgtatgtggtcattgcaatcctgaccgttgtggctgccacaatggccaatgagatgggcttcctcgaaaagactaaaaaggattttggacttggctcaatagcaacccagcagcctgagagtaacattctggacatcgacttgcgccccgcttctgcctggacactgtacgcggtagctaccactttcattacaccgatgctcaggcactccatcgagaatagctcagtgaacgtcagtctgacggccatagcaaatcaggccaccgtgcttatggggctcggaaagggttggccactgagcaaaatggatatcggcgttcctttgctggctattgggtgttactcccaagtgaaccccatcactttaacagcagccctactgctccttgtcgcgcactatgctattatcggaccaggcctgcaggccaaggcaacccgggaagcccagaaacgtgctgccgcaggtattatgaagaatcccaccgtagacgggatcacagtgatagatttggaccctattccgtacgatcccaaatttgagaagcagctgggccaagttatgctcctggtgctttgcgtcactcaggtgttaatgatgagaacgacctgggctctgtgtgaagccctcacattggcgactggaccaatctctaccctgtgggagggcaaccctgggaggttctggaatacaaccatcgccgtcagcatggcaaacatttttcgcggatcctatctagctggcgccggtctactcttctcaataatgaagaacactacgaatacacggcgagggaccggaaacactggcgaaacccttggtgagaaatggaagaatagactgaactctttgggcaaaagtgagtttcagatctacaagaggtcggggattcaagaagtggaccgcacactggcaaaagagggaatcaagcggggcgaaactgatcatcacgctgttagcagagggtccgccaaactccgttggttcgtggagaggaatctggtaacccccgagggaaaggtggtcgacttaggctgcggtagagggggatggtcttattactgtggcggtcttaagaacgttcgcgaagtgaaaggcctgacaaaagggggacctggccatgaggaaccaattcccatgtcaacgtatgggtggaatctcgtccgactacagagcggagtggatgtattctttacccctccagagaaatgcgacactctgttgtgtgatatcggcgaatccagtcccaacccgacagtggaggccggtagaaccctgagggttctcaatcttgtggagaactggctgaataacaatactcagttctgcataaaggtcttgaacccttacatgccatctgtgatcgagaagatggagacactgcagcggaagtacgggggagcgctcgtccgcaatcccttaagcagaaactcaacccacgaaatgtattgggtgtccaacgctagtggcaatattgttagctctgtaaacatgatctccaggatgctgattaatcgatttacgatgcggcataagaaagcaacctacgagcctgacgtggatcttggctcagggacacgtaacatcggaatagaaagcgagactccaaatctggacattatcggtaagagaatcgagaaaattaagcaagaacacgagacctcgtggcactatgaccaggatcatccctacaaaacatgggcctatcacggctcttacgaaactaagcagaccgggagtgcttccagcatggtcaacggagtggttcgcctactcacaaagccgtgggacgtgatacctatggtcacccagatggccatgactgatacgacacccttcggccaacagagggtgtttaaagagaaggtagacacccggactcaggaaccaaaagagggtaccaagaaactgatgaagatcacagcagagtggttgtggaaggaactggggaaaaagaaaacgcctagaatgtgtacccgcgaggagttcgccaggaaggtgcgatcaaatgctgcgctcggagccatttttactgatgagaacaaatggaagtccgcacgggaggctgttgaagactctagattctgggagcttgtcgataaagaaaggaatctgcatttagagggcaagtgcgaaacatgtgtgtataacatgatgggcaagcgcgagaaaaagatcggggagtttggaaaagccaagggtagccgtgcaatttggtacatgtggctgggcgcccggttcttggaatttgaggctctcgggttcctgaatgaagaccactggtttagtagagagaactccctaagcggagtggaaggcgagggtcttcacaaactggggtacatcctcagggaggtctctaagaaggaaggaggcgccatgtatgcggatgacaccgcaggctgggatactcgcataacactggaggacttgaaaaatgaagagatggttaccaaccatatggaaggggagcacaagaaactggccgaggctatcttcaagctcacataccagaataaagtggtacgagtgcaacggcccactccaagaggaaccgtcatggacattatctcaaggcgcgatcagagaggtagtggccaggtggggacgtatggacttaacaccttcacaaacatgggcgcccaactgattcggcagatggaaggtgagggggtttttaagggaatccagcatttaactgcaaccgaagaggtggctgtccaggactggctggccagggtgggccgtgagcgattgtcccgcatggctattagcggcgatgactgcgtagttaagcccctcgatgacagattcgcctctgcactgacagcgctaaatgatatggggaaagtgcggaaggacatacaacagtgggaaccttcgaggggatggaacgattggactcaggtcccattttgctcacaccatttccacgagcttatcatgaaagacggtcgcgtgctggtggtcccgtgtagaaatcaggatgaactcattggccgggccaggatcagccaaggggctggatggtccctgcgagagaccgcctgcttgggcaagagttacgcacagatgtggtctttaatgtattttcaccgtagagacctgcgcctcgctgccaacgcaatctgtagcgccgttccctcccattgggtgcctacgtcacggacaacctggagtattcacgcgggtcatgaatggatgactacagaggatatgcttaccgtatggaatagggtgtggatacaggagaacccatggatggaagacaaaactcccgtcgagtcttgggaagagatcccttacctggggaagagagaagaccagtggtgcggaagcctaattggcctgacctcccgcgctacatgggcccggaatatccaaacggcaattaaccaggtgaggtcactcatcggcagcgaggagtataccgattacatgccatctatgaagcgattcagacgggaagaggaagaggccggggttttgtggtga

SEQ ID NO: 14309 - RNA, 9876 nt, synthetic construct
  misc_feature 1..9876: note = derived and/or modified CDS sequence (opt3) from DENV-2__KM217156__SS-prME
  source 1..9876: mol_type = other RNA
accgcaggcgtgatcattatgctgatacccactgctatggcattccacctcactacgagaaatggggaacctcatatgatcgtcagcaagcaggaaaaaggaaagtcccttctgtttaaaaccgaagacggtgttaatatgtgcaccttgatggccatggatttaggcgaactgtgtgaagacactattacctacaactgcccactactcaggcaaaatgaaccggaagatatcgactgttggtgcaacgcgacatctacctgggtgacttatgggacatgtaccgctacgggagaacaccggcgcgaaaagcgatcagtagccctggtgccccatgtcggcatgggtcttgagactcgtaccgaaacatggatgagtagcgagggggcatggaaacacgcccagagaattgagacttggatcctgaggcatcctggattcaccataatggctgcaatcttggcctacacaattggcaccacgtattttcagcgggtgctcatcttcattctgctgactgctgttgccccatccatgacaatgcgctgcatcggcatatctaatagagattttgtggaaggggtctcgggaggttcatgggtggacattgtactcgagcacggcagctgtgttaccactatggcgaagaacaagcccacattagatttcgaactgatcaaaaccgaggcaaagcagcctgccacgcttaggaaatactgcattgaagctaagttgaccaatacaactaccgccagtcggtgtccaacacaaggggagccctccctgaacgaggaacaggacaaacgctttgtgtgcaagcactctatggtcgatcgaggatggggcaatggttgtgggctattcggaaagggcggcatcgtgacttgcgcaatgtttacctgcaaaaagaacatggaggggaaaatcgtgcagcctgaaaatctcgagtatacaattgtcgttaccccacatagcggagaagagaacgctgtgggtaatgacactggcaagcacgggaaagagataaaggtaacgccgcagtcctcaatcacagaagccgagctgaccggatacggcactgtgaccatggaatgtagtcccagaacaggtcttgatttcaacgagatggtcctgttgcaaatggaaaataaagcgtggctcgtgcataggcagtggtttctggacttacctctgccatggctccccggggccgatattcagggcagcaactggatccagaaggagacccttgttactttcaagaaccctcacgccaaaaagcaagacgtggtcgtgctgggatctcaggagggcgctatgcacacagccttgacgggggctaccgaaatacagatgtcctcaggaaatccactatttactggtcatctgaaatgccggctccgtatggacaagctgcaacttaaaggcatgagctatagtatgtgtacagggaagttcaaggtagttaaagagattgccgaaacccagcacggaacaatcgtggtccgcatccagtacgagggcgatggttctccctgcaagattccgttcgagatcatggacctggagaaaagacatgtgttggggaggctcattactgtcaaccctatagtgaccgagaaggattcccccgttaatatcgaagcagagccaccttttggcgacagctacattatcatcggagtggaacccggccagctgaaattatcgtggttcaagaaggggtcttccattggacaaatgtttgagacgaccatgcggggtgccaaacgaatggctatactgggcgatacagcgtgggacttcgggtcactaggaggcgtatttacaagtatcggtaaggcactccaccaggtcttcggggccatttatggcgctgcctttagcggagtgtcctggaccatgaaaatcctgattggcgttgtgatcacatggatagggatgaactctcgcagcacttcacttagtgtctccttggtgctggtaggagtggttaccctctacctgggcgtcatggtgcaggcagatagcggttgtgtggtctcttggaagaataaagagcttaagtgcgggtcaggaatcttctttacggacaacgttcatacatggaccgaacagtataagttccaaccagagagtcccagcaaactggcctccgctattcagaaggcccacgaagagggcatctgtggtattagatctatcactaggttggataatctcatgtggaaacagataacacctgaactgaaccacattttatcggagaatgaggtgaagctgagcatcatgaccggcgacattaaagggatcatgcaggcaggaaagcggtccctacgcccacaaccgactgaactcaaatactcatggaagacctggggcaaggcgaaaatgctgagtacagagccccataaccagacgtttcttatagatgggcctgaaaccgctcagtgcccaaatactaacagagcctggaactctttggaggtggaagactatggattcggcgtatttacaaccaacatctggctgaagctcaaagagaggcaggacgtcttctgtgatagcaagctgatgtccgcagccattaaagacaatcgtgctgtgcacgccgatatgggttactggatcgagtcagcattaaacgacacatggaagattgaaaaggctagcttcatcgaggttaaatcttgccattggcccaagtcccacactctgtggagtaacggggtgcttgaaagcgagatgataattcctaaaaattttgccggaccagtctctcaacacaactatcggcccggctaccatacccagacggcgggtccgtggcacttgggcaagctcgagatggatttcgacttttgtgaagggacaaccgtggttgtgactgaggattgcggaaatcgaggcccttccctgagaaccacaactgcctcagggaaactaatcaccgaatggtgctgtaggagttgcacactgccacccctccgctaccggggagaggacggctgttggtatggtatggaaatcagacctctgaaggagaaggaggaaaaccttgtaaatagcttggtcacggctgggcatggacagattgataacttctcgctgggcgtgttaggtatggcactctttctggaggaaatgcttaggacccgcgtgggcactaaacacgccgtcctgttggttgctgtgtccttcatgacactcatcaccgggaatatgtcttttcgagacctgggacgggtaatggtgatggtcggcgccgcaatgactgatgacattgggatgggagtgacatacctagcgctgctcgccgctttcaaggttcgtcccacctttgccgcaggcctgcttttgagaaaactgacgagcaaggagttaatgatgactaccataggtatcgtgctcctgtcacaaagtacaaccccagaaactattcttgagctgacagatgctctagccctcgggatgatgatcctgaaaattgtcaggaacatggagaagtatcagttggcagtgaccatcatggccatactgtgcgttcctaatgctgtgatcttacagaacgcgtggaaggtctcctgtacaattctcgccgcagtatctgtgagccccctgcttctgacttcctcacagcaaaaagctgactggatcccattggccctcaccattaagggactgaatccgacggccatcttcctaacaaccctgagccgcactaacaaaaagcggagttggcctcttaatgaagctataatggcagttggcatggtgtctattctcgcctccagcctgttgaaaaacgacatccccatgaccggcccactggtcgctgggggattactcacagtgtgctacgtactgactggtagatcggcggatcttgagctggaaagggccgcagacgtgcgatgggaggatcaggccgaaatctcaggctctagtcccattttgtccataaccatcagcgaggacgggtctatgagcattaagaatgaggaagaggaacagacgctcacaatcctgattcgcaccggactactggtcatctccggcctttttcctgtttcaataccaatcactgctgcagcctggtatctctgggaggtgaaaaagcagcgggcgggtgtgctgtgggatgtccccagtcctccgccagtggggaaggctgagttggaagacggagcctacagaattaaacaaaagggcatcttaggctatagccagattggggcaggagtttacaaagagggtacattccataccatgtggcacgtaactaggggcgccgtgctgatgcacaaggggaaacgtatcgaaccctcttgggctgatgtccgcaaggacctcatatcctacggaggcggttggaagctggagggggaatggaaagagggagaggaagtgcaggttcttgccctggagcctggcaagaacccacgggcagtgcagacaaaacccggcttgtttaagaccaacacggggactattggagctgtctcactagatttcagtcctggtaccagcggctccccgatcgtggacaaaaaggggaaggtagtcggactgtatggcaatggtgtggttacaagatctgggacctacgtgtcggccatcgcgcaaacagagaaaagcattgaggataaccccgaaatcgaggacgatatattcaggaagaaacgactcactattatggacctgcatccaggagccggcaagaccaaacggtatcttcctgcaatcgtccgcgaggctattaagagaggcttaaggacgctgatcctcgcccccacacgggtggttgctgcagaaatggaggaagccttgcgagggctgccaataagataccagactcctgccattcgcgctgagcacaccggaagggaaatcgtggacctcatgtgtcatgcgacatttaccatgcgtctgctttcacccgtccgggtgccaaattataacctgatcattatggatgaggcacacttcactgacccggcctccatcgctgccagaggttacattagtaccagggtagagatgggcgaagcagccgggatatttatgacagctacgcctcccggatctcgcgatccattcccccagagcaatgcgcctatcatggacgaggaacgagagattccagagagatcctggaactcaggccatgaatgggtgactgattttaagggtaaaaccgtttggttcgtcccctctatcaaggccgggaatgacatcgcagcttgcttgcggaaaaacggaaagaaagtgattcaactaagcaggaagacatttgatagtgagtatataaagacccgcactaatgactgggatttcgtggtcacaaccgacatctccgaaatgggcgccaactttaaagcagagcgtgtaattgatcctagacggtgtatgaagccggtgatcctgacggacggcgaagagagggttattctcgccgggccaatgcccgtgactcacagctctgctgcccagcgccgaggaagaatcggtcggaatcctaaaaacgagaatgaccagtacatatacatgggcgaacccttagagaacgatgaagactgcgcgcactggaaggaggcaaaaatgctgcttgataatatcaacacaccagaagggattatcccttcaatgttcgagcccgagagggaaaaggtcgacgccattgatggagagtatcgcctgagaggcgaagctaggaaaacctttgtggacctcatgcggcgtggtgatttgccagtttggctggcctaccgcgtggctgcagaggggatcaactatgccgaccgaagatggtgtttcgatggcataaagaataaccagattctcgaagagaatgtcgaggtggaaatctggaccaaggagggagaaaggaaaaagctgaaacctcggtggcttgacgctcgcatttactccgatccgctagccctgaaggagttcaaagagtttgcagcggccagaaagagtttgactttaaacctgatcacagaaatgggcaggctccccaccttcatgacacaaaaggctcggaatgccctggacaaccttgcagtactgcatactgctgaggccgggggacgagcatataatcacgccctcagcgaattgccagagacgctggaaaccctactgctccttacactgttagctactgtgaccggtggcatatttttgttcctgatgtcggggaaaggaatcggcaagatgacactcggtatgtgctgcattatcaccgcgtctattctgctttggtacgcccagatccagcctcattggatagcagcttccattatcctggagtttttcctcatcgttttgctgattcccgagccagaaaaacagagaactcctcaagataaccagttaacgtatgtcgtgatcgccatactaaccgtggtcgccgcaacaatggctaatgagatggggtttctggaaaagactaaaaaggacttcggcctcggaagcattgccacccagcagcccgagtcaaacatccttgacattgatctgcgcccggcgagtgcttggacattgtacgccgttgcaaccacttttatcacaccaatgctgaggcactctatagaaaattccagcgtgaacgtatcactcacggccatcgctaatcaagcaaccgtgctgatgggccttgggaagggatggcctctcagtaaaatggacattggtgtccccctgttggccatcggctgttacagccaggtgaacccaattactctgacagcggctttactactgctcgttgcccactatgcaatcattgggcccggacttcaggccaaggcttcccgggaggcccagaaacgtgcagctgccggcatcatgaagaatcctaccgtggatggtataaccgtcattgacctggatccgatcccctacgacccaaaattcgagaagcaattggggcaggtaatgctgctcatcctgtgcgtgacacaggttcttatgatgagaactacgtgggcgttatgtgaagccctgaccctcgcaacaggccctatttctactttgtgggagggaaaccccggcaggttttggaataccacaatagctgtgagcatggccaacatcttccgcgggtcctatctggcaggagctggcctactgttttcaattatgaagaacaccactaatacgcggcgaggtacagggaacaccggagaaactctcggcgagaaatggaagaatagagtctctcttctgggtaaaagtgagttccaaatctacaagaggtcgggcattcaggaggtggatcgcaccttggccaaagaggggatcaagcggggagaaacagaccatcacgccgtcagcagaggctccgcgaaactgcgttggttcgtggagaggaacctcgttactcctgaagggaaggtggtagatctgggatgcggccggggtgggtggtcttattactgtggaggcttaaagaatgtgcgcgaggtcaaaggtcttaccaagggcgggccaggacatgaggaacccatacctatgtcaacatatggctggaacctggttcgactcctaacgggggctgacgtgtttttcaccccacccgagaaatgcgatactctgttgtgtgacatcggagaaagctccccgaatcctacagtcgaggcaggcagaaccctgagggtgctcaaccttgtagaaaattggctgaacaataacactcagttttgcattaaggtgttgaatccatacatgcccagtgttatcgagaaaatggagacactgcagcggaagtacggtggggccctcgtgcgcaaccctttatctagaaatagcacccacgaaatgtattgggtctcaaacgcttccggaaacattgtgagtagcgtcaatatgatctctaggatgctgataaaccgattcacgatgcggcataagaaagccacctacgatccagacgtggaccttggctccggcacacgtaatattgggatcgagtcagaaactcccaacctggatatcattggaaagagaatagagaaaatcaagcaagaacacgagaccagccgccactatgaccaggatcatccgtacaaaacatgggcatatcacggttcgtacgagactaagcagaccggctctgccagttccacagttaatggggtagtgaggctactcaccaagccttgggacgtcattcccatggtgactcagatggctatgacggatacaaccccatttggacaacagcgggttttcaaagaaaaggtggacactagaacccaggagcctaaagaaggcacaaagaaactgatgaagatcacggcggagtggttgtggaaggaactgggtaaaaagaaaacaccccgcatgtgtactagggaggagtttgcccgaaaggtccggagcaacgcagctctcggggccattttcacagatgaaaataaatggaagtcagcaagagaggccgtggaagactccaggttttgggagcttgtagataaagagcgcaacctgcatttagaaggaaagtgcgagacctgtgtgtataatatgatgggcaagcgtgagaaaaagatcggcgagttcgggaaagctaagggatctcgggccatatggtacatgtggctgggtgcgagatttttggagttcgaggcactcggctttctgaacgaggaccactggttcagcagggaaaatagtctatccggggttgagggagaaggccttcacaaactgggttacatcctccgcgaggtcagcaagaaggaagggggagccatgtatgctgatgacactgccggctgggacacacgaattaccctggaggatttgaaaaacgaggaaatggtgacaaatcatatggagggcgaacacaagaaactggcagaggctatcttcaagctcacttaccagaacaaagtggtccgggttcaaagaccaacccccagggggacggtgatggacattatctctcgcagagatcagcggggatcagtacaggtgggtacctatggccttgggacatttactaatatgggagcccaactgattaggcagatggaaggcgagggtgtcttcaaggggatacagcatttaaccgctacagaggaagtggccgttcaggactggctggcacgtgtgggacgagagcgcttgagtagaatggcgatctccggcgatgactgcgtcgtgaagcctctcgatgaccggtttgccagcgctctgactgccctaaacgatatgggcaaagtaaggaaggacattcaacagtgggaaccatctcgcgggtggaacgattggacccaggttccgttctgctcgcaccattttcacgagcttatcatgaaagacggaagagtgctggtcgtggcatgtcggaatcaggatgagctcatcggtagggctcgaatttcacaaggcgccgggtggagcctgcgtgaaacggcatgcttgggaaagtcctacgcccagatgtggagtttaatgtatttccacagacgcgacctgcggctcgcggctaacgccatatgttctgcagtgcccagccattgggtccctacatccaggaccacttggtcaatccacgccggccatgagtggatgacaaccgaagacatgcttactgtttggaatagagtgtggattcaggagaacccatggatggaagataaaacccccgtagagagttgggaggaaatcccttacctgggtaagcgcgaggaccagtggtgcgggtctctaattggactgacaagccgggctacgtgggccaggaatatccaaaccgcaataaaccaggtgcgatccctcatcggctcagaagagtatactgattacatgccaagcatgaagagatttggccgggaagaggaggaagctggggtcttgtggtga

SEQ ID NO: 14310 - RNA, 9876 nt, synthetic construct
  misc_feature 1..9876: note = derived and/or modified CDS sequence (opt3) from DENV-2__KX380809__SS-prME
  source 1..9876: mol_type = other RNA
accgcaggaatcattataatgatgatccccaccgtgatggctttccacctgactacgagaaacggggaacctcatatgattgtaagcaggcaggaaaagggaaaatccctcctttttaagaccgagaatggtgttaacatgtgcacactgatggcaatggacttgggcgaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactcggaccgaaacatggatgagctccgagggggcttggaagcacgcccagaggatcgagacttgggtgcttcggcatcctggattcaccgttatggcagccatactggcttacacaatcggcaccacgtattttcagcgcgtgttgattttcatcctcctgactgcagtcgccccatctatgacaatgagatgcattggcatctcgaacagggactttgtggaaggggtatcaggaggtagctgggttgatatagtgctggagcacggcagttgtgtcaccactatggctaaaaataagcccacactcgacttcgaattaattaagaccgaggccaaacaccctgcgacgctgcggaagtactgcatcgaagcaaaacttaccaacacaactaccgcctcccgctgtccaacacagggggagccctctttgaatgaggaacaagataagcgatttgtgtgcaaacatagcatggtggacagaggatggggcaacggttgtgggctgttcggaaagggcggcattgtcacttgcgctatgtttacctgcaagaaaaatatggaggggaagatcgttcagcctgaaaacctagagtatacaatcgtgattaccccacactccggagaagagaatgccgtaggtaacgatactggcaaacatgggaaggagataaaagtgacgccgcagtcaagtatcacagaagcagagctcaccggatacggcactgctaccatggaatgtagccccaggacaggtctggacttcaatgagatggtccttctgcagatggaaaacaaggcctggttggtgcaccggcaatggtttctcgatctgcctttaccatggctgcccggggcggacacccagggctctaactggattcagaaagagactctcgttacattcaagaatcctcacgccaagaaacaggatgtggtcgtgcttggatcccaagagggcgcaatgcatacggctctgaccggggccactgaaatccagatgtcaagcggaaacttgctatttacaggtcacctgaagtgccgtctccgcatggacaaactgcagcttaagggcatgagttattctatgtgtaccgggaaattcaaggtagttaaggagatagctgaaacacaacatggaactattgtgatcagagtccagtacgagggcgacggttccccatgcaaaatccccttcgagattatggatctggaaaagaggcacgtgttggggcggctcatcaccgtcaatccgattgtgacggagaaagacagccctgttaacatagaagccgagcccccatttggcgattcgtacatcattatcggagtggaacctggccagctgaagttatcttggttcaaaaaggggtcctcaatcggacagatgtttgagaccacaatgcgaggtgcaaagcgcatggccattctgggcgacactgcttgggatttcgggagtctaggaggcgtatttaccagcataggtaaagcgctccatcaagtcttcggggcaatctatggcgccgctttttccggagtgtcttggacaatgaagattctgatcggcgttgtgattacttggatcgggatgaatagcagatcaaccagtctttccgtcagcttggtgctggtaggaatagtgacgctctacctgggcgttatggtccaggccgactctggttgtgtggtgtcatggaaaaacaaggagcttaaatgcgggagtggaatcttcattacagataatgtccacacctggactgaacagtataagtttcagcccgagagcccatccaagctggcatctgccatccaaaaagctcacgaagagggcatttgtggtatcaggtcggttacacggttggaaaacctcatgtggaagcagataacccccgagctgaatcatattttaagcgagaacgaagtgaaactgactatcatgaccggcgacattaaggggatcatgcaggccggaaaacgctccctaagacctcagccaacagagctcaagtactcatggaaagcatggggcaaggcgaagatgctgagtacggaacttcacaatcataccttcttgatagatgggccggagactgctgaatgccccaacacaaatagggcctggaactctctggaggtggaggactatggatttggcgtattcaccacaaatatctggctcaaactgaaggaacgtcaagatgtcttttgtgacagcaaattaatgtccgcagccattaaggacaaccgggctgtgcacgccgatatgggttactggatcgagtcagcactgaacgacacttggaaaattgaaaaggctagcttcatcgaggttaagtcttgccactggcctaaatcccataccctttggagtaatggggtgttggagagcgaaatgataattccaaagaacttcgccggacccgtctctcagcacaattatcgacctggctaccatacgcagacagcgggtccatggcacctcggcagactggagatggattttgacttctgtgaagggaccactgtggttgtgaccgaggattgcggaaacaggggcccctccctacgcacaactaccgcctcagggaaactgatcacagaatggtgctgtcggagttgcacgctcccgcctctgagatacaggggagaggacggctgttggtatggtatggagatccgcccacttaaggaaaaagaggaaaatttggtaaacagcctggtcaccgctgggcatggacagattgataatttttcgttaggcgtgctcggtatggcactgttccttgaggaaatgctgcgaactcgggtgggcacaaagcacgccatcttgctcgtcgctgtttcctttgtgaccctgattactgggaacatgtctttccgtgacctaggaagagtaatggtgatggtcggcgccacaatgaccgatgacatagggatgggagtgacgtacctggcactcctggcggcctttaaggttaggcccactttcgctgccggccttttgctgcgcaaattaaccagcaaggagctcatgatgacaaccatcggtattgtgctgctttcacaaagtactatccctgagacaattctggaactaaccgatgcactcgctctggggatgatggtcttgaaaatcgtgcggaatatggagaagtatcagctggccgttacaataatggcaatcttatgcgtgcccaacgccgtcattctccagaatgcttggaaagtatcctgtactatcctggcggtggtttctgtgagcccacttctgttgacctcctcacaacagaaggccgactggattcctctcgcactgacgatcaagggactaaaccccacagctatatttctgaccactcttagcagaaccagtaaaaagaggtcttggccactcaatgaagccattatggccgtcggcatggtgtccatcctggctagctcgttgctgaaaaacgatatcccgatgacaggccctttagtagcagggggactcctgactgtgtgctacgtccttaccggtcgatcagccgacctggagttggaacgcgcggctgacgttcggtgggaggagcaggccgaaatttctggcagttcccccatactcagcatcacgatttctgaggatgggagcatgtccatcaagaatgaagaggaggaacagacactgaccattctaatcagaactggactgcttgtgatatcaggcctcttcccagtgagtatccccattacagcagccgcttggtatctgtgggaggtcaaaaagcaaagggccggtgtgttgtgggacgttcctagcccaccccctgtagggaaagccgaattagaggatggagcgtaccgtatcaagcagaagggcattctgggctattctcagatcggggctggagtgtacaaagaaggtacctttcacactatgtggcatgtcacacgcggcgccgtgctcatgcacaaggggaaacggatagagccgtcctgggcagacgttaagaaagatctgatttcatacggaggcggttggaaacttgagggggaatggaaggagggagaagaggtgcaggtcctggccttggaaccaggcaaaaaccccagagctgtgcaaaccaagcctggcctattcaaaacgaacactgggaccatcggagccgtaagtctggactttagcccaggtacatccggctctcccatcgtcgataagaaagggaaggtggttggactctatggcaatggtgtggtcaccaggtcggggacatacgtgagcgcaattgctcagactgagaagtcaatcgaggacaaccctgaaatagaggatgacattttcagaaagaaacggctgaccatcatggatcttcatccgggagccggcaaaacgaagcgctatttacccgcgattgttagagaagccatcaaaaggggcctgcggacactcatattggcaccaactcgagtggtcgctgccgagatggaagaggctctgagagggctccctattcgctaccagacccccgcaatcagggccgagcacacaggacgtgaaatcgtggacctgatgtgtcatgccaccttcactatgcggcttctgtccccaattagagtacctaattataacttgatcattatggatgaggctcactttaccgaccccgcgagtatagcagccaggggttacatctctacacgcgtggaaatgggcgaggctgccgggattttcatgacggcaactccaccgggaagccgagacccttttccccagtccaatgccccaatcatggatgaggaaagagagatccccgaacggtcatggaactctggccacgagtgggttaccgacttcaagggtaagacagtctggtttgtgcctagcattaaagctgggaatgatatagcggcctgcctaaggaagaacggcaaaaaggtgatccaactgagtcgcaaaaccttcgactccgaatatattaagactcgtacaaatgattgggactttgtcgtaaccacggatatcagcgagatgggcgcaaacttcaaggctgagagagtgattgacccacggaggtgtatgaaacccgttatcctcactgatggcgaagaacgcgtgatattagccgggcctatgccggtcacacattcttcagcagcccagcgaagaggacgggtgggtaggaatccaaagaacgaaaatgaccagtacatctacatgggcgagcccctggaaaacgatgaggactgcgctcactggaaagaggccaagatgcttctggacaatattaacacccctgaagggatcattccctccatgtttgagccagaacgcgagaaagttgatgcgatcgacggagaatatagactcaggggcgaggcacggaagaccttcgtggatttgatgcgtcgcggtgacctgcctgtctggctcgcctaccgagtggctgccgaggggataaactatgctgatagaaggtggtgttttgacggcgtcaaaaataaccaaattctggaagagaatgtggaagttgagatctggactaaggagggagaacggaagaaacttaagccccgctggctagatgcaagaatttacagtgacccactggccttgaaagagttcaaggagttcgctgccggcaggaagtcgttaacactgaacctcatcaccgagatggggcggctgcctacatttatgactcagaaggcacgaaatgcgcttgataacctggccgtcctccatacggctgaagccggaggtagagcatataatcacgctttgagcgagctgccggagaccctagaaacactgctccttctgactttattggccaccgtgacaggcgggatattcctgtttctcatgtctggaaagggcatcggtaaaatgaccctggggatgtgctgcattatcactgcatccattcttctgtggtacgcccagatccagccccactggatagctgcgagcattatcctcgagttctttttgatcgtgctgttaattccagaacctgagaagcaacgcacgccccaggacaaccagctaacctatgtcgttatcgccatactgacagtggtagcagctactatggccaatgaaatgggcttcctcgagaaaaccaagaaagattttggacttggctcaattacaacccagcaaccagacagtaacatcctggatattgacttgaggcctgcctctgcatggactctgtacgctgtggccacaacgttcatcacccccatgctccggcattccatagagaatagctcagtcaacgtgagtctgactgcgatcgctaatcaggccacagttcttatggggctcggaaagggttggccgctgagcaagatggacattggcgtgccattgctggcaatcgggtgttactcccaggtcaaccctattaccttaaccgccgctctactgctccttgtagcacactatgccatcattggacccggcctgcaggcgaaagctacacgtgaagcccaaaagagagcagccgctggtatcatgaaaataccaactgtggatgggattacggttatcgacttggatcccatcccttacgacccgaagtttgagaaacagctgggccaggtgatgctcctggtcctttgcgtgacccaggtcttaatgatgaggacaacttgggccctgtgtgaagcactcaccttggctacaggacccatttctaccctgtgggagggcaatccagggcgcttctggaacactacgatagccgtgagcatggcgaatatctttcggggatcctatctagccggcgcaggtctactcttctcaattatgaagaacacagctaacacccgaagagggactggaaataccggcgaaacacttggtgagaagtggaaaaacaggctgaatgccttgggcaagtctgagtttcaaatctacaaaaagagtgggattcaggaagttgatcgcactctggcaaaagagggaatcaagcggggcgaaaccgaccatcacgctgtgtcgagagggagcgccaaactccgttggttcgtagagaggaacctggtgacacctgagggaaaggtcgttgatttaggctgcggtagagggggatggtcctattactgtggcggtcttaagaatgtgaaagaagtcaagggcctgacgaaagggggacccggccatgaggaacctataccaatgtctacctatgggtggaacctcgtgcgcctacagtcaggagtagacgtgttctttactccccctgagaagtgcgatacactgttgtgtgacatcggcgaaagctccccaaatcccaccgttgaggccggtcgaactctgagagtgctcaaccttgtcgagaattggctgaacaataacacacaattctgcattaaagtgttgaatccgtacatgcctagtgtcatcgaaaagatggaggcgctgcagaggaagtacgggggagctctcgtgcggaacccattatctcgcaatagcacccacgaaatgtattgggtttcaaacgcatccggcaacattgtaagtagcgtgaatatgatctctagaatgctgataaacaggtttacgatgaaacacaagaaagccacctacgagcccgatgtcgaccttggctccgggacacgaaatattggaatcgaatcagagactcctaacctggatatcattggtaagcggatagagaaaatcaagcaggaacatgagaccagctggcactatgaccaggaccatccatacaagacatgggcttatcacggctcgtacgaaactaaacaaaccgggtctgccagttccatggtgaatggagttgtgcgtctactcacaaagccctgggatgtcattccgatggtgacccagatggcaatgactgacacgacacctttcggccagcagagagtatttaaagagaaggtggatacccgcactcaagaacccaaagagggtaccaagaagctgatgaaaatcacagccgagtggttgtggaaggaactggggaaaaagaaaacgccaaggatgtgtacccgggaggagttcactagaaaggttcgcagcaacgctgcgctcggagccatttttacagacgagaataaatggaagtcagcaagggaggctgtcgaagattccggcttctgggagcttgtggacaaggaacgaaacctgcacttagagggcaaatgcgaaacctgtgtgtataatatgatggggaagcgggagaaaaagctgggagagtttggtaaagccaagggctctagagcaatctggtacatgtggttgggggccaggttcctcgaatttgaggctctgggattcctaaacgaagatcattggtttagccgcgagaatagtctttccggcgtcgaaggtgaggggctgcacaagctcggatacatactgcgtgacgttagcaaaaaggagggcggcgccatgtatgcggatgacactgcagggtgggatacacggatcaccttggaagacctgaaaaacgaggaaatggtgacaaatcatatggagggagaacacagaaagctcgccgaggctattttcaggcttacttaccagaacaaagtagtgcgcgtccagcgacctacaccccggggtacggtgatggacatcatttctagaagggatcagcgcggctcagggcaagttgtgacctatggactgaatacattcactaacatggaggcccagttaatcagacagatggaaggcgagggtgtctttaagagtattcaacatctgaccgtgacagaagagatagcagtaaagaactggttggagcgggttgggagggaacgtctctcccgaatggctatcagcggagacgattgcgtggtcaaaccactggacgatcgcttcgcctctgctctaactgcccttaatgacatgggcaaggtgagaaaagatattcagcagtgggagccctcgcggggctggaacgactggacccaggtgcctttttgctcacaccacttccatgaactgatcatgaaggatgggagggtcctcgttgtgccatgtcgcaatcaagacgagctgatcggacgagcacggattagccagggtgcgggctggtccttgagggaaacggcctgcttagggaaaagttacgctcagatgtggtctctgatgtattttcaccgacgtgatctcagacttgccgcaaacgctatatgtagcgccgtaccgtcccattgggtgcccacatcacgcaccacttggagtatccacgcaacacacgagtggatgaccactgaggacatgctgaccgtctggaatcgggtgtggattcaggaaaacccttggatggaggataagacaccagttgaatcttgggaggaaatcccctacctaggaaagagggaggaccaatggtgcggcagcctgattggtctcacgtccagagccacctgggcgaaaaatatccagactgctataaaccaggtgcgctcattgatcgggaatgaggaatatacagactacatgcctagcatgaagcggttcaggcgagaggaagaggaagccggagtcctgtggtga

SEQ ID NO: 14311 - RNA, 9876 nt, synthetic construct
  misc_feature 1..9876: note = derived and/or modified CDS sequence (opt3) from DENV-2__KX380810__SS-prME
  source 1..9876: mol_type = other RNA
accgccggaatcattataatgatgatccccacagtgatggctttccacctgactacgcgaaacggggaacctcatatgattgtaagcaggcaggaaaagggaaaatccctcctttttaagaccgagaatggtgttaacatgtgcaccctgatggcaatggacttgggagaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccgttatggcagccatactggcttacacaatcggcaccacgtattttcagcgcgtgttgattttcatcctcctgactgcagtcgccccatctatgacaatgagatgcattggcatctcgaacagggactttgtggaaggggtatcaggaggtagctgggttgatatagtgctggagcacggcagttgtgtcaccactatggctaaaaataagcccacactcgacttcgaattaattaagaccgaggccaaacaccctgcgacgctgcggaagtactgcatcgaagcaaaacttaccaacacaactaccgcctcccgctgtccaacacagggggagccctctttgaatgaggaacaagataagcgatttgtgtgcaaacatagcatggtggacagaggatggggcaacggttgtgggctgttcggaaagggcggcattgtcacttgcgctatgtttacctgcaagaaaaatatggaggggaagatcgttcagcctgaaaacctagagtatacaatcgtgattaccccacactccggagaagagaatgccgtaggtaacgatactggcaaacatgggaaggagataaaagtgacgccgcagtcaagtatcacagaagcagagctcaccggatacggcactgctaccatggaatgtagccccaggacaggtctggacttcaatgagatggtccttctgcagatggaaaacaaggcctggttggtgcaccggcaatggtttctcgatctgcctttaccatggctgcccggggcggacacccagggctctaactggattcagaaagagactctcgttacattcaagaatcctcacgccaagaaacaggatgtggtcgtgcttggatcccaagagggcgcaatgcatacggctctgaccggggccactgaaatccagatgtcaagcggaaacttgctatttacaggtcacctgaagtgccgtctccgcatggacaaactgcagcttaagggcatgagttattctatgtgtaccgggaaattcaaggtagttaaggagatagctgaaacacaacatggaactattgtgatcagagtccagtacgagggcgacggttccccatgcaaaatccccttcgagattatggatctggaaaagaggcacgtgttggggcggctcatcaccgtcaatccgattgtgacgggcaaagacagccctgttaacatagaggccgaacccccatttggagattcgtacatcattatcggcgtggagcctgggcagctgaagttatcttggttcaaaaagggatcctcaatcggtcagatgtttgaaaccacaatgcgaggcgcaaagcgcatggccattctgggggacactgcttgggatttcggaagtctaggcggtgtatttaccagcatagggaaagcgctccatcaagtcttcggcgcaatctatggagccgctttttccggcgtgtcttggacaatgaagattctgatcggggttgtgattacttggatcggaatgaatagcagatcaaccagtctttccgtcagcttggtgctggtaggcatagtgacgctctacctgggtgttatggtccaggccgactctgggtgtgtggtgtcatggaaaaacaaggagcttaaatgcggaagtggcatcttcattacagataatgtccacacctggactgagcagtataagtttcagcccgaaagcccatccaagctggcatctgccatccaaaaagctcacgaggaaggtatttgtggcatcaggtcggttacacggttggagaacctcatgtggaagcagataacccccgaactgaatcatattttaagcgagaacgaggtgaaactgactatcatgaccggggacattaagggaatcatgcaggccggcaaacgctccctaagacctcagccaacagaactcaagtactcatggaaagcatgggggaaggcgaagatgctgagtacggagcttcacaatcataccttcttgatagatggaccggaaactgctgagtgccccaacacaaatagggcctggaactctctggaagtggaggactatggctttggtgtattcaccacaaatatctggctcaaactgaaggagcgtcaagatgtcttttgtgacagcaaattaatgtccgcagccattaaggacaaccgggctgtgcacgccgatatggggtactggatcgaatcagcactgaacgacacttggaaaattgagaaggctagcttcatcgaagttaagtcttgccactggcctaaatcccataccctttggagtaatggagtgttggagagcgagatgataattccaaagaacttcgccggccccgtctctcagcacaattatcgacctggttaccatacgcagacagcgggcccatggcacctcgggagactggaaatggattttgacttctgtgagggaaccactgtggttgtgaccgaagattgcggcaacagggggccctccctacgcacaactaccgcctcaggaaaactgatcacagagtggtgctgtcggagttgcacgctcccgcctctgagatacaggggcgaagacggttgttggtatgggatggagatccgcccacttaaggagaaagaagagaatttggtaaacagcctggtcaccgctggacatggccagattgataatttttcgttaggtgtgctcggcatggcactgttccttgaagagatgctgcgaactcgggtggggacaaagcacgccatcttgctcgtcgctgtttcctttgtgaccctgattactggaaacatgtctttccgtgacctaggcagagtaatggtgatggtcggggccacaatgaccgatgacataggaatgggcgtgacgtacctggcactcctggcggcctttaaggttaggcccactttcgctgccggtcttttgctgcgcaaattaaccagcaaggaactcatgatgacaaccatcgggattgtgctgctttcacaaagtactatccctgagacaattctggagctaaccgatgcactcgctctgggaatgatggtcttgaaaatcgtgcggaatatggaaaagtatcagctggccgttacaataatggcaatcttatgcgtgcccaacgccgtcattctccagaatgcttggaaagtatcctgtactatcctggcggtggtttctgtgagcccacttctgttgacctcctcacaacagaaggccgactggattcctctcgcactgacgatcaagggcctaaaccccacagctatatttctgaccactcttagcagaaccagtaaaaagaggtcttggccactcaatgaggccattatggccgtcggcatggtgtccatcctggctagctcgttgctgaaaaacgatatcccgatgacagggcctttagtagcaggaggtctcctgactgtgtgctacgtccttaccggccgatcagccgacctggaattggagcgcgcggctgacgttcggtgggaagaacaggccgagatttctgggagttcccccatactcagcatcacgatttctgaagatggaagcatgtccatcaagaatgaggaagaggagcagacactgaccattctaatcagaactggcctgcttgtgatatcaggtctcttcccagtgagtatccccattacagcagccgcttggtatctgtgggaagtcaaaaagcaaagggcaggggtgttgtgggacgttcctagcccaccccctgtaggaaaagccgagttagaagatggcgcgtaccgtatcaagcagaagggcattctggggtattctcagatcggagctggtgtgtacaaagagggcacctttcacactatgtggcatgtcacacgcggggccgtgctcatgcacaagggaaaacggatagaaccgtcctgggcagacgttaagaaagatctgatttcatacggcggtgggtggaaacttgagggagagtggaaggaaggcgaggaagtgcaggtcctggccttggagccaggcaaaaaccccagagctgtgcaaaccaagcctgggctattcaaaacgaacactggaaccatcggtgccgtaagtctggactttagcccaggcacatccgggtctcccatcgtcgataagaaaggaaaggtggttggcctctatggtaatggggtggtcaccaggtcgggaacatacgtgagcgcaattgctcagactgaaaagtcaatcgaggacaaccctgagatagaagatgacattttcagaaagaaacggctgaccatcatggatcttcatccgggcgccggcaaaacgaagcgctatttacccgcgattgttagagaggccatcaaaagggggctgcggacactcatattggcaccaactcgagtggtcgctgccgaaatggaggaagctctgagaggactccctattcgctaccagacccccgcaatcagggccgagcacacaggtcgtgagatcgtggacctgatgtgtcatgccaccttcactatgcggcttctgtccccaattagagtacctaattataacttgatcattatggatgaagctcactttaccgaccccgcgagtatagcagccaggggctacatctctacacgcgtggagatgggggaagctgccggaattttcatgacggcaactccaccgggcagccgagacccttttccccagtccaatgccccaatcatggatgaggagagagaaatccccgagcggtcatggaactctggtcacgaatgggttaccgacttcaaggggaagacagtctggtttgtgcctagcattaaagctggaaatgatatagcggcctgcctaaggaagaacggcaaaaaggtgatccaactgagtcgcaaaaccttcgactccgagtatattaagactcgtacaaatgattgggactttgtcgtaaccacggatatcagcgaaatgggcgcaaacttcaaggctgagagagtgattgacccacggaggtgtatgaaacccgttatcctcactgatggggaggaacgcgtgatattagccggacctatgccggtcacacattcttcagcagcccagcgaagaggtcgggtgggcaggaatccaaagaacgagaatgaccagtacatctacatgggggaacccctggagaacgatgaagactgcgctcactggaaagaggccaagatgcttctggacaatattaacacccctgagggaatcattccctccatgtttgaaccagagcgcgaaaaagttgatgcgatcgacggcgagtatagactcaggggtgaagcacggaagaccttcgtggatttgatgcgtcgcggggacctgcctgtctggctcgcctaccgagtggctgccgagggcataaactatgctgatagaaggtggtgttttgacggagtcaaaaataaccaaattctggaggaaaatgtggaggttgaaatctggactaaggagggcgagcggaagaaacttaagccccgctggctagatgcaagaatttacagtgacccactggccttgaaagagttcaaggagttcgctgccgggaggaagtcgttaacactgaacctcatcaccgaaatgggacggctgcctacatttatgactcagaaggcacgaaatgcgcttgataacctggccgtcctccatacggctgaggccggtggcagagcatataatcacgctttgagcgaactgccggagaccctagagacactgctccttctgactttattggccaccgtgacagggggaatattcctgtttctcatgtctggcaagggtatcgggaaaatgaccctgggcatgtgctgcattatcactgcatccattcttctgtggtacgcccagatccagccccactggatagctgcgagcattatcctcgagttctttttgatcgtgctgttaattccagagcctgaaaagcaacgcacgccccaggacaaccagctaacctatgtcgttatcgccatactgacagtggtagcagctactatggccaatgagatgggattcctcgagaaaaccaagaaagattttggccttgggtcaattacaacccagcaaccagacagtaacatcctggatattgacttgaggcctgcctctgcatggactctgtacgctgtggccacaacgttcatcacccccatgctccggcattccatagagaatagctcagtcaacgtgagtctgactgcgatcgctaatcaggccacagttcttatgggactcggtaagggctggccgctgagcaagatggacattggggtgccattgctggcaatcggatgttactcccaggtcaaccctattaccttaaccgccgctctactgctccttgtagcacactatgccatcattggccccggtctgcaggcgaaagctacacgtgaggcccaaaagagagcagccgctgggatcatgaaaataccagccgcagatattggcactgtgatcgacttggatcccatcccttacgacccgaagtttgaaaaacagctgggacaggttatgctcctggtgctttgctctacgcaggtcttaatgatgaggaccacatgggctctgtgtgaggccctcactttggcgaccggccccattagcacactgtgggaagggaatccaggacgcttctggaacaccactatagccgtgtccatggcaaatatctttcggggctcatatctagctggtgccgggctactcttctctattatgaagaacacggcaaacacacgaagaggaaccggcaatactggtgagacccttggcgaaaagtggaaaaacaggctgaatgctttggggaagagtgagtttcaaatctacaaaaagtcgggcattcaggaggtcgatcgcacactggccaaagaaggcatcaagagaggggaaactgaccatcacgccgtgagccggggatccgcgaaactccgttggttcgttgaaaggaacctggtgacccctgagggcaaggtagtggatttaggttgcgggcggggaggctggtcttattactgtggtggccttaagaatgtcaaagaggttaaggggctgacaaaaggaggccccgggcatgaagaacctataccaatgtcaacgtatggatggaacctcgtgcgcctacagagcggcgtcgacgtgttctttacaccccctgaaaagtgcgatactctgttgtgtgacatcggtgagtccagtccaaatcccacagtagaagctgggcgaaccctgagagtgctcaaccttgttgagaattggctgaacaataacactcaattctgcattaaagtgttgaatccgtacatgccttctgtcatcgagaagatggaagcactgcagaggaagtacggaggcgccctcgtgcggaacccattaagccgcaattcaacacacgagatgtattgggtctccaacgctagtggcaacattgtgagctctgttaatatgatctccagaatgctgataaacaggtttaccatgaaacacaagaaagccacgtacgaacccgatgtagaccttgggtcaggaacccgaaatattggtatcgagagcgaaacacctaacctggatatcattggcaagcggatagagaaaatcaagcaggagcatgaaacttcgtggcactatgaccaggaccatccatacaagacctgggcatatcacgggtcttacgagacaaaacaaactggaagtgcctccagcatggtgaatggcgtcgtgcgtctactcaccaagccctgggatgttattccgatggtgacacagatggctatgaccgacactacgcctttcggtcagcagagagtctttaaagaaaaggtggatacacgcacccaagagcccaaagaagggactaagaagctgatgaaaatcaccgcggagtggttgtggaaggagctgggcaaaaagaaaacaccaaggatgtgtacgcgggaagagttcaccagaaaggtacgctcaaacgccgcactcggcgctatttttactgacgaaaataaatggaagtccgccagggaggcagtggaggattctggcttctgggaacttgttgacaaggagcgaaacctgcacttagaagggaaatgcgagacatgtgtctataatatgatgggaaagcgggagaaaaagctgggtgagtttggcaaagccaaggggagcagagctatctggtacatgtggttgggagccaggttcctcgagtttgaagcgctgggcttcctaaacgaggatcattggtttagtcgcgaaaattcccttagcggtgtggagggggaaggactgcacaagctcggctacatactgcgtgacgtgtctaaaaaggagggcggggcaatgtatgccgatgacaccgctggatgggatactcggatcacattggaggacctgaaaaacgaagagatggtcaccaatcatatggaaggtgagcacagaaagctcgccgaagcaattttcaggcttacataccagaacaaagttgtgcgcgtacagcgacctactccccggggcaccgtgatggacatcatttcaagaagggatcagcgcgggagtggacaagtcgtgacgtatggcctgaataccttcacaaacatggaggctcagttaatcagacagatggagggtgaaggggtttttaagtccattcaacatctgactgtgaccgaggaaatagccgtcaagaactggttggagcgggtgggaagggagcgtctcagccgaatggctatctctggcgacgattgcgtagttaaaccactggacgatcgcttcgcctcggcactaacagcgcttaatgacatgggcaaggtgagaaaagatattcagcagtgggaaccctcacgggggtggaacgactggactcaggtccctttttgcagccaccacttccatgagctgatcatgaaggatggaagggtgctcgtggtcccatgtcgcaatcaagacgaactgatcggtagagcccggatttcccagggcgctgggtggagtttgagggagaccgcctgcttaggaaaatcttacgcacagatgtggagcctgatgtattttcaccgacgtgatctcagacttgctgccaacgcaatatgttccgccgttccgtcacattgggtgcccatcagtcgcacgacatggtctattcacgcgacccacgaatggatgactacagaggacatgctgaccgtatggaatcgggtgtggatccaggagaacccttggatggaagataagactccagtcgagagctgggaagagattccctacctaggcaagagggaagaccaatggtgcggttccctgatcgggctcacctcaagagctacatgggccaaaaatatacagacggcaatcaaccaggtgcgcagcttgattggaaatgaggagtataccgactacatgccttctatgaagcggttcaggcgagaagaggaagaggccggcgttctgtggtga

SEQ ID NO: 14312 - RNA, 9876 nt, synthetic construct
  misc_feature 1..9876: note = derived and/or modified CDS sequence (opt3) from DENV-2__KX380811__SS-prME
  source 1..9876: mol_type = other RNA
accgccggcatcattataatgatgatccccacagtgatggctttccacctgactacgaggaatggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgttgcgctcgtgccccatgtcggcatgggtctggagactaggaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcagcctcagaccccagcctacggagctgaagtactcctggaaagcctggggcaaggcaaagatgctttcaaccgaattgcacaatcatactttcctgatcgatgggccagagacagcggaatgcccgaacaccaatagggcttggaacagtctcgaggtcgaggactatggatttggcgtgttcacaactaatatatggctgaaattaaaggaacgtcaagatgtattttgtgactctaacctgatgagcgccgcaatcaaagacaaccgggccgtgcacgctgatatgggttactggattgagtccgcccttaatgacacctggaagatcgaaaaagcatcattcattgaggtcaagagctgccactggcccaagtctcatacgttgtggtccaacggggtgctcgagagtgaaatgatcatacctaaaaatttcgctggaccagttagccagcacaactatcgacccggctaccatacacagaccgccggtccttggcacctgggcagactagagatggattttgacttctgtgaagggactaccgtggtagtcacagaggattgcggaaataggggcccatctctgcgcactaccacagcgtccgggaagctcattacggaatggtgctgtcggtcatgcaccctgcccccgcttagatacaggggagaggacggctgttggtatggtatggagatccgccctttgaaagaaaaggaggaaaacctggtgaatagtttagtgactgccgggcatggacagatcgataactttagcctcggcgtcctgggtatggctcttttcctggaggaaatgttgcgaacacgggttggcaccaaacacgcaattctcctggtggccgtatcgtttgtgactctaatcacagggaatatgtccttccgtgacctgggaagagtcatggtgatggttggcgctaccatgacggatgacattgggatgggagtgacttacctcgccctgcttgcagcgtttaaggtcaggccaaccttcgccgctggcttgctgttacgcaagctcacatctaaagagctgatgatgaccactataggtatcgtgcttctgagccaatcaacaattcccgagagtatcctagaactcaccgatgccctggcattggggatgatggttctgaagattgtgcggaacatggagaaatatcagttagctgtcacaatcatggccatactctgcgtacctaatgcagtgatcctgcagaacgcctggaaggtttcctgtactacccttgctgtggtctctgtgagccccctgttgctcacgtcctcacaacagaaagcggactggattccactggccctaacaatcaagggactgaatcctaccgcaatttttcttactaccctcagcagaacaagtaagaaaaggtcttggcccctgaacgaagctatcatggccgtaggcatggtgtccatattggccagctcgctgttaaagaatgatattccaatgactggcccgctcgtcgctgggggactgcttaccgtttgctacgtgctgacgggtcgatcagcagacttggagctcgaacgcgccgcggacgtgcggtgggaggagcaggctgaaatctctggcagttcccctatcctgagcattacaatatctgaggatgggagcatgtccatcaaaaacgaagaggaggaacagaccctaactattctgatcagaacaggacttctcgtcatttcaggcctgttccccgtgagtatcccaataaccgccgcagcctggtatttgtgggaggttaagaaacaaagggctggtgtattatgggacgtgcccagccctccacccgtcgggaaggcagaactggaggatggagcctaccgtatcaaacagaagggcattctcggctattctcagatcggggcgggagtgtacaaggaaggtacttttcacacaatgtggcatgttacccgcggcgctgtgctgatgcacaaagggaagcggattgagccttcctgggccgacgtcaaaaaggatcttatctcatacggaggcggttggaaactggagggggaatggaaggagggagaagaggtgcaggtattggcactagaaccgggcaagaacccaagagccgtccaaacgaaacccggcctgttcaagactaataccgggacaataggagctgtgagtctcgactttagccctggtacctccggctctccaattgttgataaaaaggggaaagtggtcggactgtatggcaacggtgtggttacaaggtcggggacttacgtgagcgccatcgcacagaccgagaagtcaatcgaggacaatcccgaaattgaggatgacatcttccgaaagaaacggcttacgataatggatttacatcctggagctggcaagacaaaacgctatctgccggccattgtcagagaagcgatcaagaggggcctccggactttgattctggcccccacccgagtggtagcagctgagatggaagaggccctcagagggctgccaatccgctaccagacccctgctataagggcagagcacaccggacgtgaaattgtggaccttatgtgtcatgccactttcaccatgcggctgttgtcccccatcagagttccaaactataatctaatcattatggatgaggcccactttacagaccctgctagtatcgcggcaaggggttacatttctacgcgcgtcgaaatgggcgaggccgctgggatattcatgactgccacacccccaggaagccgagacccgtttcctcagtccaacgcacccatcatggatgaggaaagagagattccagaacggtcatggaactctggccacgagtgggtgacagacttcaaaggtaagaccgtgtggtttgtccccagcatcaaggccgggaacgatatcgctgcgtgcctgaggaaaaatggaaagaaagtaattcaactcagtcgcaagactttcgactccgaatatataaaaacacgtaccaacgattgggactttgtggttacgactgatatcagcgagatgggcgccaatttcaaggcagagagagtgattgaccctcggaggtgtatgaagccagtcatcttaacagatggcgaagaacgcgtgattctggctgggcccatgcctgttacccattcttcagccgcacagcgaagaggacgggtgggtaggaacccgaaaaatgaaaacgaccagtacatctacatgggcgagccacttgaaaatgatgaggactgcgcccactggaaggaggctaaaatgctgctcgacaacataaacacccccgaagggatcattccttccatgtttgagcccgaacgcgagaaggtcgatgccatcgacggagaatatagattgaggggcgaggcgcggaaaactttcgtggatctgatgcgtcgcggtgacctcccagtatggctggcataccgagtggccgctgaggggattaattatgccgatagaaggtggtgttttgacggcgttaagaacaatcaaatccttgaagagaacgtcgaagtggagatatggacaaaagagggagaacggaagaagctaaaacctcgctggctggatgctagaatttacagtgaccccttggcattaaaggagttcaaagagttcgccgctggcagaaagagcctgaccctcaatctgatcacagagatggggcggcttccaacttttatgacgcagaaagccaagaacgcactggataatctcgcggtgttgcataccgccgaagctggaggtcgagcctataaccacgcactgtcggagctacctgagacactggaaactctccttctgttaaccttgctggctacagtcaccggcgggattttcctctttctgatgtctggaaagggcatcggtaaaatgactcttgggatgtgctgcataatcacggcctccattctgctctggtacgcacagatccagccgcactggattgccgctagcatcatattggagttctttctgattgttttactaatccccgaaccagagaagcaaagaacccctcaggacaatcagctgacatatgtggtaatcgcgattctcactgtggtcgccgcaaccatggctaacgaaatgggcttccttgagaaaacaaagaaagattttggactgggctcaatcaccactcagcaacccgagagtaatatattggacattgatctgcgcccagcctctgcctggacactctacgcagtggctacgaccttcatcactcctatgctgaggcattccattgaaaacagctcagttaatgtgagtcttacagccatcgcgaaccaggctaccgtcctcatggggctgggaaagggttggcccttgagcaagatggacataggcgtaccgctgttagccatcgggtgttactcccaggtgaatccaattaccctaacagcagccctgctccttctggttgctcactatgcaatcattggacctggcttgcaggccaaagcgactcgggaggctcaaaagcgtgccgcagccggtatcatgaaaattcccacggtggacgggatgaccgtcatcgatctggacccaataccctacgatcctaagtttgaaaaacagctcggccaggtgatgctgcttgtcttatgcgtgacacaggttctgatgatgagaactacctgggctctctgtgaggccttgacactggcaaccggaccgatttctactctatgggaaggcaaccccgggaggttctggaatacgacaatcgctgtgagcatggccaacatctttcgcggatcctatctggcgggcgccggtctccttttctcaattatgaagaacaccgcaaatactcggcgagggaccggaaacacaggcgagactctgggtgagaagtggaaaaatagattgaacgctctgggcaagtctgaatttcaaatatacaaaaagagtgggatccaggaggtagacaggaccctcgccaaagaaggaattaagcgcggcgagacagatcatcacgcagtgtcgcgggggagcgctaaactgagatggttcgtcgagcgtaatttagttacgccagaaggaaaggtggtcgaccttggctgcggtagagggggatggtcctattactgtggcggtctgaagaacgtgaaagaggtaaagggcctcaccaaagggggacctggccatgaggaacccatccctatgtctacttatgggtggaatctagtgcggctgcagtcaggagttgatgtgttctttacaccacccgaaaagtgcgacaccttgctgtgtgatattggcgagagctcccctaacccaactgtcgaggccggtcgcacactccgagtgcttaatctggtcgaaaactggttgaataacaatacccaattctgcatcaaagtgctgaacccctacatgccgagtgttatagagaagatggaagccctccagagaaagtacgggggagcgttagtaaggaatcctctgtctcggaacagcacgcacgagatgtattgggtgtcaaacgcttccggcaatatcgtcagtagcgtgaacatgatttctcgcatgcttatcaatagatttaccatgaggcacaaaaaggcaacatacgaaccagacgttgatctgggctccgggactcgaaacattggaatcgagtcagagacccccaatctagacataattggtaaacggatcgaaaagatcaaacaggagcatgaaacaagctggcactatgatcaggaccatccttacaagacttgggcctatcacggctcgtacgagaccaagcaaacagggtctgctagttccatggtgaacggagtcgtgcgtctcctgaccaaaccatgggacgtaattcccatggtgactcagatggccatgacggatacaaccccgttcggccagcagagagtttttaaggaaaaagtcgacactcgcacccaagagcctaaggagggtaccaagaagttgatgaagataacggcagaatggctgtggaaagagctcgggaagaaaaagacccccaggatgtgtactcgggaagagttcacaagaaaagtgcgcagcaatgccgctcttggagcgatctttaccgatgagaacaagtggaaatcagccagggaagcagtggaggactccggcttctgggaactggtcgataaggagcgaaatttacacctggaaggcaagtgcgagacttgtgtttataacatgatggggaaacgggagaagaaattgggagaatttggtaaggctaaaggctctagagccatttggtacatgtggctcggggcaaggttcctggagtttgaagccctaggattccttaatgaggaccattggtttagccgcgaaaacagtctgtccggcgtggagggtgaggggctccacaagctgggatacatcttgcgtgatgtaagcaagaaagaaggcggcgctatgtatgccgacgatacagcggggtgggacacccggattacactggaggatctcaagaatgaagagatggtgactaaccatatggaaggagagcacaagaaacttgcagaggccatcttcaaactgacctaccagaataaagtcgtgagagttcagaggccaacgcctcgcggtaccgtgatggacataatctctcgacgggaccagagaggctcagggcaagtcgtgacatatggattaaacactttcaccaacatggaagctcagctgattaggcagatggagggcgaaggtgtatttaagagtatccaacagttgacagttaaagaggagattgccgtgaagaattggctcatccgcgtcgggagagaacggctgtccaggatggcaattagcggagatgactgcgtggtgaaacccctagatgaccgtttcgcttctgcccttactgctctgaacgatatgggcaaggtccgaaaagacatacagcagtgggagccatcgcgcggctggaatgattggacccaagttcccttttgctcacatcacttccacgaactcatcatgaaggacgggagagtgctggtagtgccttgtcggaaccaggatgagttgattggaagggcccgcatcagccagggtgcaggctggtccttaagagaaacggcgtgcctggggaagagttacgcccagatgtggtctctcatgtattttcatcggagggaccttcgactggctgccaatgcaatctgtagcgctgtcccatcccactggattccgacatcacgtaccacttggagtatacatgccacacacgagtggatgaccactgaggatatgctaaccgtgtggaacagagtttggatccaagaaaatccctggatggaggacaaaacacctgtggaatcttgggaggaaattccatacctgggaaagcgcgaggatcagtggtgcggcagcctcatcggtttgacgtcccgggcaacctgggccaaaaacattcagactgcgatcaatcaggtcaggtcactgatagggaacgaggaatatacagactacatgcccagcatgaagagattccgccgggaggaagaggaagctggagtgctttggtga

SEQ ID NO: 14313 - RNA, 9876 nt, synthetic construct
  misc_feature 1..9876: note = derived and/or modified CDS sequence (opt3) from DENV-2__KX380813__SS-prME
  source 1..9876: mol_type = other RNA
accgccggcatcattataatgatgatccccactgtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgttgcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagtccgccgaaacacaacatggaactatagtcattagagtgcagtacgagggcgacggtagcccttgcaaaatcccattcgagatcatggatttggaaaagaggcacgtcctcgggcggctgattaccgtgaatcccatcgttacggagaaagactcgccggtgaacattgaagctgagcctccctttggcgattcttacataatcattggagtagaaccaggccagttaaagctgtcctggttcaaaaaggggtcaagtatcggacagatgtttgagaccacaatgcgaggtgccaagcgcatggcaatcctaggcgacactgcctgggatttcgggagcctcggaggcgtctttacctccattggtaaagctctgcatcaagtgttcggggcgatatatggcgcagccttttctggagttagctggacaatgaagatccttattggcgtggtcatcacttggattgggatgaactcaagaagtacctccttgagcgtgtctctggtactcgtgggagttgtcacgctgtaccttggcgtgatggtgcaggctgactcaggttgtgtcgttagttggaaaaacaaggagctgaaatgcgggagcggaatcttcataacagataatgtgcacacctggactgaacagtataagtttcagcctgagtccccctctaagttggcctcggcaatccaaaaagcccacgaagagggcatttgtggtatcaggagcgtgacacggctcgaaaacctgatgtggaagcagattaccccagagttaaatcatatcctgactgagaacgaagtaaaactaaccataatgacaggcgacattaaggggatcatgcaggctggaaaacgcacgctcagaccccagcctaccgagctgaagtactcctggaaagcctggggcaaggcaaagatgctttcaactgaattgcacaatcatacattcctgattgatgggccagagaccgcggaatgcccgaacacaaatagggcttggaacagtctcgaggtcgaggactatggatttggcgtgttcactaccaatatctggctgaaattaaaggaacgtcaagatgtattttgtgactctaaactgatgagcgccgcaataaaggacaaccgggccgtgcacgctgatatgggttactggatcgagtccgcccttaacgacacgtggaaaattgaaaaggcatcattcatcgaggtcaagagctgccactggcccaaatctcatacattgtggtccaatggggtgctcgagagtgaaatgattatccctaagaacttcgctggaccagttagccagcacaattatcgacccggctaccatacccagactgccggtccttggcacctgggcagactagagatggattttgacttctgtgaagggaccacagtggtagtcactgaggattgcggaaacaggggcccatctctgcgcaccacaacggcgtccgggaaactcataaccgaatggtgctgtcggtcatgcactctgcccccgcttagatacaggggagaggacggctgttggtatggtatggagattcgccctttgaaggaaaaagaggaaaatctggtgaacagtttagtgacagccgggcatggacagatcgataattttagcctcggcgtcctgggtatggctcttttcctggaggaaatgttgcgaacccgggttggcactaagcacgcaatcctcctggtggccgtatcgtttgtgacactaattaccgggaacatgtccttccgtgacctgggaagagtcatggtgatggttggcgctacgatgactgatgacatcgggatgggagtgacctacctcgccctgcttgcagcgtttaagattaggccaacattcgccgctggcttgctgttacgcaaactcacctctaaggagctgatgatgactacaataggtatcgtccttctgagccaatcaaccattcccgagagtatcctagaactcacagatgccctggcattggggatgatggtgctgaaaattgttcggaatatggagaagtatcagttagctgtgactatcatggccatactctgcgtccctaacgcagtaatcctgcagaatgcctggaaagtgtcctgtaccacgcttgctgttgtgtctgtcagccccctgttgctcacatcctcacaacagaaggcggactggattccactggccctaaccatcaagggactgaaccctactgcaatttttcttaccacactcagcagaacaagtaaaaagaggtcttggcccctgaatgaagctatcatggccgtgggcatggtatccatattggccagctcgctgctaaagaatgatattccaatgaccggcccgctcgtggctgggggactgcttacggtctgctacgttctgacaggtcgatcagcagacttggagctcgaacgcgccgcggacgtgcggtgggaggagcaggctgaaatctctggcagttcccctatcctgagcattaccatatctgaggatgggagcatgtccatcaagaatgaagaggaggaacagactctaacaattctgatcagaaccggacttctcgtgatttcaggcctgttccccgtcagtatcccaataactgccgcagcctggtatttgtgggaggtgaaaaagcaaagggctggtgttttatgggacgtacccagccctccacccgtggggaaagcagaactggaggatggagcctaccgtatcaagcagaagggcattctcggctattctcagatcggggcgggagtctacaaagaaggtacatttcacaccatgtggcatgtgacgcgcggcgctgttctgatgcacaaggggaaacggattgagccttcctgggccgacgtgaagaaagatcttatctcatacggaggcggttggaagctggagggggaatggaaggagggagaagaggtccaggtgttggcactagaaccgggcaaaaacccaagagccgtacaaactaagcccggcctgttcaaaaccaacacagggaccataggagctgtcagtctcgactttagccctggtacatccggctctccaattgtggataagaaagggaaggttgtgggactgtatggcaatggtgtcgtgactaggtcggggacctacgttagcgccatcgcacagacggagaagtcaatcgaggacaaccccgaaattgaggatgacatcttccggaaaaagagacttacaataatggatttacatcctggagctggcaaaactaagcgctatctgccggccattgtgagagaagcgatcaaaaggggcctccggaccttgattctggcccccacacgagtcgtggcagctgagatggaagaggccctcagagggctgccaatccgctaccagacccctgctataagggcagagcacactggacgtgaaattgtagaccttatgtgtcatgccaccttcacaatgcggctgttgtcccccatcagagtgccaaattataacctaatcattatggatgaggcccactttacggaccctgctagtatcgcggcaaggggttacatttctactcgcgttgaaatgggcgaggccgctgggatattcatgaccgccacacccccaggaagccgagacccgtttcctcagtccaatgcacccatcatggatgaggaaaaggagattccagaaagatcatggaactctggccacgagtgggtcaccgacttcaagggtaaaactgtgtggtttgtgcccagcatcaaggccgggaatgatatcgctgcgtgcctgcggaaaaacggaaagaaagtcattcaactcagtaggaagacattcgactccgaatatataaagacccgcacgaatgattgggactttgtagtgactacagatatcagcgagatgggcgccaacttcaaagcagagcgtgttattgaccctagacggtgtatgaagccagtgatcttaaccgatggcgaagagagggtcattctggctgggcccatgcctgtgacccattcttcagccgcacagcgccgaggaagagttggtcggaatccgaaaaacgaaaatgaccagtacatctacatgggcgagccacttgaaaacgatgaggactgcgcccactggaaggaggctaaaatgctgctcgacaatataaacactcccgaagggatcattccttccatgtttgagcccgaaagggagaaggtggatgccatcgacggagaatatcgcttgagaggcgaggcgaggaaaacattcgtcgatctgatgcggcgtggtgacctcccagtgtggctggcataccgcgtagccgctgaggggattaactatgccgatcgaagatggtgttttgacggcgtgaagaataaccaaatccttgaagagaatgttgaagtcgagatatggaccaaggagggagaaaggaaaaagctaaaacctcggtggctggatgctcgcatttacagtgaccccttggcattaaaggagttcaaagagttcgccgctggcagaaagagcctgacactcaacctgatcactgagatggggaggcttccaacgtttatgacccagaaggccaaaaatgcactggataacctcgcggtgttgcatacagccgaagctggaggtcgggcctataatcacgcactgtcggagctacctgagactctggaaaccctccttctgttaacattgctggctaccgtgactggcgggattttcctctttctgatgtctggaaagggcatcggtaaaatgacgcttgggatgtgctgcataatcaccgcctccattctgctctggtacgcacagatccagccgcactggattgccgctagcatcatattggagttctttctgattgtcttactaatccccgaaccagagaagcaacgaacacctcaggacaaccagctgacttatgttgtgatcgcgattctcaccgtagtggccgcaacaatggctaatgaaatgggcttccttgagaaaaccaagaaggattttggactgggctcaatcactacacagcaacccgagagtaacatattggacattgatctgagaccagcctctgcctggacgctctacgcagtcgctaccactttcatcacacctatgctgcgccattccattgaaaatagctcagtgaacgttagtcttaccgccatcgcgaatcaggctaccgtgctcatggggctgggaaaaggttggcccttgagcaagatggacataggcgtcccgctgttagccatcgggtgttactcccaggtaaacccaattacactaactgcagccctgctccttctggtggctcactatgcaatcattggacctggcttgcaggccaaagcgacgagggaggctcaaaagcgggccgcagccggtatcatgaaaaatcccaccgttgacgggatgacagtgattgatctggacccaatcccctacgatcctaagtttgaaaagcagctcggccaggtcatgctgcttgtgttatgcgtcactcaggtgctgatgatgcgtaccacatgggctctctgtgaggccttgaccctggcaactggaccgatatctacgctatgggaaggcaaccccgggagattctggaatacaaccattgctgttagcatggccaacatctttaggggatcctatctggcgggcgccggtctccttttctcaatcatgaaaaacactgcaaatacccgccgggggacaggaaacactggcgagaccctgggtgagaagtggaaaaatcgattgaacgctctgggcaagtctgaatttcaaatttacaaaaagagtgggatacaggaggtggacagaacactcgccaaagaaggaatcaagaggggcgagacggatcatcacgcagtatcgcgcgggagcgctaagctgcggtggttcgtggagagaaatttagtcaccccagaaggaaaagttgtggaccttggctgcggtcgtgggggatggtcctattactgtggcggtctgaagaacgtcaaagaggtgaagggcctcactaaagggggacctggccatgaagaacccattcctatgtctacatatgggtggaatctagtaaggctgcagtcaggagtggatgttttctttaccagcccagaaaagtgcgacactttgctgtgtgatatcggcgagtccagtcccaaccctacagtggaggccggtcggaccctccgcgtccttaatctggtggaaaactggttgaataacaatacgcaattctgcattaaggtcctgaacccatacatgccctctgtgatcgagaaaatggaagccctccagcgaaagtacgggggagcgttagttagaaatccgctgagcaggaactcaacccacgagatgtattgggtatccaacgctagtggcaatatagtgagctctgtcaacatgatctcccggatgcttattaatcgctttacaatgagacacaaaaaggcaacttacgaacctgacgtggatctgggctcagggaccaggaacatcggaattgagagcgagacaccaaatctagacatcataggtaaacgaattgaaaagatcaagcaggagcatgaaacttcgtggcactatgatcaggaccatccctacaaaacctgggcctatcacggctcttacgagacaaagcaaaccgggagtgcttccagcatggttaacggagtggtccggctcctgactaaaccttgggacgtgatcccaatggtaacgcagatggccatgacagataccactcccttcggccagcagcgtgtgtttaaggaaaaagttgacaccagaacacaagagccgaaggagggtacgaagaaattgatgaagattaccgcagaatggctgtggaaagagctcgggaagaaaaagactcctcgcatgtgtacaagggaagagttcacccggaaagtcagatcaaatgccgctcttggagcgatatttactgatgagaacaagtggaagtccgcccgcgaagcagtggaggactctggcttctgggaactggtggataaagagaggaatttacacctggaaggcaagtgcgagacatgtgtctataacatgatggggaaacgagagaagaaattgggagaatttggtaaggctaagggcagccgggccatctggtacatgtggctcggggcaagattcctggagtttgaagccctaggattccttaatgaggaccattggtttagtagggaaaactccctgagcggcgttgagggtgaggggctccacaaactgggatacattttgcgcgatgtgtctaagaaagaaggcggcgctatgtatgccgacgataccgcggggtgggacacacgtatcactctggaggatctcaagaatgaagagatggtaaccaaccatatggaaggagagcacaagaaacttgcagaggccattttcaaactgacgtaccagaataaagtggtccgggtgcagagacccaccccaaggggtacagttatggacatcatatcacgccgagaccagcggggcagtgggcaagtggtcacttatggattaaacaccttcacaaacatggaagctcagctgatcagacagatggagggcgaaggtgtgtttaagtccattcaacagttgactgtaaaagaggagatcgccgttaagaattggctcattagggtggggcgcgaaagactgagccggatggcaatctctggagatgactgcgtcgtgaaacctctagatgacaggttcgcttcggcccttaccgctctgaacgatatgggcaaggtgcgtaaggacattcagcagtgggagccctcacgaggctggaatgattggacgcaagtcccattttgcagccatcacttccacgaactcataatgaaagacgggcgcgttctggtggtaccctgtagaaaccaggatgagttgatcggacgggccaggatttcccagggtgcaggctggagtttacgcgaaacagcgtgcctggggaagtcttacgcccagatgtggagcctcatgtattttcatagacgggaccttaggctggctgccaatgcaatctgttccgctgtgccttcacactggatcccaaccagtcgaactacatggtctattcatgccacccacgagtggatgactaccgaggatatgctaacagtctggaaccgtgtgtggatacaagaaaatccgtggatggaggacaaaacgcccgttgaaagctgggaggaaatcccttacctgggaaagagagaggatcagtggtgcggctccctcattggtttgacctcacgcgcaacttgggccaaaaacatccagacagcgattaatcaggtgcggagcctgatcgggaacgaggaatataccgactacatgccatctatgaagaggttcagacgcgaggaagaggaagctggagtcctttggtga

SEQ ID NO: 14314 - RNA, 9876 nt, synthetic construct
  misc_feature 1..9876: note = derived and/or modified CDS sequence (opt3) from DENV-2__KX380814__SS-prME
  source 1..9876: mol_type = other RNA
accgccggcatcattataatgatgatccccacagtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcacgctcagaccccagcctaccgagctgaagtacagctggaaagcctggggcaaggcaaagatgctttccactgaattgcacaatcatacattcctgatcgatgggccagagaccgcggaatgcccgaacacaaatagggcttggaactcactcgaggtcgaggactatggatttggcgtgttcactaccaatatatggctgaaattaaaggaacgtcaagatgtattttgtgacagtaaactgatgtctgccgcaatcaaggacaaccgggccgtgcacgctgatatgggttactggattgagagcgcccttaacgacacgtggaaaatcgaaaaggcatccttcattgaggtcaagtcatgccactggcccaaaagccatacattgtggtctaatggggtgctcgagtccgaaatgatcatacctaagaacttcgctggaccagttagtcagcacaattatcgacccggctaccatacccagactgccggtccttggcacctgggcagactagagatggattttgacttctgtgaagggaccacagtggtagtcactgaggattgcggaaacaggggcccaagcctgcgcaccacaacggcgtctgggaaactcattaccgaatggtgctgtcggtcctgcactctgcccccgcttagatacaggggagaggacggctgttggtatggtatggagatccgccctttgaaggaaaaagaggaaaatctggtgaactcattagtgacagccgggcatggacagatcgataattttagtctcggcgtcctgggtatggctcttttcctggaggaaatgttgcgaacccgggttggcactaagcacgcaattctcctggtggccgttagctttgtgacactaatcaccgggaacatgtcgttccgtgacctgggaagagtcatggtgatggttggcgctacgatgactgatgacattgggatgggagtgacctacctcgccctgcttgcagcgtttaagataaggccaacattcgccgctggcttgctgttacgcaaactcacctccaaggagctgatgatgactacaatcggtattgtccttctgtctcaaagcaccatccccgagtcaattctagaactcacagatgccctggcattggggatgatggtgctgaaaatcgttcggaatatggagaagtatcagttagctgtgactataatggccatcctctgcgtccctaacgcagtaattctgcagaatgcctggaaagtgagttgtaccacgcttgctgttgtgtccgtctctcccctgttgctcacaagctcccaacagaaggcggactggatcccactggccctaaccattaagggactgaaccctactgcaatctttcttaccacactctcaagaactagcaaaaagaggagttggcccctgaatgaagctataatggccgtgggcatggtatctattttggcctccagcctgctaaagaacgatatcccaatgaccggcccgctcgtggctgggggactgcttacggtctgctacgttctgacaggtcgatcggcagacttggagctcgaacgcgccgcggacgtgcggtgggaggagcaggctgaaatctcaggctctagtcctattctgtccataaccatcagcgaggatgggtctatgagcattaagaatgaagaggaggaacagactctaacaatcctgattagaaccggacttctcgtgatctccggcctgttccccgtctcaataccaatcactgccgcagcctggtatttgtgggaggtgaaaaagcaaagggctggtgttttatgggacgtacccagtcctccacccgtggggaaagcagaactggaggatggagcctaccgtattaagcagaagggcatcctcggctatagccagattggggcgggagtctacaaagaaggtacatttcacaccatgtggcatgtgacgcgcggcgctgttctgatgcacaaggggaaacggatcgagccttcttgggccgacgtgaagaaagatcttatatcctacggaggcggttggaagctggagggggaatggaaggagggagaagaggtccaggtgttggcactagaaccgggcaaaaacccaagagccgtacaaactaagcccggcctgttcaaaaccaacacagggaccattggagctgtctcactcgactttagtcctggtacaagcggctccccaatcgtggataagaaagggaaggttgtgggactgtatggcaatggtgtcgtgactaggtctgggacctacgtttcggccatcgcacagacggaaaagagcattgaggacaaccccgaaatcgaggatgacatattccggaaaaagagacttacaattatggatttacatcctggagctggcaaaactaagcgctatctgccggccatcgtgagagaagcgattaaaaggggcctccggaccttgatcctggcccccacacgagtcgtggcagctgagatggaagaggccctcagagggctgccaatacgctaccagacccctgctattagggcagagcacactggacgtgaaatcgtagaccttatgtgtcatgccaccttcacaatgcggctgttgtcacccatcagagtgccaaattataacctaattatcatggatgaggcccactttacggaccctgcttccattgcggcaaggggttacataagtactcgcgttgaaatgggcgaggccgctgggatcttcatgaccgccacacccccaggatctcgagacccgtttcctcagagcaatgcacccattatggatgaggaaaaggagatcccagaaagatcctggaactcaggccacgagtgggtcaccgacttcaagggtaaaactgtgtggtttgtgccctctatcaaggccgggaatgatattgctgcgtgcctgcggaaaaacggaaagaaagtcatacaactcagcaggaagacattcgacagtgaatatatcaagacccgcacgaatgattgggactttgtagtgactacagatatttccgagatgggcgccaacttcaaagcagagcgtgttatcgaccctagacggtgtatgaagccagtgattttaaccgatggcgaagagagggtcatcctggctgggcccatgcctgtgacccatagctctgccgcacagcgccgaggaagagttggtcggaatccgaaaaacgaaaatgaccagtacatatacatgggcgagccacttgaaaacgatgaggactgcgcccactggaaggaggctaaaatgctgctcgacaatatcaacactcccgaagggattatcccttcaatgtttgagcccgaaagggagaaggtggatgccattgacggagaatatcgcttgagaggcgaggcgaggaaaacattcgtcgatctgatgcggcgtggtgacctcccagtgtggctggcataccgcgtagccgctgaggggatcaactatgccgatcgaagatggtgttttgacggcgtgaagaataaccaaatacttgaagagaatgttgaagtcgagatttggaccaaggagggagaaaggaaaaagctaaaacctcggtggctggatgctcgcatctactccgaccccttggcattaaaggagttcaaagagttcgccgctggcagaaagagtctgacactcaacctgattactgagatggggaggcttccaacgtttatgacccagaaggccaaaaatgcactggataacctcgcggtgttgcatacagccgaagctggaggtcgggcctataatcacgcactgagcgagctacctgagactctggaaaccctccttctgttaacattgctggctaccgtgactggcgggatcttcctctttctgatgtcgggaaagggcataggtaaaatgacgcttgggatgtgctgcatcattaccgcctctatcctgctctggtacgcacagattcagccgcactggatcgccgcttccataattttggagttctttctgatcgtcttactaatccccgaaccagagaagcaacgaacacctcaggacaaccagctgacttatgttgtgattgcgatcctcaccgtagtggccgcaacaatggctaatgaaatgggcttccttgagaaaaccaagaaggattttggactgggcagcataactacacagcaacccgagtcaaacattttggacatcgatctgagaccagccagtgcctggacgctctacgcagtcgctaccactttcattacacctatgctgcgccattctatcgaaaattccagcgtgaacgtttcacttaccgccatagcgaatcaggctaccgtgctcatggggctgggaaaaggttggcccttgagtaagatggacatcggcgtcccgctgttagccattgggtgttacagccaggtaaacccaatcacactaactgcagccctgctccttctggtggctcactatgcaattatcggacctggcttgcaggccaaagcgacgagggaggctcaaaagcgggccgcagccggtattatgaaaaatcccaccgttgacgggatgacagtgatcgatctggacccaataccctacgatcctaagtttgaaaagcagctcggccaggtcatgctgcttgtgttatgcgtcactcaggtgctgatgatgcgtaccacatgggctctctgtgaggccttgaccctggcaactggaccgatttccacgctatgggaaggcaaccccgggagattctggaatacaaccatcgctgtttctatggccaacatctttaggggaagctatctggcgggcgccggtctccttttctccattatgaaaaacactgcaaatacccgccgggggacaggaaacactggcgagaccctgggtgagaagtggaaaaatcgattgaacgctctgggcaagtcagaatttcaaatatacaaaaagtctgggatccaggaggtggacagaacactcgccaaagaaggaattaagaggggcgagacggatcatcacgcagtaagtcgcgggtcggctaagctgcggtggttcgtggagagaaatttagtcaccccagaaggaaaagttgtggaccttggctgcggtcgtgggggatggagctattactgtggcggtctgaagaacgtcaaagaggtgaagggcctcactaaagggggacctggccatgaggaacccatccctatgtccacatatgggtggaatctagtaaggctgcagtctggagtggatgttttctttacctcaccagaaaagtgcgacactttgctgtgtgatattggcgagagctcccccaaccctacagtggaggccggtcggaccctccgcgtccttaatctggtggaaaactggttgaataacaatacgcaattctgcatcaaggtcctgaacccatacatgcccagtgtgatagagaaaatggaagccctccagcgaaagtacgggggagcgttagttagaaatccgctgtctaggaacagcacccacgagatgtattgggtatcaaacgcttccggcaatatcgtgagtagcgtcaacatgatttctcggatgcttatcaatcgctttacaatgagacacaaaaaggcaacttacgaacctgacgtggatctgggctccgggaccaggaacattggaatcgagtcagagacaccaaatctagacataattggtaaacgaatcgaaaagatcaagcaggagcatgaaactagctggcactatgatcaggaccatccctacaaaacctgggcctatcacggctcgtacgagacaaagcaaaccgggtctgctagttccatggttaacggagtggtccggctcctgactaaaccttgggacgtgattccaatggtaacgcagatggccatgacagataccactcccttcggccagcagcgtgtgtttaaggaaaaagttgacaccagaacacaagagccgaaggagggtacgaagaaattgatgaagataaccgcagaatggctgtggaaagagctcgggaagaaaaagactcctcgcatgtgtacaagggaagagttcacccggaaagtcagaagcaatgccgctcttggagcgatctttactgatgagaacaagtggaagtcagcccgcgaagcagtggaggactccggcttctgggaactggtggataaagagaggaatttacacctggaaggcaagtgcgagacatgtgtctataacatgatggggaaacgagagaagaaattgggagaatttggtaaggctaagggctctcgggccatttggtacatgtggctcggggcaagattcctggagtttgaagccctaggattccttaatgaggaccattggtttagcagggaaaacagtctgtccggcgttgagggtgaggggctccacaaactgggatacatcttgcgcgatgtgagcaagaaagaaggcggcgctatgtatgccgacgataccgcggggtgggacacacgtattactctggaggatctcaagaatgaagagatggtaaccaaccatatggaaggagagcacaagaaacttgcagaggccatcttcaaactgacgtaccagaataaagtggtccgggtgcagagacccaccccaaggggtacagttatggacataatctctcgccgagaccagcggggctcagggcaagtggtcacttatggattaaacaccttcacaaacatggaagctcagctgattagacagatggagggcgaaggtgtgtttaagagtatccaacagttgactgtaaaagaggagattgccgttaagaattggctcatcagggtggggcgcgaaagactgtcccggatggcaattagcggagatgactgcgtcgtgaaacctctagatgacaggttcgcttctgcccttaccgctctgaacgatatgggcaaggtgcgtaaggacatacagcagtgggagccctcgcgaggctggaatgattggacgcaagtcccattttgctcacatcacttccacgaactcatcatgaaagacgggcgcgttctggtggtaccctgtagaaaccaggatgagttgattggacgggccaggatcagccagggtgcaggctggtccttacgcgaaacagcgtgcctggggaagagttacgcccagatgtggtctctcatgtattttcatagacgggaccttaggctggctgccaatgcaatctgtagcgctgtgccttcccactggattccaacctcacgaactacatggagtatacatgccacccacgagtggatgactaccgaggatatgctaacagtctggaaccgtgtgtggatccaagaaaatccgtggatggaggacaaaacgcccgttgaatcttgggaggaaattccttacctgggaaagagagaggatcagtggtgcggcagcctcatcggtttgacctcccgcgcaacttgggccaaaaacattcagacagcgatcaatcaggtgcggtcactgatagggaacgaggaatataccgactacatgccaagcatgaagaggttcagacgcgaggaagaggaagctggagtcctttggtga

SEQ ID NO: 14315 - RNA, 9876 nt, synthetic construct
  misc_feature 1..9876: note = derived and/or modified CDS sequence (opt3) from DENV-2__KX380807__SS-prME
  source 1..9876: mol_type = other RNA
accgcaggaatcattataatgatgatccccactgtgatggctttccacctgactacgcgaaatggggagcctcatatgattgtcagcaggcaggaaaagggaaaatccctcctttttaagaccgagaatggtgttaacatgtgcactctgatggcaatggacttgggcgaattatgtgaggatactatcacctacaattgcccactgctacggcaaaacgaaccggaggacattgattgttggtgcaattctacctcaacctgggtgacttatgggacctgtaccgccacgggagagcaccgccgagaaaaacgtagtgtagcgctcgctccccatgtgggcatgggtctggagactcggaccgaaacatggatgagctccgagggggcctggaagcacgcacagaggatcgagatatgggtccttcggcatcctggattcactatcatggccgctattctggcatacaccatcggcacaacctattttcagcgcgtgttgattttcatcctcctgacggccgttgctccatctatgactatgagatgcataggcatttcgaacagggactttgtggaaggggtctcaggaggtagctgggtggatatcgtactggagcacggcagttgtgttacaaccatggccaaaaataagcccactctcgacttcgaattaattaagacagaggcgaaacaccctgcaaccctgcggaagtactgcatcgaagccaaacttacgaacaccacaactgcttcccgctgtccaacccagggggagccctctttgaatgaggaacaagataagcgatttgtgtgcaaacatagcatggtcgacagaggatggggcaacggttgtgggctgttcggaaagggcggcatcgtgacatgcgccatgtttacttgcaagaaaaatatggaggggaagattgtgcagcctgaaaacctagagtataccatagtcatcacaccacactccggagaagagaatgcagttggtaacgataccggcaaacatgggaaggagattaaagtgactccgcagtcaagtatcacggaagctgagctcacaggatacggcaccgtaactatggaatgtagccccaggaccggtctggacttcaatgagatggtgcttctgcagatggaaaacaaggcctggttggtccaccggcaatggtttctcgatctgcctttaccatggctgcccggggcggacacacagggctctaactggatacagaaagagaccctcgtgactttcaagaatcctcacgccaagaaacaggatgttgtggtccttggatcccaagagggcgcaatgcatacagctctgacgggggccaccgaaattcagatgtcaagcggaaacttgctatttactggtcacctgaagtgccgtctccgcatggacaaactgcagcttaagggcatgagttattctatgtgtacagggaaattcaaggtggtaaaggagatcgctgaaacccaacatggaacaatcgttattagagtgcagtacgagggcgacggttccccatgcaaaatccccttcgagattatggatctggaaaagaggcacgtcttggggcggctcataactgtgaatccgatcgtcaccgagaaagacagccctgtgaacattgaagccgagcccccatttggcgattcgtacatcatcattggagttgaacctggccagctgaagttatcttggttcaaaaaggggtcctcaataggacagatgtttgagacgaccatgcgaggtgcaaagcgcatggccatcctgggcgacacagcttgggatttcgggagtctaggaggcgtgtttactagcattggtaaagcgctccatcaagtattcggggcaatctatggcgccgctttttccggagtctcttggaccatgaagattctgatcggcgtggttataacatggatcgggatgaatagcagatcaacaagtctttccgtgagcttggtcctggtgggagtagtgaccctctacctgggcgttatggtccaggccgactctggttgtgtggtgtcatggaaaaacaaggagcttaaatgcgggagtggaattttcatcacggataatgtccacacatggaccgaacagtataagtttcagcccgagagcccatccaagctggcatctgccattcaaaaagctcacgaagagggcatctgtggtataaggtcggttactcggttggaaaacctcatgtggaagcagattacacccgagctgaatcatatcttaagcgagaacgaagtgaaactgaccattatgactggcgacatcaaggggataatgcaggccggaaaacgctccctaagacctcagccaaccgagctcaagtactcatggaaagcatggggcaaggcgaagatgctgagtacagaacttcacaatcatacgttcttgatcgatgggccggagaccgctgaatgccccaacactaatagggcctggaactctctggaggtggaggactatggatttggcgtattcacaaccaatatttggctcaaactgaaggaacgtcaagatgtcttttgtgacagcaaattaatgtccgcagccatcaaggacaaccgggctgtgcacgccgatatgggttactggattgagtcagcactgaacgacacatggaaaatcgaaaaggctagcttcatagaggttaagtcttgccactggcctaaatcccatactctttggagtaatggggtgttggagagcgaaatgattatcccaaagaacttcgccggacccgtctctcagcacaattatcgacctggctaccatacccagacggcgggtccatggcacctcggcagactggagatggattttgacttctgtgaagggacaaccgtggttgtgactgaggattgcggaaacaggggcccctccctacgcaccacaactgcctcagggaaactgatcaccgaatggtgctgtcggagttgcacactcccgcctctgagatacaggggagaggacggctgttggtatggtatggagattcgcccacttaaggaaaaagaggaaaatttggtaaacagcctggtcacggctgggcatggacagatcgataatttttcgttaggcgtgctcggtatggcactgttccttgaggaaatgctgcgaacccgggtgggcactaagcacgccattttgctcgtcgctgtttcctttgtgacactgataaccgggaacatgtctttccgtgacctaggaagagtaatggtgatggtcggcgccactatgacagataatatcgggatgggagtgacctacctggcactcctggcggcctttaaggttaggcccacgttcgctgccggccttttgctgcgcaaattaactagcaaggagctcatgatgaccacaattggtatcgtgctgctttcacaaagtaccattcctgagactatcctggaactaacagacgcactcgctctggggatgatggtcttgaaaatagtgcggaacatggagaagtatcagctggccgttaccatcatggcaattttatgcgtgcccaatgccgtcatcctccagaacgcttggaaagtatcctgtacaattctggcggtggtttctgtgagcccacttctgttgacttcctcacaacagaaggccgattggatccctctcgcactgaccataaagggactaaatcccacggctatttttctgacaacccttagcagaacaagtaaaaagaggtcttggccactcaacgaagccatcatggccgtcggcatggtgtccatcctggctagctcgttgctgaaaaatgacattccgatgaccggccctttagtagcagggggactcctgacagtgtgctacgtccttactggtcgatcagccgatctggagttggaacgcgcggctgacgttcggtgggaggagcaggccgaaatatctggcagttcccccatcctcagcattaccatctctgaggacgggagcatgtccattaagaacgaagaggaggaacagacgctgacaatcctaataagaaccggactgcttgtgatctcaggcctcttcccagtgagtattcccatcactgcagccgcttggtatctgtgggaggtcaaaaagcaaagggccggtgtgttgtgggatgttcctagcccaccccctgtagggaaagccgaattagaggacggagcgtaccgtattaagcagaagggcatcctgggctattctcagataggggctggagtgtacaaagaaggtacatttcacaccatgtggcatgtcactcgcggcgccgtgctcatgcacaaggggaaacggattgagccgtcctgggcagatgttaagaaagacctgatctcatacggaggcggttggaaacttgagggggaatggaaggagggagaagaggtgcaggtcctggccttggaaccaggcaaaaaccccagagctgtgcaaacaaagcctggcctattcaaaaccaatacggggactatcggagccgtaagtctggattttagcccaggtacctccggctctcccattgtcgacaagaaagggaaggtggttggactctatggcaacggtgtggtcacaaggtcggggacctacgtgagcgcaatcgctcagacagagaagtcaatagaggataatcctgaaattgaggacgatatcttcagaaagaagcggctgactattatggaccttcatccgggagccggcaaaaccaagcgctatttacccgcgatcgttagagaagccataaaaaggggcctgcggacgctcattttggcaccaacacgagtggtcgctgccgagatggaagaggctctgagagggctccctatccgctaccagactcccgcaatcagggccgagcacaccggacgtgaaattgtggatctgatgtgtcatgccacattcaccatgcggcttctgtccccaatcagagtacctaactataatttgattataatggacgaggctcactttactgatcccgcgagtatcgcagccaggggttacatttctacccgcgtggaaatgggcgaggctgccgggatcttcatgacagcaacgccaccgggaagccgagacccttttccccagtccaacgccccaatcatggacgaggaaagagagattcccgaacggtcatggaactctggccacgagtgggttactgatttcaagggtaagaccgtctggtttgtgcctagcataaaagctgggaacgacatcgcggcctgcctaaggaagaatggcaagaaggtgattcaactgagtcgcaaaacattcgattccgaatatatcaagacccgtactaacgactgggattttgtcgtaacaaccgacattagcgagatgggcgcaaatttcaaggctgagagagtgatcgatccacggaggtgtatgaaacccgttatactcacggacggcgaagaacgcgtgatcttagccgggcctatgccggtcactcattcttcagcagcccagcgaagaggacgggtgggtaggaacccaaagaatgaaaacgatcagtacatttacatgggcgagcccctggaaaatgacgaggattgcgctcactggaaagaggccaagatgcttctggacaacatcaacacacctgaagggattatcccctccatgtttgagccagaacgcgagaaagttgacgcggtggatggagaatatagactcaggggcgaggcacggaagaccttcgtcgacttgatgcgtcgcggtgatctgcctgtgtggctcgcctacaaagtagctgccgaggggataaattatgctgaccgaagatggtgttttgatggcgtgaagaacaatcaaattctggaagagaacgttgaagtcgagatctggaccaaggagggagaaaggaagaaacttaaaccccggtggctagacgcacgcatttacagtgatccactggccttgaaagagttcaaagagttcgctgccggcagaaagagcttaactctgaatctcatcacagagatggggaggctgcctacctttatgacacagaaggcacggaacgcgcttgacaatctggccgtgctccatactgctgaagccggaggtcgagcatataaccacgctttgtcggagctgccggagacgctagaaaccctgctccttctgacattattggccactgtgaccggcgggatattcctgtttctcatgtctggaaaaggcatcggtaagatgacactggggatgtgctgcattatcaccgcatccattcttctgtggtacgcccagatccagccccactggatagctgcgagcattatcctcgagttctttttgatcgtcctgttaattccagaacctgagaaacaaagaactccccaggataatcagctaacgtatgttgtgatcgccatactgaccgtagtggcagctacaatggccaacgaaatgggcttcctcgagaagactaaaaaggactttggacttggctcaattaccacacagcaaccagagagtaatatcctggatattgacttgcgccctgcctctgcatggaccctgtacgctgtcgccactacattcatcacgcccatgctcaggcattccatagaaaacagctcagtgaatgttagtctgaccgcgatcgctaaccaggccactgtgcttatggggctcggaaagggttggccgctgagcaaaatggatattggcgtcccattgctggcaatcgggtgttactcccaggtaaatcctattacattaaccgccgctctactgctccttgtggcacactatgccatcattggacccggcctgcaggcgaaggctacccgggaggcccaaaaacgtacagcagccggtatcatgaagataccagctgccttgattgttactgtgatcgacctggaccccatcccttacgatccgaaatttgaaaagcagctcgggcaggtcatgctgcttgtgttatgctctacgcaggtcctgatgatgagaaccacatgggcactctgtgaggctttgactctggccaccggccccattagcacactatgggaaggaaacccaggcaggttctggaataccactatagcggtgtccatggccaacatctttcgcgggtcatatctggcaggagctggcctccttttctctattatgaagaacacggccaatacacggcgaggtaccgggaacactggagagaccctgggcgagaaatggaagaatagattgaacgcactgggtaaaagtgaatttcaaatctacaagaaatcgggcattcaggaggttgacaggacactcgctaaggaagggatcaaacgcggagagactgatcatcacgccgtgagccggggctccgccaagctgagatggttcgtagagcgtaatttagtgacccctgaagggaaggtcgttgaccttggatgcggcaggggtgggtggtcttattactgtggaggcctgaaaaacgtgaaggaggtcaaaggtctcacaaagggcgggcccggacatgaagaacctataccaatgtcaacgtatggctggaatctagtgcggctgcagagcggggtagatgtgttctttacaccccctgaaaaatgcgacactttgctgtgtgatatcggagagtccagtccaaaccccacagttgaggcgggccgcaccctccgagtgcttactctggtcgaaaattggttgaacaataacacacaattctgcattaaggtgctgaatccgtacatgccttctgtcatcgagaagatggaagctctccagagaaaatacggtggggcattagtgaggaacccactgagcagaaattcaacccacgagatgtattgggtttccaacgccagtggaaacattgtaagctctgtgaatatgatctcccgcatgcttataaacagatttacgatgaggcacaagaaagctacctacgaacccgacgtcgatctgggctcaggcacacgaaatattgggatcgagagcgagactcctaacctagacatcattggaaagcggatagagaaaatcaagcaggagcatgaaacctcgtggcactatgatcaggaccatccatacaagacatgggcctatcacggttcttacgagactaaacaaaccggcagtgcatccagcatggtgaatggggttgtgcgtctcctgacaaagccctgggatgtcattccgatggtgacccagatggccatgactgacacgacacctttcggacagcagagagtatttaaagaaaaggtggacacccgcactcaagagcccaaagagggcaccaagaagttgatgaaaatcacagctgaatggctgtggaaggagctcggtaaaaagaaaacgccaaggatgtgtacccgggaagagttcactagaaaggttcgctcaaacgcggcccttggggcaatttttacagatgagaataaatggaagtccgctagggaagccgtcgaggactctggattctgggaactggtggataaggagcgaaacttacacctggaaggcaaatgcgagacctgtgtgtataatatgatgggcaagcgggagaaaaagttgggggaatttggaaaagcaaagggtagcagagccatctggtacatgtggctcggcgctaggttcctggagtttgaagccctagggttccttaacgaggaccattggtttagtcgcgaaaattccctgagcggagtcgagggcgagggtctccacaagctggggtacatattgcgtgatgtttctaaaaaggaaggaggcgcgatgtatgcagacgatactgccggctgggacacacggatcaccctggaggatctcaaaaacgaagagatggtgacaaatcatatggaaggggagcacaagaaacttgctgaggccattttcaagctgacttaccagaacaaggtagtgagagtccagaggcctacaccccgcggaacggtgatggacatcatttcacgacgggatcagagaggtagtggccaagttgtgacctatgggttaaatacattcactaacatggaagcacagctgatcaggcagatggagggagaaggcgtctttaaatccattcaacagttgaccgctacagaggagatagccgtgaagaactggctcgtacgcgttggtagagaacggctgagcaggatggctatctctggggacgactgcgtggtcaaaccactagatgaccgtttcgcctcggcacttactgcgctgaatgatatgggaaaggtgcgaaaagacattcagcagtgggagccctcacgcggctggaacgattggacccaagtgcctttttgcagccatcacttccacgaactcatcatgaaggacggcagagtcctggttgtgccatgtcggaatcaggatgagttgatcgggagggcccgcatttcccagggagctggttggagtttaagagaaacggcctgcctgggcaagtcttacgcacagatgtggagcctcatgtattttcatcggagggaccttcgactggctgccaacgcaatatgttccgccgtaccgtcacactgggtgcccacaagtcgtaccacttggtctatccatgcgacacacgagtggatgaccactgaggatatgctaaccgtctggaatagagtgtggattcaagaaaacccttggatggaggacaaaacaccagttgaaagctgggaggaaatcccctacctggggaagcgcgaggatcagtggtgcggatccctcattggcttgacgtcacgggctacctgggccaaaaatatccagactgcaataaaccaggtgaggagcctgatcggtaatgaggaatatacagactacatgccttctatgaagagattccgccgggaggaagaggaagccggggtcctttggtga

SEQ ID NO: 14316 - RNA, 9876 nt, synthetic construct
  misc_feature 1..9876: note = derived and/or modified CDS sequence (opt3) from DENV-2__KX380815__SS-prME
  source 1..9876: mol_type = other RNA
accgcaggaatcattataatgatgatccccaccgtgatggctttccacctgactacgcgaaatggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtggccccatctatgacaatgagatgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaacaccctgcgacgctgcggaagtactgcattgaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaagatcgtccagcctgaaaacctagagtatacaattgttataaccccacactccggagaagagaatgccgtgggtaacgatactggcaaacatgggaaggagatcaaagtaacgccgcagtcaagtattacagaagcagagctcaccggatacggcactgtgaccatggaatgtagccccaggacaggtctggacttcaatgagatggtccttctgcagatggaaaacaaggcttggttggtgcaccggcaatggtttctcgatctgcctttaccatggctgcccggggccgacacccagggctctaactggatccagaaagagactctcgttacattcaagaatcctcacgcgaagaaacaggatgtggtcgtgcttggatcccaagagggcgccatgcatacggcactgaccggggctactgaaatacagatgtcaagcggaaacttgctatttacaggtcacctgaagtgccgtctccgcatggacaaactgcagcttaagggcatgagttattctatgtgtaccgggaaattcaaggtagttaaggagattgccgaaacacaacatggaactatcgtgatcagagtccagtacgagggcgacggttccccatgcaaaattcccttcgagatcatggatctggaaaagaggcacgtgttggggcggctcattaccgtcaatccgatagtgacggagaaagacagccctgttaacatcgaagctgagcccccatttggcgattcgtacattatcatcggagtggaacctggccagctgaagttatcttggttcaaaaaggggtcctcaattggacagatgtttgagaccacaatgcgaggtgccaagcgcatggcaatactgggcgacactgcctgggatttcgggagtctaggaggcgtatttaccagcatcggtaaagctctccatcaagtcttcggggcgatttatggcgcagccttttccggagtgtcttggacaatgaagatcctgattggcgttgtgatcacttggatagggatgaatagcagatcaaccagtctttccgtcagcttggtgctggtaggagtggttacgctctacctgggcgtcatggtgcaggctgactctggttgtgtggtctcatggaaaaacaaggagcttaaatgcgggagtggaatcttcattacagataatgttcacacctggactgaacagtataagtttcagcccgagagcccatccaagctggcctctgcaatccaaaaagcccacgaagagggcatttgtggtatcaggtcggtgacacggttggaaaacctcatgtggaagcagataacccccgagctgaatcatattttaactgagaacgaagtgaaactgaccatcatgacaggcgacattaaggggatcatgcaggctggaaaacgcagcctaagacctcagccaacggagctcaagtactcctggaaagcctggggcaaggcaaagatgctgtcaaccgaacttcacaatcatactttcttgatagatgggccggagacagcggaatgccccaacaccaatagggcttggaacagtctggaggtagaggactatggatttggcgtcttcacaactaatatctggctcaaactgaaggaacgtcaagatgtgtcttgtgacagcaaattaatgtccgccgcaattaaggacaaccgggccgttcacgctgatatgggttactggatcgagtcagccctgaacgacacctggaaaattgaaaaggccagctttatcgaggtgaagtcttgccactggcctaaatcccatacgctttggagtaatggggtcttggagagcgaaatgataattccaaagaacttcgctggacccgtgtctcagcacaattatcgacctggctaccatacacagaccgccggtccatggcacctcggcagactggagatggatttcgacttttgtgaagggactaccgttgtggtaacagaggattgcggaaacaggggcccctccctacgcactaccacagcgtcagggaaactgatcacggaatggtgctgtcggagttgcaccctcccgcctctgagatacaggggagaggacggctgttggtatggtatggagatccgcccacttaaggaaaaagaggaaaatttggtcaacagcctggtgactgccgggcatggacagattgataatttctcgttaggcgtgctcggtatggctctgtttcttgaggaaatgctgcgaacacgggtcggcaccaagcacgcaatcttgctcgttgccgtgtccttcgtaactctgattacagggaacatgtcttttcgtgacctaggaagagtgatggtcatggtgggcgctaccatgacggatgacatagggatgggagttacttacctggccctcctggcagcgttcaaggtgaggcccacctttgccgctggccttttgctgcgcaaattaacaagcaaggagctcatgatgaccactatcggtattgtcctgctttcacaaagtacaatccctgagaccattctggaactaacagatgccctcgcactggggatgatggtgttgaaaatcgttcggaatatggagaagtatcagctggctgtgactataatggccatcttatgcgtccccaacgcagtaattctccagaatgcctggaaagtgtcctgtaccacgctggctgttgtgtctgtcagcccacttctgttgacatcctcacaacagaagaccgactggatccctctcgcgctgactattaagggactaaaccccaccgccatcttcctgacaactcttagcagaaccagtaaaaagaggtcttggccactcaatgaagcaataatggctgtgggcatggtatccattctggccagctcgtttttgaaaaacgatatcccgatgacgggccctctggtggccgggggattactcacagtctgctacgttctgaccggtcgatcagctgaccttgagctggaacgcgcagccgacatccggtgggaggagcaggcggaaatttctggcagttcccccatattgagcatcactatttctgaggatgggagcatgtccatcaagaatgaagaggaggaacagacactcaccattctgatcagaactggactactggtgatatcaggccttttcccagtgagtatccccattacagctgccgcatggtatctctgggaggtcaaaaagcaaagggccggtgtgctgtgggacgttcctagcccaccccctgtagggaaagctgaattggaggatggagcataccgtatcaagcagaagggcattttaggctattctcagatcggggccggagtgtacaaagaaggtacctttcacacgatgtggcatgtcactcgcggcgcggtgctgatgcacaaggggaaacggatagagccgtcctgggctgacgttaagaaagatctcatttcatacggaggcggttggaagctggagggggaatggaaggagggagaagaggtgcaggtccttgccctggaaccaggcaaaaaccccagagcagtgcaaaccaagcctggcttgttcaaaacaaacaccgggacaatcggagccgtaagtctagactttagcccaggtacttccggctctcccatcgtcgataagaaagggaaggtggttggactgtatggcaatggtgtggtcaccaggtcggggacgtacgtgagcgctattgcccagacagagaagaacatcgaggacaatcctgaaatagaggatgacattttccggaaaaagagactcactatcatggatctgcatccgggagcaggcaaaaccaagcgctatcttcccgctattgttagagaagccatcaaaaggggcttacggacactgatactcgcgccaacccgagtggtcgccgcagagatggaagaggctttgagagggctgcctattcgctaccagactcccgccatcagggctgagcacaccggacgtgaaatcgtggacctcatgtgtcatgcaacattcacgatgcggctgctttcaccaattagagtacctaactataatctgatcattatggatgaggcccactttactgaccccgcctccatagctgcgaggggttacatcagtacccgcgtggaaatgggcgaggcagccgggattttcatgacagctaccccaccgggatctcgagacccttttccccagagcaacgccccaatcatggatgaggaaagagagatccccgaacggtcctggaactcaggccacgagtgggttactgacttcaagggtaagacagtctggtttgtgccttctattaaagcagggaacgatatagccgcttgcttgaggaagaatggcaaaaaggtgatccaactaagccgcaaaaccttcgacagtgaatatgtcaagacgcgtactaacgattgggactttgtagtgacaaccgatatttccgagatgggcgcgaatttcaaggccgagagagttatcgacccacggaggtgtatgaaacccgtgattctgaccgatggcgaagaacgcgtcatcctcgcagggcctatgccggtgactcatagctctgctgcccagcgaagaggacgggttggtaggaacccaaagaatgaaaacgaccagtacatatacatgggcgagcccttagaaaatgatgaggactgcgcacactggaaagaggccaagatgctgcttgacaacatcaacacacctgaagggattatcccctcaatgtttgagccagaacgcgagaaagtggatgctattgacggagaatatagactgaggggcgaggcccggaagaccttcgtcgatctcatgcgtcgcggtgacttgcctgtgtggctggcgtaccgagtagcagccgaggggatcaattatgctgatagaaggtggtgttttgacggcgtgaaaaacaatcaaatactcgaagagaacgttgaagtcgagatttggacaaaggagggagaacggaagaaactgaagccccgctggcttgatgccagaatctactccgacccactagctctgaaagagttcaaggagttcgcagccggcaggaaaagtttgactttaaatctgattacggagatggggcggctccctacctttatgacacagaaggctcgaaacgccctggataatcttgcagtgctgcatactgcggaagccggaggtagagcttataaccacgccctcagcgagttgccggagaccctggaaacactactgctccttaccctgttagcaactgtgacgggcgggatcttcttgtttctgatgtcgggaaagggcataggtaaaatgaccctcgggatgtgctgcatcgtcacagcttctattctgctttggtacgcccagatccagccccactggattgcagcctccatcatactggagttctttctcattgttttgctgatcccagaacctgagaagcaacgcactccccaggacaatcagttaacctatgtggtaatcgctattctaacagtggtcgcggccaccatggcaaacgaaatgggcttcctggagaaaactaagaaagattttggactcggcagcatcacaacgcagcaaccagagtcaaatatacttgacattgatctgaggcctgctagtgcctggaccttgtacgccgtggcaactacattcatcacccccatgctgcggcattctattgaaaactccagcgttaatgtgtcactcaccgctatcgccaaccaggcgacagtcctgatggggcttggaaagggttggccgctcagtaagatggacataggcgtaccactgttggctatcgggtgttacagccaggtgaatcctattactctgacggccgcattactactgctcgttgcccactatgctatcattggacccggccttcaggcaaaagccacccgtgaggcgcaaaagagagctgccgcaggtatcatgaaaattccagccgctctgatcatgacagtgatagacttggatcccattccttacgacccgaagtttgaaaaacagctggggcaggtcatgctcctggtgctttgctccactcaggtcttaatgatgaggaccacatgggccctgtgtgaggcactcaccttggctactggccccatctctacgctgtgggaaggaaacccaggccgcttctggaatacaaccatcgccgtgagcatggcgaacatttttcgggggtcctatctagccggagcaggcctactcttctcaataatgaagaacactgctaatacccgaagaggtacagggaacactggagagacccttggcgagaagtggaaaaatcaactgaacgccttgggtaagtctgaatttcagatctacaaaaagagtggcattcaggaggttgataggacactggcaaaagaagggatcaagcgcggagagacggaccatcacgctgtgtcgcggggcagcgccaaactcagatggttcgtagagcgtaatctggtgacccctgaagggaaggtcgttgatttaggatgcggcaggggtgggtggtcctattactgtggaggccttaagaacgtgaaagaggtcaagggtctgactaaaggcgggcccggacatgaggaacctattccaatgtctacatatggctggaatctcgtgcggctacaatcaggggtagacgtgttctttacaccccctgaaaagtgcgatactctgttgtgtgacatcggagagagctccccaaaccccacagttgaggccggccgcaccctgcgagtgctcaatcttgtcgaaaactggctgaataacaatacgcagttctgcataaaagtgttgaacccgtacatgcctagtgtcatcgagaagatggaagcgctgcagagaaagtacggtggggctctcgtgaggaatccattatctcggaacagcacccacgagatgtattgggtttcaaacgcatccggaaatattgtaagtagcgtgaacatgatctctcgcatgctgattaatagatttacaatgaggcacaaaaaggccacttacgaacccgatgtcgaccttggctccggcacccgaaacatcgggatagagtcagaggtgcctaatctggatattatcggaaaacggatcgaaaagattaaacaggagcatgaaacaagctggcactatgaccaagatcatccatacaagacttgggcttatcacggttcgtacgagaccaagcagacaggctctgccagttccatggttaacggggtggtccgtctactcaccaaaccctgggacgtgataccgatggtaactcagatggcaatgacggacacaacccctttcggacagcaaagagtgtttaaggaaaaagttgatactcgcacccaggagcccaaggagggcaccaaaaagctgatgaagatcacggccgaatggttgtggaaagagctgggtaagaaaaagaccccaaggatgtgtactcgggaagagttcacaagaaaagtccgcagcaatgctgcgctcggggccatttttaccgacgagaacaagtggaaatcagcaagggaagctgtggaggattccggattctgggaacttgtggacaaggagcgaaatctgcacttagaaggcaagtgcgagacttgtgtctataacatgatgggcaaacgggagaagaaactgggggaatttggaaaggccaaaggttctagagcaatctggtacatgtggttgggcgccaggttcctcgagtttgaagctctggggttcctaaatgaggatcattggtttagccgcgaaaacagtctttccggagttgagggcgagggtctgcacaagctcgggtacattctgcgtgacgtgagcaagaaagaaggaggcgccatgtatgcggatgacacagcaggctgggatacccggatcacattggaggacctgaagaatgaagagatggtaactaaccatatggaaggggagcacaaaaagctcgccgaggctatattcagacttacctaccagaataaagtggtcagggtgcagcgccctacgccccgaggaaccgttatggatatcatttctcggagagaccaaaggggttcaggccaggtggtcacatatgggctgaacactttcaccaacatggaagcccagttaatccgccaaatggagggagaaggcgtgtttaagagtattcagcatctgacagcaactgaggagatcgctgtaaagaattggttggttagagtgggtcgggaaaggctctcccgtatggccattagcggggacgattgcgtcgtgaaaccactggacgatcgattcgctaacgccctaaccgcacttaatgacatgggaaaggtgcgcaaagatatacagcagtgggagccctctagaggctggaacgactggacgcaagtccctttttgctcgcaccacttccatgaactgatcatgaaggatggccgggttctcgtggtaccatgtaggaatcaggacgagctgattgggcgcgcgagaatctcacagggagccggttggagcttgcgggaaacagcttgcttaggcaaatcctacgcccagatgtggagtctgatgtattttcacaggcgagatctccgtcttgcagctaacgccatctgttctgcagtgccgagccattgggtccccacctccagaactacatggtcaattcacgccacccacgagtggatgactaccgaggacatgctgacagtgtggaatcgcgtttggatacaagaaaacccttggatggaggataagacgccagtggaaagttgggaggaaatcccctacctagggaagcgggaggaccagtggtgcggatctctgattggcctcaccagcagggcgacttgggctaaaaatatccagacagccattaaccaggtcagatccttgatcggtaatgaggaatataccgattacatgccttcaatgaagcgcttccggagggaggaagaggaagcaggggtgctgtggtga

SEQ ID NO: 14317 - RNA, 9876 nt, synthetic construct
  misc_feature 1..9876: note = derived and/or modified CDS sequence (opt3) from DENV-2__KX380816__SS-prME
  source 1..9876: mol_type = other RNA
accgccggcatcattataatgatgatccccacagtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcacgctcagaccccagcctaccgagctgaagtacagctggaaagcctggggcaaggcaaagatgctttccactgaattgcacaatcatacattcctgatcgatgggccagagaccgcggaatgcccgaacacaaatagggcttggaactcactcgaggtcgaggactatggatttggcgtgttcactaccaatatatggctgaaattaaaggaacgtcaagatgtattttgtgacagtaaactgatgtctgccgcaatcaaggacaaccgggccgtgcacgctgatatgggttactggattgagagcgcccttaacgacacgtggaaaatcgaaaaggcatccttcattgaggtcaagtcatgccactggcccaaaagccatacattgtggtctaatggggtgctcgagtccgaaatgatcatacctaagaacttcgctggaccagttagtcagcacaattatcgacccggctaccatacccagactgccggtccttggcacctgggcagactagagatggattttgacttctgtgaagggaccacagtggtagtcactgaggattgcggaaacaggggcccaagcctgcgcaccacaacggcgtctgggaaactcattaccgaatggtgctgtcggtcctgcactctgcccccgcttagatacaggggagaggacggctgttggtatggtatggagatccgccctttgaaggaaaaagaggaaaatctggtgaactcattagtgacagccgggcatggacagatcgataattttagtctcggcgtcctgggtatggctcttttcctggaggaaatgttgcgaacccgggttggcactaagcacgcaattctcctggtggccgttagctttgtgacactaatcaccgggaacatgtcgttccgtgacctgggaagagtcatggtgatggttggcgctacgatgactgatgacattgggatgggagtgacctacctcgccctgcttgcagcgtttaagataaggccaacattcgccgctggcttgctgttacgcaaactcacctccaaggagctgatgatgactacaatcggtattgtccttctgtctcaaagcaccatccccgagtcaattctagaactcacagatgccctggcattggggatgatggtgctgaaaatcgttcggaatatggagaagtatcagttagctgtgactataatggccatcctctgcgtccctaacgcagtaattctgcagaatgcctggaaagtgagttgtaccacgcttgctgttgtgtccgtctctcccctgttgctcacaagctcccaacagaaggcggactggatcccactggccctaaccattaagggactgaaccctactgcaatctttcttaccacactctcaagaactagcaaaaagaggagttggcccctgaatgaagctataatggccgtgggcatggtatctattttggcctccagcctgctaaagaacgatatcccaatgaccggcccgctcgtggctgggggactgcttacggtctgctacgttctgacaggtcgatcggcagacttggagctcgaacgcgccgcggacgtgcggtgggaggagcaggctgaaatctcaggctctagtcctattctgtccataaccatcagcgaggatgggtctatgagcattaagaatgaagaggaggaacagactctaacaatcctgattagaaccggacttctcgtgatctccggcctgttccccgtctcaataccaatcactgccgcagcctggtatttgtgggaggtgaaaaagcaaagggctggtgttttatgggacgtacccagtcctccacccgtggggaaagcagaactggaggatggagcctaccgtattaagcagaagggcatcctcggctatagccagattggggcgggagtctacaaagaaggtacatttcacaccatgtggcatgtgacgcgcggcgctgttctgatgcacaaggggaaacggatcgagccttcttgggccgacgtgaagaaagatcttatatcctacggaggcggttggaagctggagggggaatggaaggagggagaagaggtccaggtgttggcactagaaccgggcaaaaacccaagagccgtacaaactaagcccggcctgttcaaaaccaacacagggaccattggagctgtctcactcgactttagtcctggtacaagcggctccccaatcgtggataagaaagggaaggttgtgggactgtatggcaatggtgtcgtgactaggtctgggacctacgtttcggccatcgcacagacggaaaagagcattgaggacaaccccgaaatcgaggatgacatattccggaaaaagagacttacaattatggatttacatcctggagctggcaaaactaagcgctatctgccggccatcgtgagagaagcgattaaaaggggcctccggaccttgatcctggcccccacacgagtcgtggcagctgagatggaagaggccctcagagggctgccaatacgctaccagacccctgctattagggcagagcacactggacgtgaaatcgtagaccttatgtgtcatgccaccttcacaatgcggctgttgtcacccatcagagtgccaaattataacctaattatcatggatgaggcccactttacggaccctgcttccattgcggcaaggggttacataagtactcgcgttgaaatgggcgaggccgctgggatcttcatgaccgccacacccccaggatctcgagacccgtttcctcagagcaatgcacccattatggatgaggaaaaggagatcccagaaagatcctggaactcaggccacgagtgggtcaccgacttcaagggtaaaactgtgtggtttgtgccctctatcaaggccgggaatgatattgctgcgtgcctgcggaaaaacggaaagaaagtcatacaactcagcaggaagacattcgacagtgaatatatcaagacccgcacgaatgattgggactttgtagtgactacagatatttccgagatgggcgccaacttcaaagcagagcgtgttatcgaccctagacggtgtatgaagccagtgattttaaccgatggcgaagagagggtcatcctggctgggcccatgcctgtgacccatagctctgccgcacagcgccgaggaagagttggtcggaatccgaaaaacgaaaatgaccagtacatatacatgggcgagccacttgaaaacgatgaggactgcgcccactggaaggaggctaaaatgctgctcgacaatatcaacactcccgaagggattatcccttcaatgtttgagcccgaaagggagaaggtggatgccattgacggagaatatcgcttgagaggcgaggcgaggaaaacattcgtcgatctgatgcggcgtggtgacctcccagtgtggctggcataccgcgtagccgctgaggggatcaactatgccgatcgaagatggtgttttgacggcgtgaagaataaccaaatacttgaagagaatgttgaagtcgagatttggaccaaggagggagaaaggaaaaagctaaaacctcggtggctggatgctcgcatctactccgaccccttggcattaaaggagttcaaagagttcgccgctggcagaaagagtctgacactcaacctgattactgagatggggaggcttccaacgtttatgacccagaaggccaaaaatgcactggataacctcgcggtgttgcatacagccgaagctggaggtcgggcctataatcacgcactgagcgagctacctgagactctggaaaccctccttctgttaacattgctggctaccgtgactggcgggatcttcctctttctgatgtcgggaaagggcataggtaaaatgacgcttgggatgtgctgcatcattaccgcctctatcctgctctggcacgcacagattcagccgcattggatcgccgcttccataattttggagttctttctgatcgtcttactaatccccgaaccagagaagcaacgaacacctcaggacaaccagctgacttacgttgtgattgcgatcctcaccgtagtggccgcaacaatggctaatgaaatgggcttccttgagaaaaccaagaaggattttggactgggcagcataactacacagcaacccgagtcaaacattttggacatcgatctgagaccagccagtgcctggacgctctatgcagtcgctaccactttcattacacctatgctgcgccactctatcgaaaattccagcgtgaacgtttcacttaccgccatagcgaatcaggctaccgtgctcatggggctgggaaaaggttggcccttgagtaagatggacatcggcgtcccgctgttagccattgggtgttacagccaggtaaacccaatcacactaactgcagccctgctccttctggtggctcattacgcaattatcggacctggcttgcaggccaaagcgacgagggaggctcaaaagcgggccgcagccggtattatgaaaaatcccaccgttgacgggatgacagtgatcgatctggacccaataccctatgatcctaagtttgaaaagcagctcggccaggtcatgctgcttgtgttatgcgtcactcaggtgctgatgatgcgtaccacatgggctctctgtgaggccttgaccctggcaactggaccgatttccacgctatgggaaggcaaccccgggagattctggaatacaaccatcgctgtttctatggccaacatctttaggggaagctacctggcgggcgccggtctccttttctccattatgaaaaacactgcaaatacccgccgggggacaggaaacactggcgagaccctgggtgagaagtggaaaaatcgattgaacgctctgggcaagtcagaatttcaaatatataaaaagtctgggatccaggaggtggacagaacactcgccaaagaaggaattaagaggggcgagacggatcaccatgcagtaagtcgcgggtcggctaagctgcggtggttcgtggagagaaatttagtcaccccagaaggaaaagttgtggaccttggctgcggtcgtgggggatggagctactattgtggcggtctgaagaacgtcaaagaggtgaagggcctcactaaagggggacctggccacgaggaacccatccctatgtccacatacgggtggaatctagtaaggctgcagtctggagtggatgttttctttacctcaccagaaaagtgcgacactttgctgtgtgatattggcgagagctcccccaaccctacagtggaggccggtcggaccctccgcgtccttaatctggtggaaaactggttgaataacaatacgcaattctgcatcaaggtcctgaacccatatatgcccagtgtgatagagaaaatggaagccctccagcgaaagtacgggggagcgttagttagaaatccgctgtctaggaacagcacccacgagatgtactgggtatcaaacgcttccggcaatatcgtgagtagcgtcaacatgatttctcggatgcttatcaatcgctttacaatgagacataaaaaggcaacttatgaacctgacgtggatctgggctccgggaccaggaacattggaatcgagtcagagacaccaaatctagacataattggtaaacgaatcgaaaagatcaagcaggagcacgaaactagctggcattacgatcaggaccacccctataaaacctgggcctaccacggctcgtatgagacaaagcaaaccgggtctgctagttccatggttaacggagtggtccggctcctgactaaaccttgggacgtgattccaatggtaacgcagatggccatgacagataccactcccttcggccagcagcgtgtgtttaaggaaaaagttgacaccagaacacaagagccgaaggagggtacgaagaaattgatgaagataaccgcagaatggctgtggaaagagctcgggaagaaaaagactcctcgcatgtgtacaagggaagagttcacccggaaagtcagaagcaatgccgctcttggagcgatctttactgatgagaacaagtggaagtcagcccgcgaagcagtggaggactccggcttctgggaactggtggataaagagaggaatttacatctggaaggcaagtgcgagacatgtgtctacaacatgatggggaaacgagagaagaaattgggagaatttggtaaggctaagggctctcgggccatttggtatatgtggctcggggcaagattcctggagtttgaagccctaggattccttaatgaggaccactggtttagcagggaaaacagtctgtccggcgttgagggtgaggggctccataaactgggatacatcttgcgcgatgtgagcaagaaagaaggcggcgctatgtacgccgacgataccgcggggtgggacacacgtattactctggaggatctcaagaatgaagagatggtaaccaaccacatggaaggagagcataagaaacttgcagaggccatcttcaaactgacgtatcagaataaagtggtccgggtgcagagacccaccccaaggggtacagttatggacataatctctcgccgagaccagcggggctcagggcaagtggtcacttacggattaaacaccttcacaaacatggaagctcagctgattagacagatggagggcgaaggtgtgtttaagagtatccaacagttgactgtaaaagaggagattgccgttaagaattggctcatcagggtggggcgcgaaagactgtcccggatggcaattagcggagatgactgcgtcgtgaaacctctagatgacaggttcgcttctgcccttaccgctctgaacgatatgggcaaggtgcgtaaggacatacagcagtgggagccctcgcgaggctggaatgattggacgcaagtcccattttgctcacaccacttccatgaactcatcatgaaagacgggcgcgttctggtggtaccctgtagaaaccaggatgagttgattggacgggccaggatcagccagggtgcaggctggtccttacgcgaaacagcgtgcctggggaagagttatgcccagatgtggtctctcatgtactttcacagacgggaccttaggctggctgccaatgcaatctgtagcgctgtgccttcccattggattccaacctcacgaactacatggagtatacacgccacccacgagtggatgactaccgaggatatgctaacagtctggaaccgtgtgtggatccaagaaaatccgtggatggaggacaaaacgcccgttgaatcttgggaggaaattccttatctgggaaagagagaggatcagtggtgcggcagcctcatcggtttgacctcccgcgcaacttgggccaaaaacattcagacagcgatcaatcaggtgcggtcactgatagggaacgaggaatacaccgactatatgccaagcatgaagaggttcagacgcgaggaagaggaagctggagtcctttggtga

SEQ ID NO: 14318 - RNA, 9876 nt, synthetic construct
  misc_feature 1..9876: note = derived and/or modified CDS sequence (opt3) from DENV-2__KX380817__SS-prME
  source 1..9876: mol_type = other RNA
accgccggaatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactaggaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaaatcacgccacagtcaagtattacagaagcagagctgaccggatacggcactgtgaccatggaatgtagcccgaggacaggtcttgacttcaatgagatggtcctgttgcagatggaaaacaaggcttggctcgtgcaccggcaatggtttctggatttacccctgccttggctcccaggggccgacacccagggctctaactggatccagaaagagactcttgttacattcaagaatccccacgcgaagaaacaggatgtggtcgtgctgggatcccaagagggcgccatgcatacggcattgaccggggctactgaaatacagatgtcaagcggaaacctactgtttacaggtcacctcaagtgccgtctgcgcatggacaaacttcagctgaagggcatgagttattctatgtgtaccgggaaattcaaggtagttaaggagattgccgaaacacaacatggaactatcgtgatcagagtccagtacgagggcgacggttccccttgcaaaattccattcgagatcatggatttggaaaagaggcacgtgctcgggcggctgattaccgtcaatcccatagtgacggagaaagacagcccggttaacatcgaagctgagcctccctttggcgattcgtacattatcatcggagtggaaccaggccagttaaagctgtcttggttcaaaaaggggtcctcaattggacagatgtttgagaccacaatgcgaggtgccaagcgcatggcaatactaggcgacactgcctgggatttcgggagtctcggaggcgtatttaccagcatcggtaaagctctgcatcaagtcttcggggcgatttatggcgcagccttttccggagtgtcttggacaatgaagatccttattggcgttgtgatcacttggatagggatgaatagcagatcaaccagtttgtccgtcagcctggtgctcgtaggagtggttacgctgtaccttggcgtcatggtgcaggctgactctggttgtgtggtctcatggaaaaacaaggagctgaaatgcgggagtggaatcttcattacagataatgttcacacctggactgaacagtataagtttcagcctgagagcccctccaagttggcctctgcaatccaaaaagcccacgaagagggcatttgtggtatcaggtcggtgacacggctcgaaaacctgatgtggaagcagataaccccagagttaaatcatattctgactgagaacgaagtgaaactaaccatcatgacaggcgacattaaggggatcatgcaggctggaaaacgcagcctcagaccccagcctacggagctgaagtactcctggaaagcctggggcaaggcaaagatgctttcaaccgaattgcacaatcatactttcctgatagatgggccagagacagcggaatgcccgaacaccaatagggcttggaacagtctcgaggtagaggactatggatttggcgtcttcacaactaatatctggctgaaattaaaggaacgtcaagatgtgttttgtgactctaaactgatgagcgccgcaattaaggacaaccgggccgttcacgctgatatgggttactggatcgagtccgcccttaacgacacctggaaaattgaaaaggcatcattcatcgaggtgaagtcctgccactggcccaaatctcatacgttgtggtccaatggggtcctcgagagtgaaatgataattcctaagaacttcgctggaccagtgagccagcacaattatcgacccggctaccatacacagaccgccggtccttggcacctgggcagactagagatggattttgacttctgtgaagggactaccgttgtggtaacagaggattgcggaaacaggggcccatctctgcgcactaccacagcgtccgggaaactcatcacggaatggtgctgtcggtcatgcaccctgcccccgcttagatacaggggagaggacggctgttggtatggtatggagatccgccctttgaaggaaaaagaggaaaatctggtcaacagtttagtgactgccgggcatggacagattgataattttagcctcggcgtgctgggtatggctcttttcctggaggaaatgttgcgaacacgggtcggcaccaagcacgcaatcctcctggttgccgtgtcgtttgtaactctaattacagggaacatgtccttccgtgacctgggaagagtgatggtcatggtgggcgctaccatgacggatgacatagggatgggagttacttacctcgccctgcttgcagcgtttaaggtgaggccaaccttcgccgctggcttgctgttacgcaaactcacatctaaggagctgatgatgaccactatcggtattgtccttctgagccaatcaacaatccccgagagtattctagaactcaccgatgccctggcattggggatgatggtgctgaaaatcgttcggaatatggagaagtatcagttagctgtgacaataatggccatctcctgcgtccctaacgcagtaattctccagaatgcctggaaagtgtcttgtactaccctggctgttgtgagcgtcagcccccttctgttgacgtcaagccaacagaaggcggactggatcccactcgccctgacaattaagggactaaaccctaccgcaatctttctgactacccttagtagaacatctaaaaagaggtcctggcccctcaatgaagctataatggccgtgggcatggtaagcattctggcctcgtcattgctgaaaaacgatatcccaatgactggcccgttagtggctgggggactcctgaccgtctgctacgttcttacgggtcgatctgcagacctggagttggaacgcgccgcggacgtgcggtgggaggagcaggctgaaatcagtggctccagccctattctctctataacaatcagcgaggatgggtccatgtcaattaagaatgaagaggaggaacagaccctgactatcctaattagaacaggactgcttgtgatcagtggcctcttccccgtcagcataccaatcaccgccgcagcctggtatctgtgggaggtgaaaaagcaaagggctggtgttttgtgggacgtaccctctcctccacccgtggggaaagcagaattagaggatggagcctaccgtattaagcagaagggcatcctgggctattcccagattggggcgggagtctacaaagaaggtacttttcacacaatgtggcatgtgacccgcggcgctgttctcatgcacaaggggaaacggatcgagccttcatgggccgacgtgaagaaagatctgataagttacggaggcggttggaaacttgagggggaatggaaggagggagaagaggtccaggtgctggcattggaaccgggcaaaaacccaagagccgtacaaacgaagcccggcctattcaaaactaacaccgggacaattggagctgtcagcctggacttttcccctggtacctctggctcgccaatcgtggataagaaagggaaggttgtgggactctatggcaatggtgtcgtgacaaggagcgggacttacgtttcagccatcgcacagaccgagaagtccattgaggacaaccccgaaatcgaggatgacatattcagaaagaagcggctgacgattatggatcttcatcctggagctggcaaaacaaagcgctatttaccggccatcgtgagagaagcgattaaaaggggcctgcggactctcatcttggcccccacccgagtcgtggcagctgagatggaagaggccctgagagggctcccaatacgctaccagacccctgctattagggcagagcacaccggacgtgaaatcgtagacctgatgtgtcatgccactttcaccatgcggcttctgagtcccatcagagtgccaaattataacttgattatcatggatgaggcccactttacagaccctgcttctattgcggcaaggggttacataagcacgcgcgttgaaatgggcgaggccgctgggatcttcatgactgccacacccccaggatcccgagacccgtttcctcagtcaaatgcacccattatggatgaggaaagagagatcccagaacggtcttggaacagcggccacgagtgggtcacagacttcaagggtaagaccgtgtggtttgtgcccagtatcaaagccgggaatgatattgctgcgtgcctaaggaagaacggcaagaaggtcatacaactgtcccgcaaaactttcgacagcgaatatatcaagacacgtaccaatgattgggactttgtagtgacgactgatatttctgagatgggcgccaacttcaaggcagagagagttatcgaccctcggaggtgtatgaaaccagtgattctcacagatggcgaagaacgcgtcatcttagctgggcccatgcctgtgacccattcatccgccgcacagcgaagaggacgggttggtaggaatccgaagaacgaaaatgaccagtacatatacatgggcgagccactggaaaacgatgaggactgcgcccactggaaagaggctaagatgcttctggacaatatcaacacccccgaagggattatccctagtatgtttgagcccgaacgcgagaaagtggatgccattgacggagaatatagactcaggggcgaggcgcggaagactttcgtcgatttgatgcgtcgcggtgacctgccagtgtggctcgcataccgagtagccgctgaggggatcaactatgccgatagaaggtggtgttttgacggcgtgaaaaataaccaaatactggaagagaatgttgaagtcgagatttggacaaaggagggagaacggaagaaacttaagcctcgctggctagatgctagaatctacagcgaccccctggcattgaaagagttcaaggagttcgccgctggcaggaaatcgttaaccctgaacctcattacagagatggggcggctgccaacttttatgacgcagaaggccaagaatgcacttgataacctggcggtgctccataccgccgaagctggaggtcgagcctataatcacgcattgtctgagctgcctgagacactagaaactctgctccttctgaccttattggctacagtgaccggcgggatcttcctgtttctcatgtccggaaaaggcataggtaagatgactctggggatgtgctgcatcattacggccagcatccttctgtggtacgcacagattcagccgcactggatcgccgcttcaataattctcgagttctttttgatcgtcctgttaatccccgaaccagagaaacaaagaacccctcaggacaaccagctaacatatgttgtgattgcgatcctgactgtagtggccgcaaccatggctaatgaaatgggcttcctcgagaagaccaaaaaggattttggacttggcagtataaccactcagcaacccgagtctaacattctggacatcgatttgcgcccagcctccgcctggacactgtacgcagtcgctacgaccttcattactcctatgctcaggcatagcatcgaaaattcaagtgtgaacgttagcctgacagccatagcgaatcaggctaccgtgcttatggggctcggaaagggttggcccctgtccaaaatggacatcggcgtcccgttgctggccattgggtgttactctcaggtaaacccaatcaccttaacagcagccctactgctccttgtggctcactatgcaattatcggacctggcctgcaggccaaggcgactcgggaggctcaaaaacgtgccgcagccggtattatgaagaatcccacggttgacgggatgaccgtgatcgatttggacccaataccctacgatcctaaatttgaaaagcagctgggccaggtcatgctcctggtgctttgcgtcacacaggtgttaatgatgagaactacctgggctctgtgtgaggccctcacattggcaaccggaccgattagcactctgtgggaaggcaaccccgggaggttctggaatacgacaatcgctgtttccatggccaacatctttcgcggatcatatctagcgggcgccggtctactcttctctattatgaagaacaccgcaaatactcggcgagggaccggaaacacaggcgagactcttggtgagaaatggaagaatagactgaacgctttgggcaaaagtgaatttcaaatatacaagaaatcggggatccaggaggtggacaggaccctggccaaggaaggaattaaacgcggcgagacagatcatcacgcagtaagccgggggtccgctaagctcagatggttcgtggagcgtaatctggtcacgccagaaggaaaggttgtggacttaggctgcggtagagggggatggtcttattactgtggcggtcttaaaaacgtcaaggaggtgaaaggcctgaccaaagggggacctggccatgaagaacccatccctatgtcaacttatgggtggaatctcgtacggctacagagcggagtggatgttttctttacaccacccgaaaaatgcgacaccctgttgtgtgatattggcgagtccagtcctaacccaactgtggaggccggtcgcacactgcgagtcctcaatcttgtggaaaactggctgaataacaatacccaattctgcatcaaggtcttgaacccctacatgccgtctgtgatagagaagatggaagccctgcagagaaaatacgggggagcgctcgttaggaatcctttaagccggaactcaacgcacgagatgtattgggtatccaacgctagtggcaatatcgtgagctctgtcaacatgatttcccgcatgctgatcaatagatttaccatgaggcacaagaaagcaacatacgaaccagacgtggatcttggctcagggactcgaaacattggaatcgagagcgagacccccaatctggacataattggtaagcggatcgagaaaatcaagcaggagcatgaaacatcgtggcactatgatcaggaccatccttacaagacttgggcctatcacggctcttacgagaccaaacaaacagggagtgcttccagcatggttaacggagtggtccgtctactcaccaagccatgggacgtgattcccatggtaactcagatggccatgacggatacaaccccgttcggccagcagagagtgtttaaagaaaaggttgacactcgcacccaagagcctaaagagggtacaaagaagctgatgaaaataacggcagaatggttgtggaaggagctggggaaaaagaaaacccccaggatgtgtactcgggaagagttcacaagaaaggtccgctcaaatgccgctctcggagcgatctttaccgatgagaacaaatggaagtccgccagggaagcagtggaggactctggcttctgggaacttgtggatcgagagcggaatctgcacttagaaggcaagtgcgagacttgtgtctataacatgatggggaaaagagagaagaaactgggagaatttggtaaggctaaaggcagcagggccatttggtacatgtggttgggggcacgcttcctcgagtttgaagccctgggattcctaaatgaggaccattggtttagtcgtgaaaactcccttagcggcgttgagggtgaggggctgcacaagctcggatacatcctgcgggatgtgtctaagaaagaaggcggcgctatgtatgccgacgatacagcggggtgggacaccagaattacattggaggatctgaagaatgaagagatggtaactaaccatatggaaggagagcacaaaaagctcgcagaggccatcttcaaacttacctaccagaataaggtggtcagggtgcagcgcccaacgcctcgaggtaccgttatggacataatctcacggagagaccagaggggcagtgggcaagtggtcacatatggactgaacactttcaccaacatggaagctcagttaattcgccagatggagggcgaaggtgtgtttaagtccatccaacagctgacagtaaaagaggagattgccgttaagaattggttgatcagagtggggcgggaaaggctcagccgtatggcaatttctggagatgactgcgtcgtgaaacccctggatgaccgattcgcttcggccctaactgctcttaacgatatgggcaaggtgcgcaaagacatacagcagtgggagccatcaagaggctggaatgattggacccaagtccccttttgcagccatcacttccacgaactgatcatgaaggacgggcgggttctcgtggtaccttgtaggaaccaggatgagctgattggacgcgccagaatctcccagggtgcaggctggagtttgcgggaaacggcgtgcttagggaagtcttacgcccagatgtggagcctgatgtattttcataggcgagacctccgtcttgctgccaatgcaatctgttccgctgtgccatcacactggattccgacaagtagaaccacttggtctatacatgccacacacgagtggatgaccactgaggatatgctgaccgtctggaaccgcgtgtggatccaagaaaatccctggatggaggacaaaacacctgttgaaagctgggaggaaattccatacctaggaaagcgggaggatcagtggtgcggctccctgatcggtctcacgtcaagggcaacctgggccaaaaacattcagactgcgatcaatcaggtgcgcagcttgatagggaacgaggaatatacagactacatgccctctatgaagcgattccggagggaggaagaggaagctggagtcctgtggtga

SEQ ID NO: 14319 - RNA, 9876 nt, synthetic construct
  misc_feature 1..9876: note = derived and/or modified CDS sequence (opt3) from DENV-2__KX380818__SS-prME
  source 1..9876: mol_type = other RNA
accgcaggaatcattataatgatgatccccaccgtgatggctttccacctgactacgagaaatggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactcggaccgaaacatggatgagctccgagggggcttggaagcacgcccagaggatcgagacttgggtgcttcggcatcctggattcaccataatggcagccatcctggcttacacaattggcaccacgtattttcagcgcgttttgatcttcattctcctgactgcagtggccccatctatgacaatgagatgcatcggcatatcgaacagggactttgtcgaaggggtgtcaggaggtagctgggtagatattgttctggagcacggcagttgtgtgaccactatggctaaaaataagcccacactcgacttcgaattaatcaagaccgaggccaaacaccctgcgacgctgcggaagtactgcattgaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaagatcgtccagcctgaaaacctagagtatacaattgttataaccccacactccggagaagagaatgccgtgggtaacgatactggcaaacatgggaaggagatcaaagtaacgccgcagtcaagtattacagaagcagagctcaccggatacggcactgtgaccatggaatgtagccccaggacaggtctggacttcaatgagatggtccttctgcagatggaaaacaaggcttggttggtgcaccggcaatggtttctcgatctgcctttaccatggctgcccggggccgacacccagggctctaactggatccagaaagagactctcgttacattcaagaatcctcacgcgaagaaacaggatgtggtcgtgcttggatcccaagagggcgccatgcatacggcactgaccggggctactgaaatacagatgtcaagcggaaacttgctatttacaggtcacctgaagtgccgtctccgcatggacaaactgcagcttaagggcatgagttattctatgtgtaccgggaaattcaaggtagttaaggagattgccgaaacacaacatggaactatcgtgatcagagtccagtacgagggcgacggttccccatgcaaaattcccttcgagatcatggatctggaaaagaggcacgtgttggggcggctcattaccgtcaatccgatagtgacggagaaagacagccctgttaacatcgaagctgagcccccatttggcgattcgtacattatcatcggagtggaacctggccagctgaagttatcttggttcaaaaaggggtcctcaattggacagatgtttgagaccacaatgcgaggtgccaagcgcatggcaatactgggcgacactgcctgggatttcgggagtctaggaggcgtatttaccagcatcggtaaagctctccatcaagtcttcggggcgatttatggcgcagccttttccggagtgtcttggacaatgaagatcctgattggcgttgtgatcacttggatagggatgaatagcagatcaaccagtctttccgtcagcttggtgctggtaggagtggttacgctctacctgggcgtcatggtgcaggctgactctggttgtgtggtctcatggaaaaacaaggagcttaaatgcgggagtggaatcttcattacagataatgttcacacctggactgaacagtataagtttcagcccgagagcccatccaagctggcctctgcaatccaaaaagcccacgaagagggcatttgtggtatcaggtcggtgacacggttggaaaacctcatgtggaagcagataacccccgagctgaatcatattttaactgagaacgaagtgaaactgaccatcatgacaggcgacattaaggggatcatgcaggctggaaaacgcagcctaagacctcagccaacggagctcaagtactcctggaaagcctggggcaaggcaaagatgctgtcaaccgaacttcacaatcatactttcttgatagatgggccggagacagcggaatgccccaacaccaatagggcttggaacagtctggaggtagaggactatggatttggcgtcttcacaactaatatctggctcaaactgaaggaacgtcaagatgtgtcttgtgacagcaaattaatgtccgccgcaattaaggacaaccgggccgttcacgctgatatgggttactggatcgagtcagccctgaacgacacctggaaaattgaaaaggccagctttatcgaggtgaagtcttgccactggcctaaatcccatacgctttggagtaatggggtcttggagagcgaaatgataattccaaagaacttcgctggacccgtgtctcagcacaattatcgacctggctaccatacacagaccgccggtccatggcacctcggcagactggagatggatttcgacttttgtgaagggactaccgttgtggtaacagaggattgcggaaacaggggcccctccctacgcactaccacagcgtcagggaaactgatcacggaatggtgctgtcggagttgcaccctcccgcctctgagatacaggggagaggacggctgttggtatggtatggagatccgcccacttaaggaaaaagaggaaaatttggtcaacagcctggtgactgccgggcatggacagattgataatttctcgttaggcgtgctcggtatggctctgtttcttgaggaaatgctgcgaacacgggtcggcaccaagcacgcaatcttgctcgttgccgtgtccttcgtaactctgattacagggaacatgtcttttcgtgacctaggaagagtgatggtcatggtgggcgctaccatgacggatgacatagggatgggagttacttacctggccctcctggcagcgttcaaggtgaggcccacctttgccgctggccttttgctgcgcaaattaacaagcaaggagctcatgatgaccactatcggtattgtcctgctttcacaaagtacaatccctgagaccattctggaactaacagatgccctcgcactggggatgatggtgttgaaaatcgttcggaatatggagaagtatcagctggctgtgactataatggccatcttatgcgtccccaacgcagtaattctccagaatgcctggaaagtgtcctgtaccacgctggctgttgtgtctgtcagcccacttctgttgacatcctcacaacagaagaccgactggatccctctcgcgctgactattaagggactaaaccccaccgccatcttcctgacaactcttagcagaaccagtaaaaagaggtcttggccactcaatgaagcaataatggctgtgggcatggtatccattctggccagctcgtttttgaaaaacgatatcccgatgacgggccctctggtggccgggggattactcacagtctgctacgttctgaccggtcgatcagctgaccttgagctggaacgcgcagccgacatccggtgggaggagcaggcggaaatttctggcagttcccccatattgagcatcactatttctgaggatgggagcatgtccatcaagaatgaagaggaggaacagacactcaccattctgatcagaactggactactggtgatatcaggccttttcccagtgagtatccccattacagctgccgcatggtatctctgggaggtcaaaaagcaaagggccggtgtgctgtgggacgttcctagcccaccccctgtagggaaagctgaattggaggatggagcataccgtatcaagcagaagggcattttaggctattctcagatcggggccggagtgtacaaagaaggtacctttcacacgatgtggcatgtcactcgcggcgcggtgctgatgcacaaggggaaacggatagagccgtcctgggctgacgttaagaaagatctcatttcatacggaggcggttggaagctggagggggaatggaaggagggagaagaggtgcaggtccttgccctggaaccaggcaaaaaccccagagcagtgcaaaccaagcctggcttgttcaaaacaaacaccgggacaatcggagccgtaagtctagactttagcccaggtacttccggctctcccatcgtcgataagaaagggaaggtggttggactgtatggcaatggtgtggtcaccaggtcggggacgtacgtgagcgctattgcccagacagagaagaacatcgaggacaatcctgaaatagaggatgacattttccggaaaaagagactcactatcatggatctgcatccgggagcaggcaaaaccaagcgctatcttcccgctattgttagagaagccatcaaaaggggcttacggacactgatactcgcgccaacccgagtggtcgccgcagagatggaagaggctttgagagggctgcctattcgctaccagactcccgccatcagggctgagcacaccggacgtgaaatcgtggacctcatgtgtcatgcaacattcacgatgcggctgctttcaccaattagagtacctaactataatctgatcattatggatgaggcccactttactgaccccgcctccatagctgcgaggggttacatcagtacccgcgtggaaatgggcgaggcagccgggattttcatgacagctaccccaccgggatctcgagacccttttccccagagcaacgccccaatcatggatgaggaaagagagatccccgaacggtcctggaactcaggccacgagtgggttactgacttcaagggtaagacagtctggtttgtgccttctattaaagcagggaacgatatagccgcttgcttgaggaagaatggcaaaaaggtgatccaactaagccgcaaaaccttcgacagtgaatatgtcaagacgcgtactaacgattgggactttgtagtgacaaccgatatttccgagatgggcgcgaatttcaaggccgagagagttatcgacccacggaggtgtatgaaacccgtgattctgaccgatggcgaagaacgcgtcatcctcgcagggcctatgccggtgactcatagctctgctgcccagcgaagaggacgggttggtaggaacccaaagaatgaaaacgaccagtacatatacatgggcgagcccttagaaaatgatgaggactgcgcacactggaaagaggccaagatgctgcttgacaacatcaacacacctgaagggattatcccctcaatgtttgagccagaacgcgagaaagtggatgctattgacggagaatatagactgaggggcgaggcccggaagaccttcgtcgatctcatgcgtcgcggtgacttgcctgtgtggctggcgtaccgagtagcagccgaggggatcaattatgctgatagaaggtggtgttttgacggcgtgaaaaacaatcaaatactcgaagagaacgttgaagtcgagatttggacaaaggagggagaacggaagaaactgaagccccgctggcttgatgccagaatctactccgacccactagctctgaaagagttcaaggagttcgcagccggcaggaaaagtttgactttaaatctgattacggagatggggcggctccctacctttatgacacagaaggctcgaaacgccctggataatcttgcagtgctgcatactgcggaagccggaggtagagcttataaccacgccctcagcgagttgccggagaccctggaaacactactgctccttaccctgttagcaactgtgacgggcgggatcttcttgtttctgatgtcgggaaagggcataggtaaaatgaccctcgggatgtgctgcatcgtcacagcttctattctgctttggtacgcccagatccagccccactggattgcagcctccatcatactggagttctttctcattgttttgctgatcccagaacctgagaagcaacgcactccccaggacaatcagttaacctatgtggtaatcgctattctaacagtggtcgcggccaccatggcaaacgaaatgggcttcctggagaaaactaagaaagattttggactcggcagcatcacaacgcagcaaccagagtcaaatatacttgacattgatctgaggcctgctagtgcctggaccttgtacgccgtggcaactacattcatcacccccatgctgcggcattctattgaaaactccagcgttaatgtgtcactcaccgctatcgccaaccaggcgacagtcctgatggggcttggaaagggttggccgctcagtaagatggacataggcgtaccactgttggctatcgggtgttacagccaggtgaatcctattactctgacggccgcattactactgctcgttgcccactatgctatcattggacccggccttcaggcaaaagccacccgtgaggcgcaaaagagagctgccgcaggtatcatgaaaattccagccgctgacatcgggagggtgatagatctggaccccattccttacgatccgaagtttgaaaaacagttgggccaggtcatgctgctcgtgctgtgcgtcacacaggtgcttatgatgcgcactacctgggccttatgtgaggcactgacactcgctaccggacccatctccactttgtgggaaggcaacccagggcggttctggaatacgacaatcgccgtttctatggcgaacatttttcgaggaagctatctggccggcgcaggtctactgttctccataatgaagaacaccgctaatactagaagggggaccggaaacacaggcgagactctcggtgagaagtggaaaaatcaacttaacgccctgggcaagtcagaatttcagatctacaaaaagtctgggattcaggaggtggaccgcaccttggcaaaagaaggaatcaagcggggcgagacagatcatcacgctgtaagtagagggtcggccaaactgcgttggttcgtggagaggaatctcgtcacgcctgaaggaaaggttgtggacctgggctgcggtagagggggatggagctattactgtggcggtttaaagaacgtcaaagaggtgaagggccttaccaaagggggacccggccatgaggaacctattccaatgtccacttatgggtggaatctggtacgcctccaatctggagtggatgttttctttacaccccctgaaaagtgcgacaccctactgtgtgatatcggcgagtcaagcccaaaccccactgtggaggccggtcgaacattgagagtcctgaatctcgtggaaaactggcttaataacaatacccagttctgcataaaagtcctgaacccgtacatgccttccgtgatcgagaagatggaagcgttgcagaggaagtacgggggagctctggttcggaatccactcagtcgcaactctacgcacgagatgtattgggtaagcaacgcatcaggcaatattgtgtccagtgtcaacatgatcagcagaatgttaattaataggtttaccatgcgacacaaaaaggccacatacgaacccgacgtggatctgggctctgggactcggaacatcggaatagagtccgaggttcctaatcttgacattatcggtaaacgtatcgaaaagattaaacaggagcatgaaacctcatggcactatgatcaagaccatccatacaagacatgggcttatcacggcagctacgagactaagcagaccgggtcggcctctagtatggtgaacggagtcgtgagactgctaacaaaaccctgggacgtaataccgatggtgacccagatggcaatgactgatacgacacctttcggccagcaacgcgtttttaaggaaaaagtcgacaccaggactcaggagcccaaggagggtaccaaaaagctcatgaagatcacagccgaatggctgtggaaagagttggggaagaaaaagacgccacggatgtgtaccagagaagagttcactcgcaaagtgaggtccaatgctgcgctgggagccatttttacagatgagaacaagtggaaaagcgcacgagaagctgtggaggactcaggcttctgggaactcgtcgataaggagcggaatcttcacctggaaggcaagtgcgagacctgtgtttataacatgatggggaaaagagagaagaaattaggagaatttggtaaggccaaaggctccagggcaatctggtacatgtggctgggggcccgcttcttggagtttgaagctctcggattcctgaatgaggaccattggttttctcgtgaaaacagcctaagtggcgtggagggtgaggggcttcacaagctgggatacattctccgggatgtatccaagaaagaaggcggcgccatgtatgcggacgatactgcagggtgggacacaagaatcaccctggaggatttgaagaatgaagagatggtgacaaaccatatggaaggagagcacaaaaagctggccgaggctatattcaggctcacttaccagaataaagtcgtgcgcgttcagcgacctacaccccggggtacggtgatggacatcattagcagaagggaccaacgcggctctgggcaggtcgtgacctatggacttaacacattcactaacatggaagcccagctgatcagacaaatggagggcgaaggtgtatttaagtcaattcagcatttaaccgcaacagaggagatcgctgttaagaattggctggtgcgggtcgggagggaacgtttgagtcgaatggccatttccggagatgactgcgtggtgaaaccactcgatgaccgcttcgctaacgccctgactgcactaaatgatatgggcaaggtcagaaaagacatacagcagtgggagcccagccggggctggaacgattggacccaagttcctttttgctctcaccacttccatgaacttatcatgaaggacgggagggtgctggtagtgccatgtcgcaatcaggatgagctcattggacgagcgcggatctcgcagggtgccggctggtcactgagggaaacggcttgcttggggaaaagctacgcccagatgtggtccttaatgtattttcaccgacgtgacctgagactcgcagctaacgccatctgtagtgcagtcccgtctcattgggtgcccacaagccgcaccacttggtccattcacgccacacacgagtggatgaccactgaggatatgcttaccgtttggaatcgggtgtggatacaagaaaacccttggatggaggacaagacaccagtcgaatcatgggaggaaatcccctacctgggaaagagggaggatcagtggtgcggcagtctaattggtctgacgtctagagcgacctgggctaaaaatatccagactgccattaaccaggtgcgcagcctcatcgggaatgaggaatatacagactacatgccttccatgaagcggttcaggcgagaggaagaggaagcaggagtattgtggtga

SEQ ID NO: 14320 - RNA, 9876 nt, synthetic construct
  misc_feature 1..9876: note = derived and/or modified CDS sequence (opt3) from DENV-2__KX380819__SS-prME
  source 1..9876: mol_type = other RNA
accgcaggaatcattataatgatgatccccacagtgatggctttccacctgactacgcgaaacggggaacctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgcaacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccgttatggcagccatactggcttacacaatcggcaccacgtattttcagcgcgtgttgattttcatcctcctgactgcagtcgccccatctatgacaatgagatgcattggcatctcgaacagggactttgtggaagggatatcaggaggtagctgggtagatattgttctggagcacggcagttgtgtgaccactatggctaaaaataagcccacactcgacttcgaattaatcaagaccgaggccaaacaccctgcgacgctgcggaagtactgcattgaagcaaaacttaccaacacaactaccgcctcccgctgtccaacacagggggagccctctttgaatgaggaacaagataagcgatttgtctgcaaacatagcatggtggacagaggatggggcaacggttgtgggctgttcggaaagggcggcatcgtgacttgcgctatgtttacctgcaagaaaaatatggaggggaagatcgtccagcctgaaaacctagagtatacaattgttataaccccacactccggagaagagaatgccgtgggtaacgatactggcaaacatgggaaggagatcaaagtaacgccgcagtcaagtattacagaagcagagctcaccggatacggcactgctaccatggaatgtagccccaggacaggtctggacttcaatgagatggtgcttctgcagatggaaaacaaggcctggttggtccaccggcaatggtttctcgatctgcctttaccatggctgcccggggcggacacccagggctctaactggatccagaaagagactctcgtgacattcaagaatcctcacgccaagaaacaggatgttgtggtccttggatcccaagagggcgcaatgcatacggctctgaccggggccactgaaatacagatgtcaagcggaaacttgctatttacaggtcacctgaagtgccgtctccgcatggacaaactgcagcttaagggcatgagttattctatgtgtaccgggaaattcaaggtggtaaaggagattgctgaaacacaacatggaactatcgttatcagagtgcagtacgagggcgacggttccccatgcaaaattcccttcgagatcatggatctggaaaagaggcacgtcttggggcggctcattaccgtgaatccgatagtcacggagaaagacagccctgtgaacatcgaagccgagcccccatttggcgattcgtacattatcatcggagttgaacctggccagctgaagttatcttggttcaaaaaggggtcctcaattggacagatgtttgagaccacaatgcgaggtgcaaagcgcatggccatactgggcgacactgcttgggatttcgggagtctaggaggcgtgtttaccagcatcggtaaagcgctccatcaagtattcggggcaatttatggcgccgctttttccggagtctcttggacaatgaagatcctgattggcgtggttatcacttggatagggatgaatagcagatcaaccagtctttccgtgagcttggtcctggtgggaatcgtaacgctctacctgggcgtgatggttcaggccgactctggttgtgtcgtgtcatggaaaaacaaggagcttaaatgcgggagtggaattttcatcacagataatgtgcacacctggactgaacagtataagtttcagcccgagagcccatccaagctggcatctgccattcaaaaagctcacgaagagggcatctgtggtataaggtcggtcacacggttggaaaacctcatgtggaagcagattacccccgagctgaatcatatcttaagcgagaacgaagttaaactgactattatgaccggcgacatcaaggggataatgcaggccggaaaacgctccctaagacctcagccaacagagctcaagtactcatggaaagcatggggcaaggcgaagatgctgagtacggaacttcacaatcataccttcttgatcgatgggccggagactgctgaatgccccaacacaaatagggcctggaactctctggaggtggaggactatggatttggcgtgttcaccacaaatatttggctcaaactgaaggaacgtcaagatgtattttgtgacagcaaattaatgtccgcagccatcaaggacaaccgggctgtccacgccgatatgggttactggattgagtcagcactgaacgacacttggaaaatcgaaaaggctagcttcatagaggtgaagtcttgccactggcctaaatcccataccctttggagtaatggggttttggagagcgaaatgattatcccaaagaacttcgccggacccgtgtctcagcacaattatcgacctggctaccatacgcagacagcgggtccatggcacctcggcagactggagatggattttgacttctgtgaagggaccactgtcgtggttaccgaggattgcggaaacaggggcccctccctacgcacaactaccgcctcagggaaactgatcacagaatggtgctgtcggagttgcacgctcccgcctctgagatacaggggagaggacggctgttggtatggtatggagattcgcccacttaaggaaaaagaggaaaatttggtgaacagcctggtaaccgctgggcatggacagatcgataatttttcgttaggcgtcctcggtatggcactgttccttgaggaaatgctgcgaactcgggtgggcacaaagcacgccattttgctcgtggctgtctcctttgttaccctgataactgggaacatgtctttccgtgacctaggaagagtgatggtaatggtgggcgccacaatgaccgatgacatcgggatgggagtcacgtacctggcactcctggcggcctttaaggtgaggcccactttcgctgccggccttttgctgcgcaaattaaccagcaaggagctcatgatgacaaccattggtatcgttctgctttcacaaagtactattcctgagacaatcctggaactaaccgatgcactcgctctggggatgatggtgttgaaaatagtccggaatatggagaagtatcagctggccgtgacaatcatggcaattttatgcgttcccaacgccgtgatcctccagaatgcttggaaagtctcctgtactattctggcggtagtgtctgttagcccacttctgttgacctcctcacaacagaaggccgactggatccctctcgcactgacgataaagggactaaaccccacagctatttttctgaccactcttagcagaaccagtaaaaagaggtcttggccactcaatgaagccatcatggccgtgggcatggtctccatcctggctagctcgttgctgaaaaacgatattccgatgacaggccctttagtggcagggggactcctgactgtatgctacgtgcttaccggtcgatcagccgacctggagttggaacgcgcggctgacgtccggtgggaggagcaggccgaaatatctggcagttcccccatcctcagcattacgatctctgaggatgggagcatgtccattaagaatgaagaggaggaacagacactgaccatcctaataagaactggactgcttgttatctcaggcctcttcccagtgagtattcccatcacagcagccgcttggtatctgtgggaggtgaaaaagcaaagggccggtgtcttgtgggacgtgcctagcccaccccctgttgggaaagccgaattagaggatggagcgtaccgtattaagcagaagggcatcctgggctattctcagataggggctggagtatacaaagaaggtacctttcacactatgtggcatgtgacacgcggcgccgtcctcatgcacaaggggaaacggattgagccgtcctgggcagacgtgaagaaagatctgatctcatacggaggcggttggaaacttgagggggaatggaaggagggagaagaggttcaggtgctggccttggaaccaggcaaaaaccccagagctgtccaaaccaagcctggcctattcaaaacgaacactgggaccatcggagccgtgagtctggactttagcccaggtacatccggctctcccattgtagataagaaagggaaggtcgtgggactctatggcaatggtgttgtgaccaggtcggggacatacgtcagcgcaatcgctcagactgagaagtcaatagaggacaaccctgaaattgaggatgacatcttcagaaagaaacggctgaccattatggatcttcatccgggagccggcaaaacgaagcgctatttacccgcgatcgtgagagaagccataaaaaggggcctgcggacactcattttggcaccaactcgagttgtggctgccgagatggaagaggctctgagagggctccctatccgctaccagacccccgcaatcagggccgagcacacaggacgtgaaattgtcgacctgatgtgtcatgccaccttcactatgcggcttctgtccccaatcagagtgcctaattataacttgattataatggatgaggctcactttaccgaccccgcgagtatcgcagccaggggttacatttctacacgcgtagaaatgggcgaggctgccgggatcttcatgacggcaactccaccgggaagccgagacccttttccccagtccaatgccccaatcatggatgaggaaagagagattcccgaacggtcatggaactctggccacgagtgggtgaccgacttcaagggtaagacagtttggtttgtccctagcataaaagctgggaatgatatcgcggcctgcctaaggaagaacggcaagaaggtgattcaactgagtcgcaaaaccttcgactccgaatatatcaagactcgtacaaatgattgggactttgtggtcaccacggatattagcgagatgggcgcaaacttcaaggctgagagagtaatcgacccacggaggtgtatgaaacccgtgatactcactgatggcgaagaacgcgttatcttagccgggcctatgccggtgacacattcttcagcagcccagcgaagaggacgggtcggtaggaatccaaagaacgaaaatgaccagtacatttacatgggcgagcccctggaaaacgatgaggactgcgctcactggaaagaggccaagatgcttctggacaatatcaacacccctgaagggattatcccctccatgtttgagccagaacgcgagaaagtggatgcgatagacggagaatatagactcaggggcgaggcacggaagaccttcgttgatttgatgcgtcgcggtgacctgcctgtgtggctcgcctaccgagtcgctgccgaggggattaactatgctgatagaaggtggtgttttgacggcgtgaaaaataaccaaatcctggaagagaatgtagaagtggagatttggactaaggagggagaacggaagaaacttaagccccgctggctagatgcaagaatctacagtgacccactggccttgaaagagttcaaggagttcgctgccggcaggaagtcgttaacactgaacctcataaccgagatggggcggctgcctacatttatgactcagaaggcacgaaatgcgcttgataacctggccgttctccatacggctgaagccggaggtagagcatataatcacgctttgagcgagctgccggagaccctagaaacactgctccttctgactttattggccaccgtcacaggcgggatcttcctgtttctcatgtctggaaagggcattggtaaaatgaccctggggatgtgctgcatcattactgcatccatccttctgtggtacgcccagatacagccccactggattgctgcgagcatcatcctcgagttctttttgattgtgctgttaatcccagaacctgagaagcaacgcacgccccaggacaaccagctaacctatgtggtcatagccattctgacagttgtggcagctactatggccaatgaaatgggcttcctcgagaaaaccaagaaagattttggacttggctcaatcacaacccagcaaccagacagtaacattctggatatcgacttgaggcctgcctctgcatggactctgtacgctgtagccacaacgttcataacccccatgctccggcattccatcgagaatagctcagtgaacgtcagtctgactgcgattgctaatcaggccacagtgcttatggggctcggaaagggttggccgctgagcaagatggacatcggcgttccattgctggcaattgggtgttactcccaggtgaaccctatcaccttaaccgccgctctactgctccttgtcgcacactatgccattatcggacccggcctgcaggcgaaagctacacgtgaagcccaaaagagagcagccgctggtataatgaaaattccagccgcattgatcgggagggtaatcgatctggaccccattccttacgatccgaagtttgagaaacagctcggccaggtgatgctgcttgttttatgcgtgactcaggtcctgatgatgcgcacgacctgggctctctgtgaagccttgacactggcgactggacccatatctaccctatgggagggcaatccagggcggttctggaacacaaccatcgccgtgagcatggcaaatatttttcgaggatcctatctggctggcgccggtctccttttctcaatcatgaagaacactgcaaacacgagaagggggacaggaaataccggcgaaactctgggtgagaagtggaaaaaccgcttgaatgctctgggcaagtctgagtttcaaatttacaaaaagagtgggatccaggaagtcgaccggaccctcgccaaagagggaataaagagaggcgaaacagatcatcacgccgtgtcgcgtgggagcgcgaaactgaggtggttcgttgagcggaacttagtgactcctgagggaaaggtagtggaccttggctgcggtcgcgggggatggtcctattactgtggcggtctgaagaatgtcaaagaagttaagggcctcaccaaagggggacccggccatgaggaacctatcccaatgtctacatatgggtggaacctagtgcgactgcagtcaggagtcgatgtgttctttacgccccctgagaagtgcgacaccttgctgtgtgatattggcgaaagctccccaaatcccactgtagaggctggtagaacactcagggtgcttaacctggttgagaattggttgaacaataacacccaattctgcatcaaagtgctgaatccgtacatgcctagtgtcattgaaaagatggaggcactccagcggaagtacgggggagccttagtgcgcaacccactgtctagaaatagcactcacgaaatgtattgggtctcaaacgcttccggcaacatcgtgagtagcgttaatatgatatctaggatgcttattaaccgatttacaatgaaacacaagaaagccacctacgagcccgacgtagatctgggctccgggacgcggaatatcggaatcgaatcagagacccctaacctagacattataggtaagcgtatcgagaaaattaagcaggaacatgagacaagctggcactatgatcaggaccatccatacaagacttgggcatatcacggctcgtacgaaaccaaacaaacagggtctgccagttccatggtgaatggagtcgtgagactcctgactaagccctgggacgttatcccgatggtgacccagatggctatgacagataccactcctttcggccagcagcgcgtctttaaagagaaggtggacacgaggacacaagaacccaaagagggtaccaagaagttgatgaaaattactgcggagtggctgtggaaggaactcgggaaaaagaaaaccccacggatgtgtacaagagaggagttcacgcgcaaggtaaggagcaacgccgcacttggagctatctttaccgatgagaataaatggaagtcagcccgagaggcagtggaagactccggcttctgggagctggttgataaggaacggaacttacacctggagggcaaatgcgaaacttgtgtctataatatgatggggaagagagagaaaaagttgggagagtttggtaaagccaagggctctagggctatatggtacatgtggctcggggcccgcttcctggaatttgaggcgctaggattccttaacgaagaccattggtttagccgtgagaatagtctgtccggcgtggaaggtgaggggctccacaagctgggatacatcttgcgggatgtgagcaaaaaggagggcggcgcaatgtatgccgacgatacagctgggtgggacaccagaattactctggaagatctcaaaaacgaggaaatggtcacaaatcatatggagggagaacacaggaaacttgccgaggcaatcttccgcctgacctaccagaacaaagttgtgcgagtacagcggcctacacccagaggtactgtgatggacattatctctaggcgcgaccagagaggctcagggcaagtcgtgacctatggattaaatacgttcaccaacatggaggctcagctgattcggcagatggaaggcgagggtgtttttaagagtatacaacatttgacagtgactgaagagatcgccgtcaagaactggctcgagagggtggggcgtgaacgactgtcccgcatggctattagcggagatgactgcgtagttaaaccactagatgacagattcgcctctgcacttaccgcgctgaatgatatgggcaaggtgcggaaagacatccagcagtgggagccctcgaggggctggaacgattggacacaggtccctttttgctcacaccacttccatgaactcatcatgaaggacgggcgcgtgctggtggtcccatgtagaaatcaagatgagttgattggacgggccaggataagccagggtgctggctggtccttacgagaaactgcctgcctggggaaaagttacgcacagatgtggtctctcatgtattttcaccgtagagaccttcgcctggctgccaacgcaatctgtagcgccgttccgtcccattgggtgcccatttcacggaccacgtggagtatccacgcgacacacgagtggatgaccactgaggatatgctaacagcttggaatagggtatggattcaggaaaacccttggatggaggacaagaccccagtggaatcttgggaggaaatcccctacctgggaaagagagaggatcaatggtgcggcagcctcataggtttgacttcccgcgccacctgggccaaaaatatccagacagccattaaccaggtccggtcactgatcgggaatgaggaatatacggactacatgcctagcatgaagaggttccgaagagaggaagaggaagctggagtgctttggtga

SEQ ID NO: 14321 - RNA, 9876 nt, synthetic construct
  misc_feature 1..9876: note = derived and/or modified CDS sequence (opt3) from DENV-2__KX380821__SS-prME
  source 1..9876: mol_type = other RNA
accgcaggcatcattataatgatgatccccaccgtgatggctttccacctgactacgcgaaacggggagcctcatatgattgtcagcaggcaggaaaagggaaagtccctcctttttaagaccgagaatggtgttaacatgtgcacactgatggcaatggacttgggcgaattatgtgaggatactatcacctacaattgcccactgctgcggcaaaacgaaccggaggacattgattgttggtgcaattctacatcaacctgggtgacttatgggacatgtaccgcaacgggagagcaccgccgagaaaaacgtagtgtagcgctcgtgccccatgtcggcatgggtctggagactagaaccgaaacatggatgagctccgagggggcttggaagcacgcccagaggatcgagacttgggtgcttcggcatcctggattcaccgttatggcagccatactggcttacacaatcggcaccacgtattttcagcgcgtgttgattttcatcctcctgactgcagtcgccccatctatgacaatgagatgcattggcatctcgaacagggactttgtggaaggggtatcaggaggtagctgggttgatatagtgctggagcacggcagttgtgtcaccactatggctaaaaataagcccacactcgacttcgaattaattaagaccgaggccaaacaccctgcgacgctgcggaagtactgcatcgaagcaaaacttaccaacacaactaccgcctcccgctgtccaacacagggggagccctctttgaatgaggaacaagataagcgatttgtgtgcaaacatagcatggtggacagaggatggggcaacggttgtgggctgttcggaaagggcggcattgtcacttgcgctatgtttacctgcaagaaaaatatggaggggaagatcgttcagcctgaaaacctagagtatacaatcgtgattaccccacactccggagaagagaatgccgtaggtaacgatactggcaaacatgggaaggagataaaagtgacgccgcagtcaagtatcacagaagcagagctcaccggatacggcactgctaccatggaatgtagccccaggacaggtctggacttcaatgagatggtccttctgcagatggaaaacaaggcctggttggtgcaccggcaatggtttctcgatctgcctttaccatggctgcccggggcggacacccagggctctaactggattcagaaagagactctcgttacattcaagaatcctcacgccaagaaacaggatgtggtcgtgcttggatcccaagagggcgcaatgcatacggctctgaccggggccactgaaatccagatgtcaagcggaaacttgctatttacaggtcacctgaagtgccgtctccgcatggacaaactgcagcttaagggcatgagttattctatgtgtaccgggaaattcaaggtagttaaggagatagctgaaacacaacatggaactattgtgatcagagtccagtacgagggcgacggttccccatgcaaaatccccttcgagattatggatctggaaaagaggcacgtgttggggcggctcatcaccgtcaatccgattgtgacggagaaagacagccctgttaacatagaagccgagcccccatttggcgattcgtacatcattatcggagtggaacctggccagctgaagttatcttggttcaaaaaggggtcctcaatcggacagatgtttgagaccacaatgcgaggtgcaaagcgcatggccattctgggcgacactgcttgggatttcgggagtctaggaggcgtatttaccagcataggtaaagcgctccatcaagtcttcggggcaatctatggcgccgctttttccggagtgtcttggacaatgaagattctgatcggcgttgtgattacttggatcgggatgaatagcagatcaaccagtctttccgtcagcttggtgctggtaggagtggttacgctctacctgggcgtcatggtgcaggccgactctggttgtgtggtctcatggaaaaacaaggagcttaaatgcgggagtggaatattcatcacagataatgttcacacctggactgaacagtataagtttcagcccgagagcccatccaagctggcatctgccattcaaaaagctcacgaagagggcatctgtggtattaggtcggtgacacggttggaaaacctcatgtggaagcagatcacccccgagctgaatcatatattaactgagaacgaagtgaaactgaccattatgacaggcgacatcaaggggattatgcaggccggaaaacgcacgctaagacctcagccaaccgagctcaagtacagctggaaagcatggggcaaggcgaagatgctgtccactgaacttcacaatcatacattcttgatcgatgggccggagaccgctgaatgccccaacacaaatagggcctggaactcactggaggtagaggactatggatttggcgtcttcactaccaatatatggctcaaactgaaggaacgtcaagatgtgttttgtgacagtaaattaatgtctgcagccatcaaggacaaccgggctgttcacgccgatatgggttactggattgagagcgcactgaacgacacgtggaaaatcgaaaaggcttccttcattgaggtgaagtcatgccactggcctaaaagccatacactttggtctaatggggtcttggagtccgaaatgatcataccaaagaacttcgccggacccgtgagtcagcacaattatcgacctggctaccatacccagactgcgggtccatggcacctcggcagactggagatggattttgacttctgtgaagggaccacagttgtggtaactgaggattgcggaaacaggggccccagcctacgcaccacaacggcctctgggaaactgattaccgaatggtgctgtcggtcctgcactctcccgcctctgagatacaggggagaggacggctgttggtatggtatggagatccgcccacttaaggaaaaagaggaaaatttggtcaactcactggtgacagctgggcatggacagatcgataattttagtttaggcgtgctcggtatggcactgttccttgaggaaatgctgcgaacccgggtcggcactaagcacgccattttgctcgttgctgtgagctttgtaacactgatcaccgggaacatgtcgttccgtgacctaggaagagtgatggtcatggtgggcgccacgatgactgatgacattgggatgggagttacctacctggcactcctggcggcctttaagataaggcccacattcgctgccggccttttgctgcgcaaattaacctccaaggagctcatgatgactacaatcggtattgtgctgctttctcaaagcaccatccctgagtcaattctggaactaacagatgcactcgctctggggatgatggtcttgaaaatcgtgcggaatatggagaagtatcagctggccgttactataatggcaatcttatgcgtgcccaacgccgtcattctccagaatgcttggaaagtaagttgtaccacgctggcggtggtttccgtgtctccacttctgttgacaagctcccaacagaaggccgactggatccctctcgcactgaccattaagggactaaaccccactgctatctttctgaccacactttcaagaactagcaaaaagaggagttggccactcaatgaagccataatggccgtcggcatggtgtctattctggcttccagcttgctgaaaaacgatatcccgatgaccggccctttagtagcagggggactcctgacggtgtgctacgtccttacaggtcgatcggccgacctggagttggaacgcgcggctgacgttcggtgggaggagcaggccgaaatctcaggctctagtcccattctctccataaccatcagcgaggatgggtctatgagcattaagaatgaagaggaggaacagactctgacaatcctaattagaaccggactgcttgtgatctccggcctcttcccagtgtcaatacccatcactgcagccgcttggtatctgtgggaggtcaaaaagcaaagggccggtgtgttgtgggacgttcctagtccaccccctgtagggaaagccgaattagaggatggagcgtaccgtattaagcagaagggcatcctgggctatagccagattggggctggagtgtacaaagaaggtacatttcacaccatgtggcatgtcacgcgcggcgccgtgctcatgcacaaggggaaacggatcgagccgtcttgggcagacgttaagaaagatctgatatcctacggaggcggttggaaacttgagggggaatggaaggagggagaagaggtgcaggtcctggccttggaaccaggcaaaaaccccagagctgtgcaaactaagcctggcctattcaaaaccaacacagggaccattggagccgtatcactggactttagtccaggtacaagcggctcccccatcgtcgataagaaagggaaggtggttggactctatggcaatggtgtggtcactaggtctgggacctacgtgtcggcaatcgctcagacggaaaagagcattgaggacaaccctgaaatcgaggatgacatattcagaaagaagcggctgacaattatggatcttcatccgggagccggcaaaactaagcgctatttacccgcgatcgttagagaagccattaaaaggggcctgcggaccctcatcttggcaccaacacgagtggtcgctgccgagatggaagaggctctgagagggctccctatacgctaccagacccccgcaattagggccgagcacactggacgtgaaatcgtggacctgatgtgtcatgccaccttcacaatgcggcttctgtcaccaatcagagtacctaattataacttgattatcatggatgaggctcactttacggaccccgcgtccattgcagccaggggttacataagtactcgcgtggaaatgggcgaggctgccgggatcttcatgaccgcaacaccaccgggatctcgagacccttttccccagagcaatgccccaattatggatgaggaaaaggagatccccgaaagatcctggaactcaggccacgagtgggttaccgacttcaagggtaaaactgtctggtttgtgccttctatcaaggctgggaatgatattgcggcctgcctacggaaaaacggaaagaaagtgatacaactgagcaggaagacattcgacagtgaatatatcaagacccgcacgaatgattgggactttgtcgtaactacagatatttccgagatgggcgcaaacttcaaagctgagcgtgtgatcgacccaagacggtgtatgaagcccgttattctcaccgatggcgaagagagggtgatcttagccgggcctatgccggtcacccatagctctgcagcccagcgccgaggaagagtgggtcggaatcccaagaacgaaaatgaccagtacatatacatgggcgagcccctggaaaacgatgaggactgcgctcactggaaggaggccaaaatgcttctggacaatatcaacactcctgaagggattatcccctcaatgtttgagccagaaagggagaaggttgatgcgattgacggagaatatcgcctcagaggcgaggcaaggaaaacattcgtggatttgatgcggcgtggtgacctgcctgtctggctcgcctaccgcgtggctgccgaggggatcaactatgctgatcgaagatggtgttttgacggcgtaaagaataaccaaatactggaagagaatgtggaagttgagatttggaccaaggagggagaaaggaagaaacttaaaccccggtggctagatgcacgcatctactccgacccactggccttgaaagagttcaaagagttcgctgccggcagaaagagtttaacactgaacctcattactgagatggggaggctgcctacgtttatgacccagaaggccaagaatgcgcttgataacctggccgtcctccatacagctgaagccggaggtcgggcatataatcacgctttgagcgagctgccggagactctagaaaccctgctccttctgacattattggccaccgtgactggcgggatcttcctgtttctcatgtcgggaaagggcataggtaaaatgacgctggggatgtgctgcatcattaccgcatctatccttctgtggtacgcccagattcagccccactggatcgctgcgtccataattctcgagttctttttgatcgtgctgttaatcccagaacctgagaagcaacgaacaccccaggacaaccagctaacttatgtcgttattgccatcctgaccgtggtagcagctacaatggccaatgaaatgggcttcctcgagaaaaccaagaaggattttggacttggcagcataactacacagcaaccagagtcaaacattctggacatcgatttgagacctgccagtgcatggacgctgtacgctgtggccaccactttcattacacccatgctccgccattctatcgaaaattccagcgtcaacgtgtcactgaccgcgatagctaatcaggccaccgttcttatggggctcggaaaaggttggccgctgagtaagatggacatcggcgtgccattgctggcaattgggtgttacagccaggtcaaccctatcacattaactgccgctctactgctccttgtagcacactatgccattatcggacccggcctgcaggcgaaagctacgagggaggcccaaaagcgggcagccgctggtattatgaaaaatccaaccgtggacgggatgacagttatcgatttggaccccataccttacgatccgaagtttgaaaagcagctgggccaggtgatgctcctggtcctttgcgtgactcaggtcttaatgatgcgtaccacatgggccctgtgtgaggcactcaccttggctactggacccatttccacgctgtgggaaggcaacccagggagattctggaatacaaccatcgccgtgtctatggcgaacatctttaggggaagctatctagccggcgcaggtctactcttctccattatgaaaaacactgctaatacccgccgggggacaggaaacactggcgagacccttggtgagaagtggaaaaatcgactgaacgccttgggcaagtcagaatttcaaatatacaaaaagtctgggatccaggaggttgacagaacactggcaaaagaaggaattaagaggggcgagacggatcatcacgctgtgagtcgcgggtcggccaagctccggtggttcgtagagagaaatctggtgacccctgaaggaaaagtcgttgacttaggctgcggtcgtgggggatggagctattactgtggcggtcttaagaacgtgaaagaggtcaagggcctgactaaagggggacccggccatgaggaacctatcccaatgtccacatatgggtggaatctcgtgaggctacagtctggagtagatgtgttctttacaccacctgaaaagtgcgacactctgttgtgtgatattggcgagtcaagcccaaaccccacagttgaggccggtcggaccctgcgcgtgctcaatcttgtcgaaaactggctgaataacaatacgcaattctgcatcaaggtgttgaacccgtacatgccttccgtcatagagaaaatggaagcgctgcagcgaaagtacgggggagctctcgtgagaaatccattaagtaggaactctacccacgagatgtattgggttagcaacgcatcaggcaatatcgtatccagtgtgaacatgattagccggatgctgatcaatcgctttacaatgagacacaaaaaggccacttacgaacccgacgtcgatcttggctctgggaccaggaacattggaatcgagtccgagacacctaatctggacataattggtaaacgaatcgaaaagatcaagcaggagcatgaaacttcatggcactatgatcaggaccatccatacaaaacctgggcttatcacggcagctacgagacaaagcaaaccgggtcggcctctagtatggtgaacggagttgtgcggctactcactaaaccctgggacgtcattccgatggtgacgcagatggcaatgacagataccactcctttcggccagcagcgtgtatttaaggaaaaagtggacaccagaacacaagagcccaaggagggtacgaagaaactgatgaagataaccgccgaatggttgtggaaagagctggggaagaaaaagactccacgcatgtgtacaagggaagagttcacccggaaagttagatccaatgctgcgctcggagccatctttactgatgagaacaagtggaaaagcgcacgcgaagctgtcgaggactcaggcttctgggaacttgtggataaagagaggaatctgcacttagaaggcaagtgcgagacatgtgtgtataacatgatggggaaacgagagaagaaactgggagaatttggtaaggccaagggctcccgggcaatttggtacatgtggttgggggccagattcctcgagtttgaagctctgggattcctaaatgaggaccattggttttctagggaaaacagccttagtggcgtcgagggtgaggggctgcacaaactcggatacatcctgcgcgatgtttccaagaaagaaggcggcgccatgtatgcggacgataccgcagggtgggacacacgtattactttggaggatctgaagaatgaagagatggtgaccaaccatatggaaggagagcacaaaaagctcgccgaggctatcttcaaacttacgtaccagaataaagtagtgcgggtccagagacctacccccaggggtacagtgatggacataatcagccgccgagaccagcggggctctgggcaagttgtgacttatggactgaacaccttcacaaacatggaagcccagttaattagacagatggagggcgaaggtgtctttaagtcaatccaacagctgactgtgaaagaggagattgcagtaaagaattggttgatcagggttgggcgcgaaagactcagtcggatggctatttccggagatgactgcgtggtcaaaccactggatgacaggttcgccagcgctctaaccgcccttaacgatatgggcaaggtgcgtaaggacatacagcagtgggagccctctcgaggctggaatgattggacgcaagtgcctttttgctcgcatcacttccacgaactgatcatgaaagacgggcgcgtcctcgttgtgccatgtagaaaccaggatgagctgattggacgggcaaggatctcacagggtgcgggctggagcttgcgcgaaacagcctgcttagggaagtcctacgctcagatgtggagtctgatgtattttcatagacgggacctcaggcttgccgcaaatgctatctgttctgccgtaccgagccactggattcccacctcccgaactacatggtcaatacatgcaacccacgagtggatgactaccgaggatatgctgacagtgtggaaccgtgtctggatccaagaaaatccttggatggaggacaaaacgccagtggaaagttgggaggaaattccctacctaggaaagagagaggatcagtggtgcggctctctgatcggtctcaccagccgcgccacttgggcgaaaaacattcagacagctatcaatcaggttcggtccttgatagggaacgaggaatataccgactacatgccttcaatgaagaggttcagacgcgaggaagaggaagccggagtgctgtggtga

SEQ ID NO: 14322 - RNA, 9876 nt, synthetic construct
  misc_feature 1..9876: note = derived and/or modified CDS sequence (opt3) from DENV-2__KX380822__SS-prME
  source 1..9876: mol_type = other RNA
accgccggaatcattataatgatgatccccacggtgatggctttccacctgactacgagaaacggggaacctcatatgattgtaagcaggcaggaaaagggaaaatccctcctttttaagaccgagaatggtgttaacatgtgcacactgatggcaatggacttgggcgaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactcggaccgaaacatggatgagctccgagggggcttggaagcacgcccagaggatcgagacttgggtgcttcggcatcctggattcaccgttatggcagccatactggcttacacaatcggcaccacgtattttcagcgcgtgttgattttcatcctcctgactgcagtcgccccatctatgacaatgagatgcattggcatctcgaacagggactttgtggaaggggtatcaggaggtagctgggttgatatagtgctggagcacggcagttgtgtcaccactatggctaaaaataagcccacactcgacttcgaattaattaagaccgaggccaaacaccctgcgacgctgcggaagtactgcatcgaagcaaaacttaccaacacaactaccgcctcccgctgtccaacacagggggagccctctttgaatgaggaacaagataagcgatttgtgtgcaaacatagcatggtggacagaggatggggcaacggttgtgggctgttcggaaagggcggcattgtcacttgcgctatgtttacctgcaagaaaaatatggaggggaagatcgttcagcctgaaaacctagagtatacaatcgtgattaccccacactccggagaagagaatgccgtaggtaacgatactggcaaacatgggaaggagataaaagtgacgccgcagtcaagtatcacagaagcagagctcaccggatacggcactgctaccatggaatgtagccccaggacaggtctggacttcaatgagatggtccttctgcagatggaaaacaaggcctggttggtgcaccggcaatggtttctcgatctgcctttaccatggctgcccggggcggacacccagggctctaactggattcagaaagagactctcgttacattcaagaatcctcacgccaagaaacaggatgtggtcgtgcttggatcccaagagggcgcaatgcatacggctctgaccggggccactgaaatccagatgtcaagcggaaacttgctatttacaggtcacctgaagtgccgtctccgcatggacaaactgcagcttaagggcatgagttattctatgtgtaccgggaaattcaaggtagttaaggagatagctgaaacacaacatggaactattgtgatcagagtccagtacgagggcgacggttccccatgcaaaatccccttcgagattatggatctggaaaagaggcacgtgttggggcggctcatcaccgtcaatccgattgtgacggagaaagacagccctgttaacatagaagccgagcccccatttggcgattcgtacatcattatcggagtggaacctggccagctgaagttatcttggttcaaaaaggggtcctcaatcggacagatgtttgagaccacaatgcgaggtgcaaagcgcatggccattctgggcgacactgcttgggatttcgggagtctaggaggcgtatttaccagcataggtaaagcgctccatcaagtcttcggggcaatctatggcgccgctttttccggagtgtcttggacaatgaagattctgatcggcgttgtgattacttggatcgggatgaatagcagatcaaccagtctttccgtcagcttggtgctggtaggaatagtgacgctctacctgggcgttatggtccaggccgactctggttgtgtggtgtcatggaaaaacaaggagcttaaatgcgggagtggaatcttcattacagataatgtccacacctggactgaacagtataagtttcagcccgagagcccatccaagctggcatctgccatccaaaaagctcacgaagagggcatttgtggtatcaggtcggttacacggttggaaaacctcatgtggaagcagataacccccgagctgaatcatattttaagcgagaacgaagtgaaactgactatcatgaccggcgacattaaggggatcatgcaggccggaaaacgctccctaagacctcagccaacagagctcaagtactcatggaaagcatggggcaaggcgaagatgctgagtacggaacttcacaatcataccttcttgatagatgggccggagactgctgaatgccccaacacaaatagggcctggaactctctggaggtggaggactatggatttggcgtattcaccacaaatatctggctcaaactgaaggaacgtcaagatgtcttttgtgacagcaaattaatgtccgcagccattaaggacaaccgggctgtgcacgccgatatgggttactggatcgagtcagcactgaacgacacttggaaaattgaaaaggctagcttcatcgaggttaagtcttgccactggcctaaatcccataccctttggagtaatggggtgttggagagcgaaatgataattccaaagaacttcgccggacccgtctctcagcacaattatcgacctggctaccatacgcagacagcgggtccatggcacctcggcagactggagatggattttgacttctgtgaagggaccactgtggttgtgaccgaggattgcggaaacaggggcccctccctacgcacaactaccgcctcagggaaactgatcacagaatggtgctgtcggagttgcacgctcccgcctctgagatacaggggagaggacggctgttggtatggtatggagatccgcccacttaaggaaaaagaggaaaatttggtaaacagcctggtcaccgctgggcatggacagattgataatttttcgttaggcgtgctcggtatggcactgttccttgaggaaatgctgcgaactcgggtgggcacaaagcacgccatcttgctcgtcgctgtttcctttgtgaccctgattactgggaacatgtctttccgtgacctaggaagagtaatggtgatggtcggcgccacaatgaccgatgacatagggatgggagtgacgtacctggcactcctggcggcctttaaggttaggcccactttcgctgccggccttttgctgcgcaaattaaccagcaaggagctcatgatgacaaccatcggtattgtgctgctttcacaaagtactatccctgagacaattctggaactaaccgatgcactcgctctggggatgatggtcttgaaaatcgtgcggaatatggagaagtatcagctggccgttacaataatgactatcttatgcgtgcccaacgcagtcattctccagaatgcctggaaagtatcctgtaccatcctggctgtggtttctgtgagcccacttctgttgacgtcctcacaacagaaggcggactggattcctctcgccctgacaatcaagggactaaaccccaccgcaatatttctgactacccttagcagaacaagtaaaaagaggtcttggccactcaatgaagctattatggccgtcggcatggtgtccatcctggccagctcgttgctgaaaaacgatatcccgatgactggccctttagtagctgggggactcctgaccgtgtgctacgtccttacgggtcgatcagcagacctggagttggaacgcgccgcggacgttcggtgggaggagcaggctgaaatttctggcagttcccccatactcagcatcacaatttctgaggatgggagcatgtccatcaagaatgaagaggaggaacagaccctgactattctaatcagaacaggactgcttgtgatatcaggcctcttcccagtgagtatccccattaccgccgcagcctggtatctgtgggaggtcaaaaagcaaagggctggtgtgttgtgggacgttcctagcccaccccctgtagggaaagcagaattagaggatggagcctaccgtatcaagcagaagggcattctgggctattctcagatcggggcgggagtgtacaaagaaggtacttttcacacaatgtggcatgtcacccgcggcgctgtgctcatgcacaaggggaaacggatagagccgtcctgggccgacgttaagaaagatctgatttcatacggaggcggttggaaacttgagggggaatggaaggagggagaagaggtgcaggtcctggcattggaaccaggcaaaaaccccagagccgtgcaaacgaagcctggcctattcaaaactaacaccgggacaatcggagctgtaagtctggactttagcccaggtacctccggctctcccatcgtcgataagaaagggaaggtggttggactctatggcaatggtgtggtcacaaggtcggggacttacgtgagcgccattgcacagaccgagaagtcaatcgaggacaaccctgaaatagaggatgacattttcagaaagaaacggctgacgatcatggatcttcatccgggagctggcaaaacaaagcgctatttacccgccattgttagagaagcgatcaaaaggggcctgcggactctcatattggccccaacccgagtggtcgcagctgagatggaagaggccctgagagggctccctattcgctaccagacacccgctatcagggcagagcacaccggacgtgaaatcgtggacctgatgtgtcatgccactttcaccatgcggcttctgtccccaattagagtacctaattataacttgatcattatggatgaggcccactttacagaccccgctagtatagcggcaaggggttacatctctacgcgcgtggaaatgggcgaggccgctgggattttcatgactgccaccccaccgggaagccgagacccttttccccagtccaatgcaccaatcatggatgaggaaagagagatccccgaacggtcatggaactctggccacgagtgggttacagacttcaagggtaagaccgtctggtttgtgcctagcattaaagccgggaatgatataactgcttgcctaaggaagaacggcaaaaaggtgatccaactgagtcgcaaaacattcgactccgaatatattaagacccgtacgaatgattgggactttgtcgtaactacagatatcagcgagatgggcgcgaacttcaaggccgagagagtgattgacccacggaggtgtatgaaacccgttatcctcaccgatggcgaagaacgcgtgatattagcagggcctatgccggtcacccattcttcagctgcccagcgaagaggacgggtgggtaggaatccaaagaacgaaaatgaccagtacatctacatgggcgagcccctggaaaacgatgaggactgcgcacactggaaagaggccaagatgcttctggacaatattaacactcctgaagggatcattccctccatgtttgagccagaacgcgagaaagttgatgctatcgacggagaatatagactcaggggcgaggcccggaagacattcgtggatttgatgcgtcgcggtgacctgcctgtctggctcgcgtaccgagtggcagccgaggggataaactatgctgatagaaggtggtgttttgacggcgtcaaaaataaccaaattctggaagagaatgtggaagttgagatctggaccaaggagggagaacggaagaaacttaagccccgctggctagatgccagaatttacagtgacccactggctttgaaagagttcaaggagttcgcagccggcaggaagtcgttaacactgaacctcatcactgagatggggcggctgcctacgtttatgacccagaaggctcgaaatgcccttgataacctggcagtcctccatacagcggaagccggaggtagagcttataatcacgccttgagcgagctgccggagactctagaaaccctgctccttctgacattattggcaaccgtgactggcgggatattcctgtttctcatgtctggaaagggcatcggtaaaatgacgctggggatgtgctgcattatcaccgcttccattcttctgtggtacgcccagatccagccccactggatagcagccagcattatcctcgagttctttttgatcgtgctgttaattccagaacctgagaagcaacgcacaccccaggacaaccagctaacttatgtcgttatcgctatactgaccgtggtagcggccacaatggcaaatgaaatgggcttcctcgagaaaaccaagaaagattttggacttggctcaattactacacagcaaccagacagtaacatcctggatattgacttgaggcctgcttctgcctggacgctgtacgccgtggcaaccactttcatcacacccatgctccggcattccatagagaatagctcagtcaacgtgagtctgaccgctatcgccaatcaggcgaccgttcttatggggctcggaaagggttggccgctgagcaagatggacattggcgtgccattgctggctatcgggtgttactcccaggtcaaccctattacattaactgccgcactactgctccttgtagcccactatgctatcattggacccggcctgcaggcaaaagccacgcgtgaagcgcaaaagagagctgccgcaggtatcatgaaaataccagccgctgatgggatgaccgtgattgacttggatcccatcccttacgacccgaagtttgagaaacagctgggccaggttatgctcctggtgctttgcgtcacacaggtgttaatgatgaggactacctgggccctgtgtgaagcactcacattggctaccggacccatctctactctgtgggagggcaatccagggcgcttctggaacacgacaattgccgtcagcatggcgaatatatttcggggatcctatctagccggcgcaggtctactcttctcaatcatgaagaacaccgctaacactcgaagagggaccggaaatacaggcgaaactcttggtgagaagtggaaaaacaggctgaatgccttgggcaagtctgagtttcaaatttacaaaaagagtgggatccaggaagtggatcgcaccctggcaaaagagggaattaagcggggcgaaacagaccatcacgctgtttcgagagggagcgccaaactccgttggttcgtggagaggaacctggtaacgcctgagggaaaggtggtcgatttaggctgcggtagagggggatggtcctattactgtggcggtcttaagaatgttaaagaagtgaagggcctgaccaaagggggacccggccatgaggaacctatcccaatgtctacttatgggtggaacctcgtccgcctacagtcaggagtggacgtattctttacaccccctgagaagtgcgataccctgttgtgtgacataggcgaaagctccccaaatcccactgtggaggccggtcgaacactgagagttctcaaccttgtggagaattggctgaacaataacacccaattctgcatcaaagtcttgaatccgtacatgcctagtgtgattgaaaagatggaggcgctgcagaggaagtacgggggagctctcgtccggaacccattatctcgcaatagcacgcacgaaatgtattgggtgtcaaacgcatccggcaacatcgttagtagcgtaaatatgatttctagaatgctgatcaacaggtttaccatgaaacacaagaaagccacatacgagcccgatgtggaccttggctccgggactcgaaatataggaattgaatcagagacccctaacctggatatcatcggtaagcggattgagaaaataaagcaggaacatgagacaagctggcactatgaccaggaccatccatacaagacttgggcttatcacggctcgtacgaaaccaaacaaacagggtctgccagttccatggtcaatggagtggttcgtctactcaccaagccctgggatgtgatcccgatggtcactcagatggcaatgacggacacaacccctttcggccagcagagagtgtttaaagagaaggtagatactcgcacccaagaacccaaagagggtacaaagaagctgatgaaaattacggccgagtggttgtggaaggaactggggaaaaagaaaaccccaaggatgtgtactcgggaggagttcacaagaaaggtgcgcagcaacgctgcgctcggagccatctttaccgacgagaataaatggaagtcagcaagggaggctgttgaagattccggcttctgggagcttgtcgacaaggaacgaaacctgcacttagagggcaaatgcgaaacttgtgtgtataatatgatggggaagcgggagaaaaagctgggagagtttggtaaagccaagggctctagagcaatttggtacatgtggttgggggccaggttcctcgaatttgaggctctgggattcctaaacgaagatcattggtttagccgcgagaatagtctttccggcgtggaaggtgaggggctgcacaagctcggatacatcctgcgtgacgtcagcaaaaaggagggcggcgccatgtatgcggatgacacagcagggtgggatacccggataacattggaagacctgaaaaacgaggaaatggttactaatcatatggagggagaacacagaaagctcgccgaggctatcttcaggcttacctaccagaacaaagtggtacgcgtgcagcgacctacgccccggggtaccgtcatggacattatctctagaagggatcagcgcggctcagggcaagtggttacatatggactgaatactttcaccaacatggaggcccagttaattagacagatggaaggcgagggtgtgtttaagagtatccaacatctgacagtcactgaagagattgcagtgaagaactggttggagcgggtagggagggaacgtctctcccgaatggctataagcggagacgattgcgttgtgaaaccactggacgatcgcttcgcctctgctctaaccgcccttaatgacatgggcaaggtcagaaaagatatccagcagtgggagccctcgcggggctggaacgactggacacaggtgcctttttgctcacaccacttccatgaactgattatgaaggatgggagggtgctcgtcgttccatgtcgcaatcaagacgagctgatcggacgagcacggatcagccagggtgcgggctggtccttgagggaaacagcctgcttagggaaaagttacgctcagatgtggtctctgatgtattttcaccgacgtgatctcagacttgccgcaaacgctatttgtagcgccgtgccgtcccattgggtacccacctcacgcactacatggagtatacacgcaacccacgagtggatgactaccgaggacatgctgacagtgtggaatcgggtctggatccaggaaaacccttggatggaggataagacgccagtggaatcttgggaggaaattccctacctaggaaagagggaggaccaatggtgcggcagcctgatcggtctcacctccagagccacttgggcgaaaaatattcagacagctatcaaccaggttcgctcattgatagggaatgaggaatataccgactacatgcctagcatgaagcggttcaggcgagaggaagaggaagccggagtgctgtggtga

SEQ ID NO: 14323 - RNA, 9876 nt, synthetic construct
  misc_feature 1..9876: note = derived and/or modified CDS sequence (opt3) from DENV-2__KX380828__SS-prME
  source 1..9876: mol_type = other RNA
accgcaggcgtgatcattatgctgatacccactgctatggcattccacctcactacgagaaatggggaacctcatatgatcgtcagcaggcaggaaaagggaaaatcccttctgtttaagaccgaggacggtgttaatatgtgcacattgatggccatggatttaggcgaactgtgtgaggacactattacctacaactgcccactactccggcaaaatgaaccggaggatatcgactgttggtgcaactctacatcaacctgggtgacttatgggacatgtaccgcgacgggagagcaccgccgagaaaaacgtagtgttgctctggtgccccatgtcggcatgggtcttgagactagaaccgaaacatggatgagctccgagggggcctggaagcacgcacagaggattgagacttggatcctgcggcatcctggattcaccataatggccgctatcttggcatacacaattggcaccacgtattttcagcgcgtgctcatcttcattctgctgactgccgttgctccatctatgacaatgagatgcatcggcatatcgaatagggattttgtggaaggggtctcaggaggtagctgggtggacattgtactcgagcacggcagttgtgttaccactatggccaaaaacaagcccacattagatttcgaactgatcaagaccgaggcgaaacagcctgcaacgcttcggaagtactgcattgaagccaaattgaccaatacaactaccgcttcccgctgtccaacacaaggggagccctctctgaacgaggaacaggacaagcgatttgtgtgcaaacacagcatggtcgatagaggatggggcaatggttgtgggctattcggaaagggcggcatcgtgacttgcgccatgtttacctgcaagaaaaacatggaggggaagatcgtgcagcctgaaaatctcgagtatacaattgtcgttaccccacattccggagaagagaacgcagtgggtaatgacactggcaaacacgggaaggagataaaagtaacgccgcagtcaagtatcacagaagctgagctgaccggatacggcactgtgaccatggaatgtagccccaggacaggtcttgatttcaacgagatggtcctgttgcaaatggaaaataaggcctggctcgtgcatcggcagtggtttctggacttacctctgccatggctccccggggcggatacccagggctctaactggattcagaaagagatgcttgttactttcaagaaccctcacgccaagaaacaagacgtggtcgtgctgggatcccaggagggcgcaatgcacacagctttgacgggggccaccgaaatccagatgtcaagcggaaatctactgtttactggtcatctcaagtgccgtctgcgcatggacaaacttcaactgaagggcatgagttattctatgtgtacagggaaattcaaggtagttaaggagatagctgaaacccagcacggaacaattgtggtcagagtgcagtacgagggcgatggttccccatgcaaaatccccttcgagatcatggacttggaaaagaggcatgtcctcgggcggctgattactgtgaacccgatcgttaccgagaaagatagccctgtgaatattgaagccgagcccccatttggcgactcgtacataatcattggagtagaacctggccagttaaagctgtcttggttcaaaaaggggtcctcaatcggacaaatgtttgagacgaccatgcgaggtgcaaagcgcatggccatcctaggcgatacagcttgggacttcgggagtctcggaggcgtctttactagcattggtaaagcgctgcaccaggtgttcggggcaatatatggcgccgctttttccggagtttcttggaccatgaagatccttattggcgtggtcatcacatggattgggatgaacagcagatcaacaagtttgtccgtgagcctggtactcgtgggagttgtcaccctgtaccttggcgtgatggtgcaggccgattctggttgtgtcgtttcatggaaaaataaggagctgaaatgcgggagtggaatcttcataacggacaacgtgcatacatggaccgaacagtataagtttcaacccgagagcccatccaagttggcatctgccatccagaaagctcacgaagagggcatttgtggtatcaggtcggtgactcggctcgaaaatctgatgtggaagcagattacacccgagttaaaccacatcctgagcgagaatgaagtaaaactaaccataatgactggcgatattaaggggatcatgcaggccggaaaacgctccctcagacctcaaccaaccgagctgaagtactcatggaaaacatggggcaaggcaaagatgcttagtacggaaccgcataaccagaccttcttgattgacgggcccgagactgcggaatgccctaatacaaacagggcttggaactctctggaggtcgaggattatggatttggcgtgttcaccacaaacatctggctcaaactgaaggaacgtcaggacgtattttgtgacagcaaattaatgtccgccgcaataaaggataatcgggccgtgcacgctgacatgggttactggatcgagtcagccctgaacgatacttggaaaattgaaaaggccagcttcatcgaggtcaagtcttgccattggccaaaatcccacaccctttggagtaacggggtgttggagagcgaaatgattatccccaagaatttcgctggacctgtttctcagcacaactatcgaccaggctaccatacgcaaacagccggtccctggcacctcggcaaactggagatggactttgatttctgtgaagggaccactgtggtagtcaccgaggactgcggaaatagaggcccgtccctaaggacaactaccgcgtcagggaagctgataacagaatggtgctgtcgcagttgcacgctccctccactgcggtacaaaggagaggatggctgttggtatggtatggagattagaccccttaaggaaaaggaggaaaacttggtgaatagcctggtgaccgccgggcatggacagatcgacaacttttcgttaggcgtcctcggtatggctctgttccttgaggaaatgctgaggactcgcgttggcacaaaacacgcagtgttgctcgtagccgtgtcctttatgaccctgatcactgggaatatgtctttccgagatctaggacgggtcatggtgatggttggcgctgccatgacagacgatattgggatgggagtgacctacctggcactcctggcggcctttaaggtccgtcctacgttcgctgccggccttttgctgagaaaattaactagcaaggagctcatgatgaccacaatcggtattgtgctgctttcacagagtaccatacccgagactatcctggaactaacagacgcactcgctctggggatgatgattttgaaaatcgttaggaacatggagaagtatcaactggccgtgaccattatggcaatcttatgcgccccaaatgctgtcatactccagaacgcgtggaaggtatcctgtacaatcctggccgtggtttctgtgagccctcttctgttgacttcctcacagcagaaagcagattggattcccctcgctctgaccatcaagggactaaatccaacggccatttttctgacaacccttagccgcactaacaaaaagcggagttggccgctcaatgaagccatcatggctgtcggcatggtgtctatactggcatccagcttgctgaaaaacgacattcctatgaccggccccttagtagccgggggactcctgacagtgtgctacgtccttactggtagatcggcggacctggagttggaaagggctgccgatgttcgatgggaggaccaagcagagatctcaggctctagtccaatcctctccattaccataagcgaagatgggtctatgagcatcaagaatgaggaagaggagcagacgctgacaattctaatccgcaccggactgcttgtgatttccggcctcttccccgtgtcaatccctataactgccgctgcatggtatctgtgggaagtcaaaaagcagcgggccggtgtgttgtgggacgttccaagtccccctccggtagggaaggcggagttagaagatggagcttacagaatcaaacagaagggcattctgggctatagccaaatcggggccggagtgtacaaagagggtacatttcataccatgtggcacgtcactaggggcgcagtgctcatgcacaaggggaaacgtattgaaccatcttgggccgacgttcgcaaggatctgatctcctacggaggcggttggaaacttgagggggagtggaaagaaggagaggaagtgcaggtcctggctttggagcccggcaagaaccctcgggccgtgcagacaaaaccaggcctattcaagaccaacacggggactataggagcagtatcactggactttagtcccggtaccagcggctcccctattgtcgataaaaaggggaaggtggttggactctatggcaatggtgtggtcacaagatctgggacctacgtgtcggctatcgcccagacagaaaagagcatcgaggacaacccggagattgaagatgacatcttcaggaagaaacgactgactataatggatcttcatcccggagcgggcaagaccaaacggtatttaccagccattgttcgcgaggcaatcaagagaggcctgaggacgctcattttggctcctacacgggtggtcgccgctgaaatggaggaagcactgcgagggctccccatcagataccaaactccagccatacgcgccgagcacaccggaagggagattgtggacctgatgtgtcatgctacattcaccatgcgtcttctgtcacctgtacgggtgcccaattataacttgatcatcatggacgaagcgcactttactgatccagcatccattgccgctagaggttacatcagtaccagggttgagatgggcgaagccgcagggattttcatgacagccacgccgcctggatctcgcgacccctttccacagagcaatgctcccataatggatgaggagcgagaaatccctgagagatcctggaactcaggccatgaatgggtcactgacttcaagggtaaaaccgtgtggtttgtgccatctattaaggcggggaatgatatcgccgcatgcctacggaaaaacggaaagaaagtcatccagctgagcaggaagacattcgacagtgagtatattaagacccgcactaatgattgggactttgtagtgacaaccgatatatccgaaatgggcgctaacttcaaagccgagcgtgttatcgaccccagacggtgtatgaagcctgtgattctcacggatggcgaggaaagggtcatcttagcagggccgatgccagtgactcacagctctgccgctcaacgccgaggaagaattggtcggaatcccaaaaacgagaatgaccagtacatctacatgggcgaacctctggagaacgacgaagattgcgcccactggaaggaggcgaaaatgcttctggacaatataaacacacccgaggggatcattccatcaatgtttgaacctgagagggaaaaggttgatgcaatcgacggagagtatcgcctcagaggcgaagccaggaaaaccttcgtggagttgatgcggcgtggtgatctgcccgtctggctcgcttaccgcgtggccgctgaggggattaactatgcagaccgaagatggtgttttgatggcatcaagaataaccagatactggaagagaatgtagaagtggagatttggaccaaggagggagagaaaaagaaacttaaaccaaggtggctagacgcccggatctactccgatcctctggctttgaaagagttcaaggagttcgccgcaggccgcaagagtttaactatgaacctgattacagagatggggagactcccgacctttatgacacagaaagcgaggaatgccctggacaaccttgctgttctgcatactgccgaagcaggaggtcgggcttataatcacgccctcagcgagttgcccgagacgctggaaaccctactgctccttacactgttagcaactgtcaccggcgggatcttcttgtttctgatgtcgggaaagggcataggtaaaatgacactcgggatgtgctgcatcattaccgcctctatcctgctttggtacgctcaaattcagccacattggatcgcggcctccataattctggagttctttctcatcgtgttgctgatccctgaacccgagaagcagcgaactccacaggataaccaattaacgtatgtggtcattgcaatcctaaccgttgtggctgccacaatggccaatgaaatgggcttcctggagaaaactaagaaggactttggactcggcagcatagtagcacagcagcctgagtcaaacattcttgatatcgacctgagacccgctagtgcctggaccttgtacgcggtggctacaaccttcattactccgatgctgcgccactctatcgaaaattccagcgtcaacgtgtcactcacagccatagcaaatcaggccacggttctgatggggcttggaaaaggttggccactcagtaagatggacatcggcgtgcctctgttggctattgggtgttacagccaagtcaaccccatcaccctgactgcagccttactactgctcgtagcgcactatgctattatcggaccaggccttcaggccaaagcaacaagggaggcccagaagcgggctgccgcaggtattatgaaaatccccaccgtggatgggataaccgttattgacctggatcctatcccgtacgaccccaagtttgaaaagcagttgggccaagtgatgctgctcgtcctgtgcgtgacacaggtccttatgatgcgtactacgtgggctttatgtgaggccctgaccctcgcgacaggaccaatctccactttgtgggaaggcaatcctgggagattctggaacaccacaattgccgtgtctatggcaaatatatttaggggaagctatctggctggcgccggtctactgttctccatcatgaaaaacaccactaacacgcgccgggggacaggaaataccggcgagactctcggtgagaagtggaaaaaccgacttaattcactgggcaagtctgaatttcagatttacaaaagaagtgggatccaagaggttgataggaccttggcaaaggaaggaattaaacgcggcgagacagaccatcacgctgtgtcgcgggggagcgccaagctgagatggttcgtagagcgtaacctcgtgactcccgaaggaaaggtcatggatctgggctgcggtaggggagggtggtcctattactgtggcggtttaaagaatgttcgggaggtgaagggccttaccaaagggggacctggccatgaagaaccaatccccatgtctacatatgggtggaacctggtccgcctccagtcaggagtggacgtattctttacgcctccagaaaagtgcgataccctactgtgtgacataggcgagagctcccccaatccgactgtggaggccggtcgaacattgagagttctgaacctcgtggaaaattggcttaacaataacacccagttctgcatcaaagtcctgaatccttacatgccaagtgtgattgagaagatggaaactttgcagaggaagtacgggggagcgctggtccggaaccccctctctcgcaatagcacacacgagatgtattgggtgtcaaacgcttccggcaacatcgttagtagcgtaaatatgatttctagaatgttaatcaacaggtttaccatgcgacataaaaaggcaacgtacgaacctgatgtggacctgggctccgggacccggaatataggaattgagtcagagacaccaaaccttgatatcatcggtaaacgtattgaaaagataaaacaagagcacgaaactagctggcactatgaccaggaccatccctacaagacctgggcctatcacggctcgtacgagacaaagcagactgggtctgctagttccatggtcaatggagtggttagactgctaaccaaaccgtgggatgtgatccctatggtcacacagatggccatgaccgacactacgcccttcggccaacagcgcgtgtttaaggaaaaagtagatacaaggacccaggagccaaaggagggtactaaaaagctcatgaagattaccgcagaatggctgtggaaagagttggggaagaaaaagacacctcggatgtgtacgagagaagagttcacccgcaaagtgaggagcaacgccgctctgggagcgatctttactgacgagaataagtggaaatcagcccgagaagcagttgaggattcccggttctgggaactcgtcgacaaggagagaaaccttcatctggaaggcaagtgcgagacatgtgtgtataatatgatgggcaaaagggagaagaaaattggggaatttggacgcgctaagggttctcgtgccatctggtacatgtggttaggcgcacggttcctggagtttgaagccttggggttcctcaacgaggatcactggtttagcagagaaaatagtctgtccggagtggagggcgagggtctacacaaacttgggtacatactgagggaagtcagcaagaaggagggaggcgctatgtatgccgacgataccgcgggctgggacactcgcatcacactcgaagatctgaaaaacgaggaaatggttaccaatcatatggagggggagcacaagaaattggcagaagccattttcaagctgacataccagaacaaagtggtacgagtgcaacggcccactccaagaggaaccgtcatggacatcatttctaggcgcgaccagagaggttcaggccaggtggggacgtatggactcaataccttcacaaacatgggcgctcaacttatccggcagatggagggtgaaggggtttttaagagtattcagcatctgactaccacagaggaggtggccgtccaggattggttagcaagggtgggacgtgaacgactgtcccgcatggctataagcggcgacgattgcgtagttaagcccttggacgatagattcgcctctgctctcactgccctgaacgacatgggcaaagtgcggaaggatatccaacagtgggagccttcgaaagggtggaatgactggacccaggtcccattttgctcacaccatttccacgaactaattatgaaggatggaagggtgcttgtggtcccgtgtcgcaaccaggacgagctgatcggtagagcacggatcagccaaggcgcggggtggtccctcagggaaacggcctgcctgggaaaaagttacgctcagatgtggtctttgatgtattttcaccgacgtgatttaagactggccgcaaatgctatttgtagcgccgttccctcccattgggtgcctacatcacgcaccacttggagtatacacgcacggcatgagtggatgacaaccgaggacatgctcactgtatggaacagggtgtggatccaggaaaatccatggatggaggataagacccccgtcgaatcttgggaggaaattccttaccttggcaagagagaggaccagtggtgcggtagcctgatcgggctaacatcccgcgccacgtgggcgaaaaacattcaaaccgctatcaatcaggtgcggtcactgataggaagcgaggaatatactgactacatgccatctatgaagaggttccgaagagaggaagaggaagccggcgttctctggtga

SEQ ID NO: 14324 - RNA, 9876 nt, synthetic construct
  misc_feature 1..9876: note = derived and/or modified CDS sequence (opt3) from DENV-2__KX380829__SS-prME
  source 1..9876: mol_type = other RNA
accgcaggcgtgatcattatgctgatacccactgctatggcattccacctcactacgagaaacggggaacctcatatgatcgtcagcaggcaggaaaagggaaaatcccttctgtttaagaccgaggacggtgttaatatgtgcacattgatggccatggatttaggcgaactgtgtgaggacactattacctacaactgcccactactccggcaaaatgaaccggaggatatcgactgttggtgcaactctacatcaacctgggtgacttatgggacatgtaccgcgacgggagagcaccgccgagaaaaacgtagtgttgctctggtgccccatgtcggcatgggtcttgagactagaaccgaaacatggatgagctccgagggggcctggaagcacgcacagaggattgagacttggatcctgcggcatcctggattcaccataatggccgctatcttggcatacacaattggcaccacgtattttcagcgcgtgctcatcttcattctgctgactgccgttgctccatctatgacaatgagatgcatcggcatatcgaatagggattttgtggaaggggtctcaggaggtagctgggtggacattgtactcgagcacggcagttgtgttaccactatggccaaaaacaagcccacattagatttcgaactgatcaagaccgaggcgaaacagcctgcaacgcttcggaagtactgcattgaagccaaattgaccaatacaactaccgcttcccgctgtccaacacaaggggagccctctctgaacgaggaacaggacaagcgatttgtgtgcaaacacagcatggtcgatagaggatggggcaatggttgtgggctattcggaaagggcggcatcgtgacttgcgccatgtttacctgcaagaaaaacatggaggggaagatcgtgcagcctgaaaatctcgagtatacaattgtcgttaccccacattccggagaagagaacgcagtgggtaatgacactggcaaacacgggaaggagataaaagtaacgccgcagtcaagtatcacagaagctgagctgaccggatacggcactgtgaccatggaatgtagccccaggacaggtcttgatttcaacgagatggtcctgttgcaaatggaaaataaggcctggctcgtgcatcggcagtggtttctggacttacctctgccatggctccccggggcggatacccagggctctaactggattcagaaagagatgcttgttactttcaagaaccctcacgccaagaaacaagacgtggtcgtgctgggatcccaggagggcgcaatgcacacagctttgacgggggccaccgaaatccagatgtcaagcggaaatctactgtttactggtcatctcaagtgccgtctgcgcatggacaaacttcaactgaagggcatgagttattctatgtgtacagggaaattcaaggtagttaaggagatagctgaaacccagcacggaacaattgtggtcagagtgcagtacgagggcgatggttccccatgcaaaatccccttcgagatcatggacttggaaaagaggcatgtcctcgggcggctgattactgtgaacccgatcgttaccgagaaagatagccctgtgaatattgaagccgagcccccatttggcgactcgtacataatcattggagtagaacctggccagttaaagctgtcttggttcaaaaaggggtcctcaatcggacaaatgtttgagacgaccatgcgaggtgcaaagcgcatggccatcctaggcgatacagcttgggacttcgggagtctcggaggcgtctttactagcattggtaaagcgctgcaccaggtgttcggggcaatatatggcgccgctttttccggagtttcttggaccatgaagatccttattggcgtggtcatcacatggattgggatgaacagcagatcaacaagtttgtccgtgagcctggtactcgtgggagttgtcaccctgtaccttggcgtgatggtgcaggccgattctggttgtgtcgtttcatggaaaaataaggagctgaaatgcgggagtggaatcttcataacggacaacgtgcatacatggaccgaacagtataagtttcaacccgagagcccatccaagttggcatctgccatccagaaagctcacgaagagggcatttgtggtatcaggtcggtgactcggctcgaaaatctgatgtggaagcagattacacccgagttaaaccacatcctgagcgagaatgaagtaaaactaaccataatgactggcgatattaaggggatcatgcaggccggaaaacgctccctcagacctcaaccaaccgagctgaagtactcatggaaaacatggggcaaggcaaagatgcttagtacggaaccgcataaccagaccttcttgattgacgggcccgagactgcggaatgccctaatacaaacagggcttggaactctctggaggtcgaggattatggatttggcgtgttcaccacaaacatctggctcaaactgaaggaacgtcaggacgtattttgtgacagcaaattaatgtccgccgcaataaaggataatcgggccgtgcacgctgacatgggttactggatcgagtcagccctgaacgatacttggaaaattgaaaaggccagcttcatcgaggtcaagtcttgccattggccaaaatcccacaccctttggagtaacggggtgttggagagcgaaatgattatccccaagaatttcgctggacctgtttctcagcacaactatcgaccaggctaccatacgcaaacagccggtccctggcacctcggcaaactggagatggactttgatttctgtgaagggaccactgtggtagtcaccgaggactgcggaaatagaggcccgtccctaaggacaactaccgcgtcagggaagctgataacagaatggtgctgtcgcagttgcacgctccctccactgcggtacaaaggagaggatggctgttggtatggtatggagattagaccccttaaggaaaaggaggaaaacttggtgaatagcctggtgaccgccgggcatggacagatcgacaacttttcgttaggcgtcctcggtatggctctgttccttgaggaaatgctgaggactcgcgttggcacaaaacacgcagtgttgctcgtagccgtgtcctttatgaccctgatcactgggaatatgtctttccgagatctaggacgggtcatggtgatggttggcgctgccatgacagacgatattgggatgggagtgacctacctggcactcctggcggcctttaaggtccgtcctacgttcgctgccggccttttgctgagaaaattaactagcaaggagctcatgatgaccacaatcggtattgtgctgctttcacagagtaccatacccgagactatcctggaactaacagacgcactcgctctggggatgatgattttgaaaatcgttaggaacatggagaagtatcaactggccgtgaccattatggcaatcttatgcgccccaaatgctgtcatactccagaacgcgtggaaggtatcctgtacaatcctggccgtggtttctgtgagccctcttctgttgacttcctcacagcagaaagcagattggattcccctcgctctgaccatcaagggactaaatccaacggccatttttctgacaacccttagccgcactaacaaaaagcggagttggccgctcaatgaagccatcatggctgtcggcatggtgtctatactggcatccagcttgctgaaaaacgacattcctatgaccggccccttagtagccgggggactcctgacagtgtgctacgtccttactggtagatcggcggacctggagttggaaagggctgccgatgttcgatgggaggaccaagcagagatctcaggctctagtccaatcctctccattaccataagcgaagatgggtctatgagcatcaagaatgaggaagaggagcagacgctgacaattctaatccgcaccggactgcttgtgatttccggcctcttccccgtgtcaatccctataactgccgctgcatggtatctgtgggaagtcaaaaagcagcgggccggtgtgttgtgggacgttccaagtccccctccggtagggaaggcggagttagaagatggagcttacagaatcaaacagaagggcattctgggctatagccaaatcggggccggagtgtacaaagagggtacatttcataccatgtggcacgtcactaggggcgcagtgctcatgcacaaggggaaacgtattgaaccatcttgggccgacgttcgcaaggatctgatctcctacggaggcggttggaaacttgagggggagtggaaagaaggagaggaagtgcaggtcctggctttggagcccggcaagaaccctcgggccgtgcagacaaaaccaggcctattcaagaccaacacggggactataggagcagtatcactggactttagtcccggtaccagcggctcccctattgtcgataaaaaggggaaggtggttggactctatggcaatggtgtggtcacaagatctgggacctacgtgtcggctatcgcccagacagaaaagagcatcgaggacaacccggagattgaagatgacatcttcaggaagaaacgactgactataatggatcttcatcccggagcgggcaagaccaaacggtatttaccagccattgttcgcgaggcaatcaagagaggcctgaggacgctcattttggctcctacacgggtggtcgccgctgaaatggaggaagcactgcgagggctccccatcagataccaaactccagccatacgcgccgagcacaccggaagggagattgtggacctgatgtgtcatgctacattcaccatgcgtcttctgtcacctgtacgggtgcccaattataacttgatcatcatggacgaagcgcactttactgatccagcatccattgccgctagaggttacatcagtaccagggttgagatgggcgaagccgcagggattttcatgacagccacgccgcctggatctcgcgacccctttccacagagcaatgctcccataatggatgaggagcgagaaatccctgagagatcctggaactcaggccatgaatgggtcactgacttcaagggtaaaaccgtgtggtttgtgccatctattaaggcggggaatgatatcgccgcatgcctacggaaaaacggaaagaaagtcatccagctgagcaggaagacattcgacagtgagtatattaagacccgcactaatgattgggactttgtagtgacaaccgatatatccgaaatgggcgctaacttcaaagccgagcgtgttatcgaccccagacggtgtatgaagcctgtgattctcacggatggcgaggaaagggtcatcttagcagggccgatgccagtgactcacagctctgccgctcaacgccgaggaagaattggtcggaatcccaaaaacgagaatgaccagtacatctacatgggcgaacctctggagaacgacgaagattgcgcccactggaaggaggcgaaaatgcttctggacaatataaacacacccgaggggatcattccatcaatgtttgaacctgagagggaaaaggttgatgcaatcgacggagagtatcgcctcagaggcgaagccaggaaaaccttcgtggagttgatgcggcgtggtgatctgcccgtctggctcgcttaccgcgtggccgctgaggggattaactatgcagaccgaagatggtgttttgatggcatcaagaataaccagatactggaagagaatgtagaagtggagatttggaccaaggagggagagaaaaagaaacttaaaccaaggtggctagacgcccggatctactccgatcctctggctttgaaagagttcaaggagttcgccgcaggccgcaagagtttaactatgaacctgattacagagatggggagactcccgacctttatgacacagaaagcgaggaatgccctggacaaccttgctgttctgcatactgccgaagcaggaggtcgggcttataatcacgccctcagcgagttgcccgagacgctggaaaccctactgctccttacactgttagcaactgtcaccggcgggatcttcttgtttctgatgtcgggaaagggcataggtaaaatgacactcgggatgtgctgcatcattaccgcctctatcctgctttggtacgctcaaattcagccacattggatcgcggcctccataattctggagttctttctcatcgtgttgctgatccctgaacccgagaagcagcgaactccacaggataaccaattaacgtatgtggtcattgcaatcctaaccgttgtggctgccacaatggccaatgaaatgggcttcctggagaaaactaagaaggactttggactcggcagcatagtagcacagcagcctgagtcaaacattcttgatatcgacctgagacccgctagtgcctggaccttgtacgcggtggctacaaccttcattactccgatgctgcgccactctatcgaaaattccagcgtcaacgtgtcactcacagccatagcaaatcaggccacggttctgatggggcttggaaaaggttggccactcagtaagatggacatcggcgtgcctctgttggctattgggtgttacagccaagtcaaccccatcaccctgactgcagccttactactgctcgtagcgcactatgctattatcggaccaggccttcaggccaaagcaacaagggaggcccagaagcgggctgccgcaggtattatgaaaaatcccaccgtggatgggatgaccgttatcgacctggatcctataccgtacgaccccaagtttgaaaagcagttgggccaagtgatgctgctcgtcctgtgcgtgacacaggtccttatgatgcgtactacgtgggctttatgtgaggccctgaccctcgcgacaggaccaatttccactttgtgggaaggcaaccctgggagattctggaataccacaatcgccgtgtctatggcaaacatctttaggggaagctatctggctggcgccggtctactgttctccattatgaaaaacaccactaatacgcgccgggggacaggaaacaccggcgagactctcggtgagaagtggaaaaatcgacttaactcactgggcaagtctgaatttcagatatacaaaagaagtgggatccaagaggttgataggaccttggcaaaggaaggaattaaacgcggcgagacagaccatcacgctgtgtcgcgggggagcgccaagctgagatggttcgtagagcgtaatctcgtgactcccgaaggaaaggtcatggatctgggctgcggtaggggagggtggtcctattactgtggcggtttaaagaatgttcgggaggtgaagggccttaccaaagggggacctggccatgaagaaccaatccccatgtctacatatgggtggaatctggtccgcctccagtcaggagtggacgtattctttacgcctccagaaaagtgcgataccctactgtgtgacattggcgagagctcccccaacccgactgtggaggccggtcgaacattgagagttctgaatctcgtggaaaactggcttaataacaatacccagttctgcatcaaagtcctgaacccttacatgccaagtgtgatagagaagatggaaactttgcagaggaagtacgggggagcgctggtccggaatcccctctctcgcaacagcacacacgagatgtattgggtgtcaaacgcttccggcaatatcgttagtagcgtaaacatgatttctagaatgttaatcaataggtttaccatgcgacataaaaaggcaacgtacgaacctgatgtggacctgggctccgggacccggaacattggaatcgagtcagagacaccaaatcttgatataattggtaaacgtatcgaaaagatcaaacaagagcacgaaactagctggcactatgaccaggaccatccctacaagacctgggcctatcacggctcgtacgagacaaagcagactgggtctgctagttccatggtcaacggagtggttagactgctaaccaaaccgtgggatgtgattcctatggtcacacagatggccatgaccgacactacgcccttcggccaacagcgcgtgtttaaggaaaaagtagatacaaggacccaggagccaaaggagggtactaaaaagctcatgaagataaccgcagaatggctgtggaaagagttggggaagaaaaagacacctcggatgtgtacgagagaagagttcacccgcaaagtgaggagcaatgccgctctgggagcgatctttactgacgagaacaagtggaaatcagcccgagaagcagttgaggattcccggttctgggaactcgtcgacaaggagagaaatcttcatctggaaggcaagtgcgagacatgtgtgtataacatgatgggcaaaagggagaagaaaattggggaatttggacgcgctaagggttctcgtgccatctggtacatgtggttaggcgcacggttcctggagtttgaagccttggggttcctcaatgaggatcactggtttagcagagaaaacagtctgtccggagtggagggcgagggtctacacaaacttgggtacattctgagggaagtcagcaagaaggagggaggcgctatgtatgccgacgataccgcgggctgggacactcgcatcacactcgaagatctgaaaaatgaggaaatggttaccaaccatatggagggggagcacaagaaattggcagaagccatattcaagctgacataccagaataaagtggtacgagtgcaacggcccactccaagaggaaccgtcatggacatcatttctaggcgcgaccagagaggttcaggccaggtggggacgtatggactcaacaccttcacaaacatgggcgctcaacttatccggcagatggagggtgaaggggtttttaagagtattcagcatctgactaccacagaggaggtggccgtccaggattggttagcaagggtgggacgtgaacgactgtcccgcatggctatcagcggcgacgattgcgtagttaagcccttggacgatagattcgcctctgctctcactgccctgaatgacatgggcaaagtgcggaaggatattcaacagtgggagccttcgaaagggtggaacgactggacccaggtcccattttgctcacaccatttccacgaactaataatgaaggatggaagggtgcttgtggtcccgtgtcgcaatcaggacgagctgatcggtagagcacggattagccaaggcgcggggtggtccctcagggaaacggcctgcctgggaaaaagttacgctcagatgtggtctttgatgtattttcaccgacgtgatttaagactggccgcaaacgctatctgtagcgccgttccctcccattgggtgcctacatcacgcaccacttggagtatccacgcacggcatgagtggatgacaaccgaggacatgctcactgtatggaatagggtgtggattcaggaaaacccatggatggaggataagacccccgtcgaatcttgggaggaaataccttaccttggcaagagagaggaccagtggtgcggtagcctgatcgggctaacatcccgcgccacgtgggcgaaaaatattcaaaccgctatcaaccaggtgcggtcactgattggaagcgaggaatatactgactacatgccatctatgaagaggttccgaagagaggaagaggaagccggcgttctctggtga

SEQ ID NO: 14325 - RNA, 9876 nt, synthetic construct
  misc_feature 1..9876: note = derived and/or modified CDS sequence (opt3) from DENV-2__KX380830__SS-prME
  source 1..9876: mol_type = other RNA
accgccggaatcattataatgatgatccccacggtgatggctttccacctgactacgagaaacggggaacctcatatgattgtaagcaggcaggaaaagggaaaatccctcctttttaagaccgagaatggtgttaacatgtgcaccctgatggcaatggacttgggcgaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactcggaccgaaacatggatgagctccgagggggcttggaagcacgcccagaggatcgagacttgggtgcttcggcatcctggattcaccgttatggcagccatactggcttacacaatcggcaccacgtattttcagcgcgtgttgattttcatcctcctgactgcagtcgccccatctatgacaatgagatgcattggcatctcgaacagggactttgtggaaggggtatcaggaggtagctgggttgatatagtgctggagcacggcagttgtgtcaccactatggctaaaaataagcccacactcgacttcgaattaattaagaccgaggccaaacaccctgcgacgctgcggaagtactgcatcgaagcaaaacttaccaacacaactaccgcctcccgctgtccaacacagggggagccctctttgaatgaggaacaagataagcgatttgtgtgcaaacatagcatggtggacagaggatggggcaacggttgtgggctgttcggaaagggcggcattgtcacttgcgctatgtttacctgcaagaaaaatatggaggggaagatcgttcagcctgaaaacctagagtatacaatcgtgattaccccacactccggagaagagaatgccgtaggtaacgatactggcaaacatgggaaggagataaaagtgacgccgcagtcaagtatcacagaagcagagctcaccggatacggcactgctaccatggaatgtagccccaggacaggtctggacttcaatgagatggtccttctgcagatggaaaacaaggcctggttggtgcaccggcaatggtttctcgatctgcctttaccatggctgcccggggcggacacccagggctctaactggattcagaaagagactctcgttacattcaagaatcctcacgccaagaaacaggatgtggtcgtgcttggatcccaagagggcgcaatgcatacggctctgaccggggccactgaaatccagatgtcaagcggaaacttgctatttacaggtcacctgaagtgccgtctccgcatggacaaactgcagcttaagggcatgagttattctatgtgtaccgggaaattcaaggtagttaaggagatagctgaaacacaacatggaactattgtgatcagagtccagtacgagggcgacggttccccatgcaaaatccccttcgagattatggatctggaaaagaggcacgtgttggggcggctcatcaccgtcaatccgattgtgacggagaaagacagccctgttaacatagaagccgagcccccatttggcgattcgtacatcattatcggagtggaacctggccagctgaagttatcttggttcaaaaaggggtcctcaatcggacagatgtttgagaccacaatgcgaggtgcaaagcgcatggccattctgggcgacactgcttgggatttcgggagtctaggaggcgtatttaccagcataggtaaagcgctccatcaagtcttcggggcaatctatggcgccgctttttccggagtgtcttggacaatgaagattctgatcggcgttgtgattacttggatcgggatgaatagcagatcaaccagtctttccgtcagcttggtgctggtaggaatagtgacgctctacctgggcgttatggtccaggccgactctggttgtgtggtgtcatggaaaaacaaggagcttaaatgcgggagtggaatcttcattacagataatgtccacacctggactgaacagtataagtttcagcccgagagcccatccaagctggcatctgccatccaaaaagctcacgaagagggcatttgtggtatcaggtcggttacacggttggaaaacctcatgtggaagcagataacccccgagctgaatcatattttaagcgagaacgaagtgaaactgactatcatgaccggcgacattaaggggatcatgcaggccggaaaacgctccctaagacctcagccaacagagctcaagtactcatggaaagcatggggcaaggcgaagatgctgagtacggaacttcacaatcataccttcttgatagatgggccggagactgctgaatgccccaacacaaatagggcctggaactctctggaggtggaggactatggatttggcgtattcaccacaaatatctggctcaaactgaaggaacgtcaagatgtcttttgtgacagcaaattaatgtccgcagccattaaggacaaccgggctgtgcacgccgatatgggttactggatcgagtcagcactgaacgacacttggaaaattgaaaaggctagcttcatcgaggttaagtcttgccactggcctaaatcccataccctttggagtaatggggtgttggagagcgaaatgataattccaaagaacttcgccggacccgtctctcagcacaattatcgacctggctaccatacgcagacagcgggtccatggcacctcggcagactggagatggattttgacttctgtgaagggaccactgtggttgtgaccgaggattgcggaaacaggggcccctccctacgcacaactaccgcctcagggaaactgatcacagaatggtgctgtcggagttgcacgctcccgcctctgagatacaggggagaggacggctgttggtatggtatggagatccgcccacttaaggaaaaagaggaaaatttggtaaacagcctggtcaccgctgggcatggacagattgataatttttcgttaggcgtgctcggtatggcactgttccttgaggaaatgctgcgaactcgggtgggcacaaagcacgccatcttgctcgtcgctgtttcctttgtgaccctgattactgggaacatgtctttccgtgacctaggaagagtaatggtgatggtcggcgccacaatgaccgatgacatagggatgggagtgacgtacctggcactcctggcggcctttaaggttaggcccactttcgctgccggccttttgctgcgcaaattaaccagcaaggagctcatgatgacaaccatcggtattgtgctgctttcacaaagtactatccctgagacaattctggaactaaccgatgcactcgctctggggatgatggtcttgaaaatcgtgcggaatatggagaagtatcagctggccgttacaataatggcaatcttatgcgtgcccaacgccgtcattctccagaatgcttggaaagtatcctgtactatcctggcggtggtttctgtgagcccacttctgttgacctcctcacaacagaaggccgactggattcctctcgcactgacgatcaagggactaaaccccacagctatatttctgaccactcttagcagaaccagtaaaaagaggtcttggccactcaatgaagccattatggccgtcggcatggtgtccatcctggctagctcgttgctgaaaaacgatatcccgatgacaggccctttagtagcagggggactcctgactgtgtgctacgtccttaccggtcgatcagccgacctggagttggaacgcgcggctgacgttcggtgggaggagcaggccgaaatttctggcagttcccccatactcagcatcacgatttctgaggatgggagcatgtccatcaagaatgaagaggaggaacagacactgaccattctaatcagaactggactgcttgtgatatcaggcctcttcccagtgagtatccccattacagcagccgcttggtatctgtgggaggtcaaaaagcaaagggccggtgtgttgtgggacgttcctagcccaccccctgtagggaaagccgaattagaggatggagcgtaccgtatcaagcagaagggcattctgggctattctcagatcggggctggagtgtacaaagaaggtacctttcacactatgtggcatgtcacacgcggcgccgtgctcatgcacaaggggaaacggatagagccgtcctgggcagacgttaagaaagatctgatttcatacggaggcggttggaaacttgagggggaatggaaggagggagaagaggtgcaggtcctggccttggaaccaggcaaaaaccccagagctgtgcaaaccaagcctggcctattcaaaacgaacactgggaccatcggagccgtaagtctggactttagcccaggtacatccggctctcccatcgtcgataagaaagggaaggtggttggactctatggcaatggtgtggtcaccaggtcggggacatacgtgagcgcaattgctcagactgagaagtcaatcgaggacaaccctgaaatagaggatgacattttcagaaagaaacggctgaccatcatggatcttcatccgggagccggcaaaacgaagcgctatttacccgcgattgttagagaagccatcaaaaggggcctgcggacactcatattggcaccaactcgagtggtcgctgccgagatggaagaggctctgagagggctccctattcgctaccagacccccgcaatcagggccgagcacacaggacgtgaaatcgtggacctgatgtgtcatgccaccttcactatgcggcttctgtccccaattagagtacctaattataacttgatcattatggatgaggctcactttaccgaccccgcgagtatagcagccaggggttacatctctacacgcgtggaaatgggcgaggctgccgggattttcatgacggcaactccaccgggaagccgagacccttttccccagtccaatgccccaatcatggatgaggaaagagagatccccgaacggtcatggaactctggccacgagtgggttaccgacttcaagggtaagacagtctggtttgtgcctagcattaaagctgggaatgatatagcggcctgcctaaggaagaacggcaaaaaggtgatccaactgagtcgcaaaaccttcgactccgaatatattaagactcgtacaaatgattgggactttgtcgtaaccacggatatcagcgagatgggcgcaaacttcaaggctgagagagtgattgacccacggaggtgtatgaaacccgttatcctcactgatggcgaagaacgcgtgatattagccgggcctatgccggtcacacattcttcagcagcccagcgaagaggacgggtgggtaggaatccaaagaacgaaaatgaccagtacatctacatgggcgagcccctggaaaacgatgaggactgcgctcactggaaagaggccaagatgcttctggacaatattaacacccctgaagggatcattccctccatgtttgagccagaacgcgagaaagttgatgcgatcgacggagaatatagactcaggggcgaggcacggaagaccttcgtggatttgatgcgtcgcggtgacctgcctgtctggctcgcctaccgagtggctgccgaggggataaactatgctgatagaaggtggtgttttgacggcgtcaaaaataaccaaattctggaagagaatgtggaagttgagatctggactaaggagggagaacggaagaaacttaagccccgctggctagatgcaagaatttacagtgacccactggccttgaaagagttcaaggagttcgctgccggcaggaagtcgttaacactgaacctcatcaccgagatggggcggctgcctacatttatgactcagaaggcacgaaatgcgcttgataacctggccgtcctccatacggctgaagccggaggtagagcatataatcacgctttgagcgagctgccggagaccctagaaacactgctccttctgactttattggccaccgtgacaggcgggatattcctgtttctcatgtctggaaagggcatcggtaaaatgaccctggggatgtgctgcattatcactgcatccattcttctgtggtacgcccagatccagccccactggatagctgcgagcattatcctcgagttctttttgatcgtgctgttaattccagaacctgagaagcaacgcacgccccaggacaaccagctaacctatgtcgttatcgccatactgacagtggtagcagctactatggccaatgaaatgggcttcctcgagaaaaccaagaaagattttggacttggctcaattacaacccagcaaccagacagtaacatcctggatattgacttgaggcctgcctctgcatggactctgtacgctgtggccacaacgttcatcacccccatgctccggcattccatagagaatagctcagtcaacgtgagtctgactgcgatcgctaatcaggccacagttcttatggggctcggaaagggttggccgctgagcaagatggacattggcgtgccattgctggcaatcgggtgttactcccaggtcaaccctattaccttaaccgccgctctactgctccttgtagcacactatgccatcattggacccggcctgcaggcgaaagctacacgtgaagcccaaaagagagcagccgctggtatcatgaaaataccagccgcagatgggatgactgtgattgacttggatcccatcccttacgacccgaagtttgagaaacagctgggccaggttatgctcctggtgctttgcgtcacacaggtgttaatgatgaggaccacatgggctctgtgtgaagccctcactttggcgaccggacccatctctacactgtgggagggcaatccagggcgcttctggaacaccactattgccgtcagcatggcaaatatatttcggggatcctatctagctggcgccggtctactcttctcaatcatgaagaacacggcaaacacacgaagagggaccggaaatactggcgaaacccttggtgagaagtggaaaaacaggctgaatgctttgggcaagtctgagtttcaaatttacaaaaagagtgggatccaggaagtggatcgcacactggccaaagagggaattaagcggggcgaaactgaccatcacgccgtttcgagagggagcgcgaaactccgttggttcgtggagaggaacctggtaacccctgagggaaaggtggtcgatttaggctgcggtagagggggatggtcctattactgtggcggtcttaagaatgttaaagaagtgaagggcctgacaaaagggggacccggccatgaggaacctatcccaatgtctacgtatgggtggaacctcgtccgcctacagtcaggagtggacgtattctttacaccccctgagaagtgcgatactctgttgtgtgacataggcgaaagctccccaaatcccacagtggaggctggtcgaaccctgagagttctcaaccttgtggagaattggctgaacaataacactcaattctgcatcaaagtcttgaatccgtacatgcctagtgtgattgaaaagatggaggcactgcagaggaagtacgggggagccctcgtccggaacccattatctcgcaatagcacacacgaaatgtattgggtgtcaaacgcttccggcaacatcgttagtagcgtaaatatgatttctagaatgctgatcaacaggtttaccatgaaacacaagaaagccacgtacgagcccgatgtggaccttggctccgggacccgaaatataggaattgaatcagagacacctaacctggatatcatcggtaagcggattgagaaaataaagcaggaacatgagactagctggcactatgaccaggaccatccatacaagacctgggcatatcacggctcgtacgaaacaaaacaaactgggtctgccagttccatggtcaatggagtggttcgtctactcaccaagccctgggatgtgatcccgatggtcacacagatggctatgaccgacactacgcctttcggccagcagagagtgtttaaagagaaggtagatacacgcacccaagaacccaaagagggtactaagaagctgatgaaaattaccgcggagtggttgtggaaggaactggggaaaaagaaaacaccaaggatgtgtacgcgggaggagttcaccagaaaggtgcgcagcaacgccgcactcggagctatctttactgacgagaataaatggaagtcagccagggaggcagttgaagattccggcttctgggagcttgtcgacaaggaacgaaacctgcacttagagggcaaatgcgaaacatgtgtgtataatatgatggggaagcgggagaaaaagctgggagagtttggtaaagccaagggctctagagctatttggtacatgtggttgggggccaggttcctcgaatttgaggcgctgggattcctaaacgaagatcattggtttagccgcgagaatagtctttccggcgtggaaggtgaggggctgcacaagctcggatacatcctgcgtgacgtcagcaaaaaggagggcggcgcaatgtatgccgatgacaccgctgggtgggatactcggataacattggaagacctgaaaaacgaggaaatggttaccaatcatatggagggagaacacagaaagctcgccgaggcaatcttcaggcttacataccagaacaaagtggtacgcgtgcagcgacctactccccggggtaccgtcatggacattatctctagaagggatcagcgcggctcagggcaagtggttacgtatggactgaataccttcacaaacatggaggctcagttaattagacagatggaaggcgagggtgtgtttaagagtatccaacatctgactgtcaccgaagagattgccgtgaagaactggttggagcgggtagggagggaacgtctctcccgaatggctataagcggagacgattgcgttgtgaaaccactggacgatcgcttcgcctctgcactaacagcgcttaatgacatgggcaaggtcagaaaagatatccagcagtgggagccctcgcggggctggaacgactggactcaggtgcctttttgctcacaccacttccatgaactgattatgaaggatgggagggtgctcgtcgttccatgtcgcaatcaagacgagctgatcggacgagcacggatcagccagggtgctggctggtccttgagggaaaccgcctgcttagggaaaagttacgcacagatgtggtctctgatgtattttcaccgacgtgatctcagacttgctgccaacgcaatttgtagcgccgtgccgtcccattgggtacccatatcacgcacgacatggagtatccacgcgacccacgagtggatgactacagaggacatgctgaccgtgtggaatcgggtctggattcaggaaaacccttggatggaggataagactccagtggaatcttgggaggaaatcccctacctaggaaagagggaggaccaatggtgcggcagcctgattggtctcacctccagagctacatgggccaaaaatatccagacggcaataaaccaggttcgctcattgatcgggaatgaggaatataccgactacatgcctagcatgaagcggttcaggcgagaggaagaggaagccggagtgctgtggtga

SEQ ID NO: 14326 - RNA, 9876 nt, synthetic construct
  misc_feature 1..9876: note = derived and/or modified CDS sequence (opt3) from DENV-2__KX380831__SS-prME
  source 1..9876: mol_type = other RNA
accgccggcatcattataatgatgatccccaccgtgatggctttccacctgactacgaggaatggggagcctcatatgattgtcagcaggcaggaaaagggaaagtccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgttgcgctcgtgccccatgtcggcatgggtctggagactaggaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcagcctcagaccccagcctacggagctgaagtactcctggaaagcctggggcaaggcaaagatgctttcaaccgaattgcacaatcatactttcctgatcgatgggccagagacagcggaatgcccgaacaccaatagggcttggaacagtctcgaggtcgaggactatggatttggcgtgttcacaactaatatatggctgaaattaaaggaacgtcaagatgtattttgtgactctaacctgatgagcgccgcaatcaaagacaaccgggccgtgcacgctgatatgggttactggattgagtccgcccttaatgacacctggaagatcgaaaaagcatcattcattgaggtcaagagctgccactggcccaagtctcatacgttgtggtccaacggggtgctcgagagtgaaatgatcatacctaaaaatttcgctggaccagttagccagcacaactatcgacccggctaccatacacagaccgccggtccttggcacctgggcagactagagatggattttgacttctgtgaagggactaccgtggtagtcacagaggattgcggaaataggggcccatctctgcgcactaccacagcgtccgggaagctcattacggaatggtgctgtcggtcatgcaccctgcccccgcttagatacaggggagaggacggctgttggtatggtatggagatccgccctttgaaagaaaaggaggaaaacctggtgaatagtttagtgactgccgggcatggacagatcgataactttagcctcggcgtcctgggtatggctcttttcctggaggaaatgttgcgaacacgggttggcaccaaacacgcaattctcctggtggccgtatcgtttgtgactctaatcacagggaatatgtccttccgtgacctgggaagagtcatggtgatggttggcgctaccatgacggatgacattgggatgggagtgacttacctcgccctgcttgcagcgtttaaggtcaggccaaccttcgccgctggcttgctgttacgcaagctcacatctaaagagctgatgatgaccactataggtatcgtgcttctgagccaatcaacaattcccgagagtatcctagaactcaccgatgccctggcattggggatgatggttctgaagattgtgcggaacatggagaaatatcagttagctgtcacaatcatggccatactctgcgtacctaatgcagtgatcctgcagaacgcctggaaggtttcctgtactacccttgctgtggtctctgtgagccccctgttgctcacgtcctcacaacagaaagcggactggattccactggccctaacaatcaagggactgaatcctaccgcaatttttcttactaccctcagcagaacaagtaagaaaaggtcttggcccctgaacgaagctatcatggccgtaggcatggtgtccatattggccagctcgctgttaaagaatgatattccaatgactggcccgctcgtcgctgggggactgcttaccgtttgctacgtgctgacgggtcgatcagcagacttggagctcgaacgcgccgcggacgtgcggtgggaggagcaggctgaaatctctggcagttcccctatcctgagcattacaatatctgaggatgggagcatgtccatcaaaaacgaagaggaggaacagaccctaactattctgatcagaacaggacttctcgtcatttcaggcctgttccccgtgagtatcccaataaccgccgcagcctggtatttgtgggaggttaagaaacaaagggctggtgtattatgggacgtgcccagccctccacccgtcgggaaggcagaactggaggatggagcctaccgtatcaaacagaagggcattctcggctattctcagatcggggcgggagtgtacaaggaaggtacttttcacacaatgtggcatgttacccgcggcgctgtgctgatgcacaaagggaagcggattgagccttcctgggccgacgtcaaaaaggatcttatctcatacggaggcggttggaaactggagggggaatggaaggagggagaagaggtgcaggtattggcactagaaccgggcaagaacccaagagccgtccaaacgaaacccggcctgttcaagactaataccgggacaataggagctgtgagtctcgactttagccctggtacctccggctctccaattgttgataaaaaggggaaagtggtcggactgtatggcaacggtgtggttacaaggtcggggacttacgtgagcgccatcgcacagaccgagaagtcaatcgaggacaatcccgaaattgaggatgacatcttccgaaagaaacggcttacgataatggatttacatcctggagctggcaagacaaaacgctatctgccggccattgtcagagaagcgatcaagaggggcctccggactttgattctggcccccacccgagtggtagcagctgagatggaagaggccctcagagggctgccaatccgctaccagacccctgctataagggcagagcacacaggacgtgaaattgtggaccttatgtgtcatgccactttcaccatgcggctgttgtcccccatcagagttccaaactataatctaatcattatggatgaggcccactttacagaccctgctagtatcgcggcaaggggttacatttctacgcgcgtcgaaatgggcgaggccgctgggatattcatgactgccacacccccaggaagccgagacccgtttcctcagtccaacgcacccatcatggatgaggaaagagagattccagaacggtcatggaactctggccacgagtgggtgacagacttcaaaggtaagaccgtgtggtttgtccccagcatcaaggccgggaacgatatcgctgcgtgcctgaggaaaaatggaaagaaagtaattcaactcagtcgcaagactttcgactccgaatatataaaaacacgtaccaacgattgggactttgtggttacgactgatatcagcgagatgggcgccaatttcaaggcagagagagtgattgaccctcggaggtgtatgaagccagtcatcttaacagatggcgaagaacgcgtgattctggctgggcccatgcctgttacccattcttcagccgcacagcgaagaggacgggtgggtaggaacccgaaaaatgaaaacgaccagtacatctacatgggcgagccacttgaaaatgatgaggactgcgcccactggaaggaggctaaaatgctgctcgacaacataaacacccccgaagggatcattccttccatgtttgagcccgaacgcgagaaggtcgatgccatcgacggagaatatagattgaggggcgaggcgcggaaaactttcgtggatctgatgcgtcgcggtgacctcccagtatggctggcataccgagtggccgctgaggggattaattatgccgatagaaggtggtgttttgacggcgttaagaacaatcaaatccttgaagagaacgtcgaagtggagatatggacaaaagagggagaacggaagaagctaaaacctcgctggctggatgctagaatttacagtgaccccttggcattaaaggagttcaaagagttcgccgctggcagaaagagcctgaccctcaatctgatcacagagatggggcggcttccaacttttatgacgcagaaagccaagaacgcactggataatctcgcggtgttgcataccgccgaagctggaggtcgagcctataaccacgcactgtcggagctacctgagacactggaaactctccttctgttaaccttgctggctacagtcaccggcgggattttcctctttctgatgtctggaaagggcatcggtaaaatgactcttgggatgtgctgcataatcacggcctccattctgctctggtacgcacagatccagccgcactggattgccgctagcatcatattggagttctttctgattgttttactaatccccgaaccagagaagcaaagaacccctcaggacaatcagctgacatatgtggtaatcgcgattctcactgtggtcgccgcaaccatggctaacgaaatgggcttccttgagaaaacaaagaaagattttggactgggctcaatcaccactcagcaacccgagagtaatatattggacattgatctgcgcccagcctctgcctggacactctacgcagtggctacgaccttcatcactcctatgctgaggcattccattgaaaacagctcagttaatgtgagtcttacagccatcgcgaaccaggctaccgtcctcatggggctgggaaagggttggcccttgagcaagatggacataggcgtaccgctgttagccatcgggtgttactcccaggtgaatccaattaccctaacagcagccctgctccttctggttgctcactatgcaatcattggacctggcttgcaggccaaagcgactcgggaggctcaaaagcgtgccgcagccggtatcatgaaaaaccccacggtggacgggatgaccgtcattgatctggacccaatcccctacgatcctaagtttgaaaaacagctcggccaggtgatgctgcttgtcttatgcgtgacacaggttctgatgatgagaactacctgggctctctgtgaggccttgacactggcaaccggaccgatatctactctatgggaaggcaatcccgggaggttctggaacacgacaattgctgtgagcatggccaacatctttcgcggatcctatctggcgggcgccggtctccttttctcaatcatgaagaataccgcaaacactcggcgagggaccggaaatacaggcgagactctgggtgagaagtggaaaaacagattgaatgctctgggcaagtctgaatttcaaatttacaaaaagagtgggatacaggaggtagacaggaccctcgccaaagaaggaatcaagcgcggcgagacagatcatcacgcagtgtcgcgggggagcgctaaactgagatggttcgtcgagcgtaacttagttacgccagaaggaaaggtggtcgaccttggctgcggtagagggggatggtcctattactgtggcggtctgaagaatgtgaaagaggtaaagggcctcaccaaagggggacctggccatgaggaacccattcctatgtctacttatgggtggaacctagtgcggctgcagtcaggagttgatgtgttctttacaccacccgaaaagtgcgacaccttgctgtgtgatatcggcgagagctcccctaatccaactgtcgaggccggtcgcacactccgagtgcttaacctggtcgaaaattggttgaacaataacacccaattctgcattaaagtgctgaatccctacatgccgagtgttatcgagaagatggaagccctccagagaaagtacgggggagcgttagtaaggaaccctctgtctcggaacagcacgcacgagatgtattgggtgtcaaatgcttccggcaacatagtcagtagcgtgaataccatctctcgcatgcttattaacagatttacaatgaggcacaaaaaggcaacttacgaaccagacgttgatctgggctccgggacccgaaatatcggaattgagtcagagacacccaacctagacatcataggtaaacggattgaaaagatcaaacaggagcatgaaactagctggcactatgatcaggaccatccttacaagacctgggcctatcacggctcgtacgagacaaagcaaaccgggtctgctagttccatggtgaatggagtcgtgcgtctcctgactaaaccatgggacgtaatccccatggtgacgcagatggccatgacagataccactccgttcggccagcagagagtttttaaggaaaaagtcgacacccgcacacaagagcctaaggagggtacgaaaaagttgatgaagattaccgcagaatggctgtggaaagagctcgggaagaaaaagactcccaggatgtgtacacgggaagagttcaccagaaaagtgcgcagcaacgccgctcttggagcgatatttactgatgagaataagtggaaatcagccagggaagcagtggaggactccggcttctgggaactggtcgataaggagcgaaacttacacctggaaggcaagtgcgagacatgtgtttataatatgatggggaaacgggagaagaaattgggagaatttggtaaggctaaaggctctagagccatctggtacatgtggctcggggcaaggttcctggagtttgaagccctaggattccttaacgaggaccattggtttagccgcgaaaatagtctgtccggcgtggagggtgaggggctccacaagctgggatacattttgcgtgatgtaagcaagaaagaaggcggcgctatgtatgccgacgataccgcggggtgggacacacggatcactctggaggatctcaagaacgaagagatggtgaccaatcatatggaaggagagcacaagaaacttgcagaggccattttcaaactgacgtaccagaacaaagtcgtgagagttcagaggccaacccctcgcggtacagtgatggacatcatatctcgacgggaccagagaggctcagggcaagtcgtgacttatggattaaacaccttcacaaatatggaagctcagctgatcaggcagatggagggcgaaggtgtatttaagagtattcaacagttgactgttaaagaggagatcgccgtgaagaactggctcattcgcgtcgggagagaacggctgtccaggatggcaatcagcggagatgactgcgtggtgaaacccctagatgaccgtttcgcttctgcccttaccgctctgaatgatatgggcaaggtccgaaaagacattcagcagtgggagccatcgcgcggctggaacgattggacgcaagttcccttttgctcacatcacttccacgaactcataatgaaggacgggagagtgctggtagtgccttgtcggaatcaggatgagttgatcggaagggcccgcattagccagggtgcaggctggtccttaagagaaacagcgtgcctggggaagagttacgcccagatgtggtctctcatgtattttcatcggagggaccttcgactggctgccaacgcaatctgtagcgctgtcccatcccactggatcccgacctcacgtactacatggagtattcatgccacccacgagtggatgactaccgaggatatgctaacagtgtggaatagagtttggatacaagaaaacccctggatggaggacaaaacgcctgtggaatcttgggaggaaatcccatacctgggaaagcgcgaggatcagtggtgcggcagcctcattggtttgacctcccgggcaacttgggccaaaaatatccagacagcgattaaccaggtcaggtcactgatcgggaatgaggaatataccgactacatgcccagcatgaagagattccgccgggaggaagaggaagctggagtgctttggtga

SEQ ID NO: 14327 - RNA, 9876 nt, synthetic construct
  misc_feature 1..9876: note = derived and/or modified CDS sequence (opt3) from DENV-2__KX380808__SS-prME
  source 1..9876: mol_type = other RNA
accgcaggcatcattataatgatgatcccaacagtgatggctttccacctgactacgaggaacggggaacctcatatgattgtcagcaggcaggaaaagggaaagtccctcctttttaagaccgagaatggtgttaacatgtgcacactgatggcaatggacttgggcgaattatgtgaggatactatcacctacaattgcccactgctgaaacaaaacgaaccggaggacattgattgttggtgcaattctacatcaacctgggtgacttatgggacatgtaccgccacgggagagcaccggcgcgaaaagcgaagtgtagcgctcgtgccacatgtcggcatgggtctggagactcgtaccgaaacatggatgagctccgagggggcttggaaacacgcccagagaatcgagacttgggtgcttaggcatcctggattcaccataatggcagccatcctggcttacacaattggcaccacgtattttcagcgggttttgatcttcattctcctgactgcaatcgccccatctatgacaatgcgctgcataggcatttcgaacagagactttgtggaaggggtctcaggaggtagctgggtggatatcgtactggagcacggcagttgtgttaccactatggctaagaataagcccacactcgacttcgaattaattaaaaccgaggccaagcaccctgcgacgctgaggaaatactgcatcgaagcaaaacttaccaacacaactaccgcctcccggtgtccaacacagggggagccctctttgaatgaggaacaagataaacgctttgtgtgcaagcatagcatggtcgaccgaggatggggcaacggttgtgggctgttcggaaagggcggcatcgtgacttgcgctatgtttacctgcaaaaagaatatggaggggaaaattgtgcagcctgaaaacctagagtatacaatagtcatcaccccacactccggagaagagaatgccgttggtaacgatactggcaagcatgggaaagagattaaggtgacgccgcagtcaagtatcacagaagcagagctcaccggatacggcactgtaaccatggaatgtagccccagaacaggtctggacttcaatgagatggtgcttctgcagatggaaaacaaggcttggttggtccacaggcaatggtttctcgatctgcctttaccatggctgcccggggccgacacccagggctctaactggatacagaaggagactctcgtgacattcaagaatcctcacgcgaaaaagcaggatgttgtggtccttggatcccaagagggcgccatgcatacggcactgaccggggctactgaaattcagatgtcaagcggaaacttgctatttacaggtcacctgaaatgccggctccgtatggacaagctgcagcttaaaggcatgagttattctatgtgtaccgggaagttcaaggtggtaaaagagatcgccgaaacacaacatggaactatcgttattcgcgtgcagtacgagggcgacggttccccatgcaagatccccttcgagattatggatctggagaagcggcacgtcttggggaggctcataaccgtgaatccgatcgtcacggagaaggacagccctgtgaacattgaagctgagcccccatttggcgattcgtacatcatcattggagttgaacctggccagctgaaattatcttggttcaagaaggggtcctcaataggacagatgtttgagaccacaatgcggggtgccaaacgaatggcaatcctgggcgacactgcctgggatttcgggagtctaggaggcgtgtttaccagcattggtaaggctctccatcaagtattcggggcgatctatggcgcagccttttccggagtctcttggacaatgaaaattctgatcggcgtggttataacttggatcgggatgaatagccgctcaaccagtctttccgtgagcttggtcctggtgggagtagtgacgctctacctgggcgttatggtccaggctgactctggttgtgtggtgtcatggaagaacaaagagcttaagtgcgggagtggaattttcatcacagataatgtccacacctggactgaacagtataagtttcagcccgagagcccatccaaactggcctctgcaattcaaaaggcccacgaagagggcatctgtggtataagatcggttacaaggttggaaaacctcatgtggaaacagattacccccgagctgaatcatatcttaagcgagaacgaagtgaagctgactattatgaccggcgacatcaaagggataatgcaggctggaaagcggtccctacgccctcagccaacagagctcaaatactcatggaaggcctggggcaaggcaaaaatgctgagtacggaacttcacaatcataccttcttgatcgatgggccggagactgcggaatgccccaacacaaatagagcttggaactctctggaggtggaggactatggatttggcgtattcaccacaaatatttggctcaagctgaaagaaaggcaagatgtcttttgtgacagcaagttaatgtccgccgcaatcaaagacaaccgtgccgtgcacgctgatatgggttactggattgagtcagccctgaacgacacttggaagatcgaaaaggccagcttcatagagattaaatcttgccactggcctaagtcccataccctttggagtaatggggttttggagagcgaaatgatcatccccaagaacttcgctggacccgtgtctcagcacaattatcggcctggctaccatacgcagacagccggtccatggcacctcggccgactggagatggattttgacttctgtgaagggaccactgtcgtggttaccgaggattgcggaaacagaggcccctccctaaggacaactaccgcgtcagggaagctgattacagaatggtgctgtcgcagttgcacgctcccgcctctgcggtacagaggagaggacggctgttggtatggtatggagatcaggccacttaaagaaaaggaggaaaatttggtgaacagcctggtaaccgccgggcatggacagattgataatttttcgttaggcgtcctcggtatggctctgttccttgaggaaatgctgcgcactcgagtgggcacaaagcacgcaatattgctcgtggccgtctcctttgttaccctgatcactgggaacatgtctttccgggacctaggacgtgtgatggtaatggtgggcgctacaatgaccgatgacattgggatgggagtcacgtacctggccctcctggcagcgtttaaagtgagacccactttcgccgctggccttttgctgaggaagttaaccagcaaagagctcatgatgacaaccatcggtattgttctgctttcacaaagtactatccctgagacaatactggaactaaccgatgccctcgcactggggatgatggtgttgaagatcgtccgcaatatggagaaatatcagctggctgtgacaattatggccatcttatgcgttcccaacgcagtgattctccagaatgcctggaaggtctcctgtactaccctggctgtagtgtctgttagcccacttctgttgacgtcctcacaacagaaggcggactggatccctctcgccctgacaataaaaggactaaaccccaccgcaatttttctgactacccttagccggacaagtaagaaaagatcttggccactcaatgaagctatcatggccgtgggcatggtctccatcctggccagctcgttgctgaagaacgatattccgatgactggccctttagtggctgggggactcctgaccgtatgctacgtgcttacgggtaggtcagcagacctggagttggaacgagccgcggacgtccgctgggaggagcaggctgaaatatctggcagttcccccatcctcagcattacaatctctgaggatgggagcatgtccattaaaaatgaagaggaggaacagaccctgactatcctaatacggacaggactgcttgttatctcaggcctcttcccagtgagtattcccatcaccgccgcagcctggtatctgtgggaggtgaagaaacaaagagctggtgtcttgtgggacgtgcctagcccaccccctgttgggaaggcagaattagaggatggagcctacaggattaagcagaaaggcatcctgggctattctcagataggggcgggagtatacaaggaaggtacttttcacacaatgtggcatgtgacccgtggcgctgtcctcatgcacaaagggaagcgcattgagccgtcctgggccgacgtgaaaaaggatctgatctcatacggaggcggttggaaacttgagggggaatggaaagagggagaagaggttcaggtgctggcattggaaccaggcaagaacccccgggccgtccaaacgaaacctggcctattcaagactaacaccgggacaatcggagctgtgagtctggactttagcccaggtacctccggctctcccattgtagataaaaaggggaaggtcgtgggactctatggcaatggtgttgtgacaagatcggggacttacgtcagcgccatcgcacagaccgagaaatcaatagaggacaaccctgaaattgaggatgacatcttcaggaagaaacgactgacgattatggatcttcatccgggagctggcaagacaaaacggtatttacccgccatcgtgcgcgaagcgataaagagaggcctgaggactctcattttggccccaacccgggttgtggcagctgagatggaagaggccctgcgagggctccctatcagataccagacacccgctatccgcgcagagcacaccggaagggaaattgtcgacctgatgtgtcatgccactttcaccatgcgtcttctgtccccaatccgggtgcctaattataacttgattataatggatgaggcccactttacagaccccgctagtatcgcggcaagaggttacatttctacgagggtagaaatgggcgaggccgctgggatcttcatgactgccaccccaccgggaagccgcgacccttttccccagtccaatgcaccaatcatggatgaggaacgagagattcccgaaagatcatggaactctggccacgagtgggtgacagacttcaagggtaaaaccgtttggtttgtccctagcataaaggccgggaatgatatcgctgcgtgcctacggaaaaacggaaagaaagtgattcaactgagtaggaagactttcgacacagaatatatcaagacccgcacgaatgattgggactttgtggtcactacagatatttccgagatgggcgccaacttcaaagcagagcgtgtaatcgacccaagacggtgtatgaagcccgtgatactcaccgatggcgaagagagggttatcttagctgggcctatgccggtgacccatagctctgccgcacagcgccgaggaagagtcggtcggaatcccaagaacgaaaatgaccagtacatttacatgggcgagcccctggaaaacgatgaggactgcgcccactggaaggaggctaaaatgcttctggacaatatcaacactcctgaagggattatcccctcaatgtttgagccagaaagggagaaggtggatgccatagacggagaatatcgcctcagaggcgaggcgaggaaaacattcgttgatttgatgcggcgtggtgacctgcctgtgtggctcgcataccgcgtcgccgctgaggggattaactatgccgatcgaagatggtgttttgacggcgtgaagaataaccaaatcctggaagagaatgtagaagtggagatttggaccaaggagggagaaaggaagaaacttaaaccccggtggctagatgctcgcatctactccgacccactggcattgaaagagttcaaagagttcgccgctggcagaaagagtttaacactgaacctcataactgagatggggaggctgcctacgtttatgacccagaaggcccggaatgcacttgataacctggcggttctccatacagccgaagctggaggtcgagcctataatcacgcattgagcgagctgccggagactctagaaaccctgctccttctgacattattggctaccgtcactggcgggatcttcctgtttctcatgtcgggaaaaggcattggtaagatgacgctggggatgtgctgcatcattaccgcctctatccttctgtggtacgcacagatacagccccactggattgccgcttccatcatcctcgagttctttttgattgtgctgttaatcccagaacctgagaaacaaagaacaccccaggacaaccagctaacttatgtggtcatagcgattctgaccgttgtggccgcaacaatggctaatgaaatgggcttcctcgagaagaccaaaaaggattttggacttggcagcatcactacacagcaaccagagtcaaacattctggacatcgatttgcgccctgccagtgcctggacgctgtacgcagtagctaccactttcataacacccatgctcaggcattctatcgaaaattccagcgtgaacgtctcactgaccgccattgcgaatcaggctaccgtgcttatggggctcggaaagggttggccgctgagtaaaatggacatcggcgttccattgctggccattgggtgttacagccaggtgaaccctatcacattaactgcagccctactgctccttgtcacgcactatgctattatcggacccggcctgcaggcaaaggccacccgggaggcgcaaaaacgtgctgccgcaggtataatgaagattccaacagtagacgggatcactgtgatcgatttggaccccattccttacgatccgaaatttgaaaagcagctgggccaggttatgctcctggtgctttgcgtcacccaggtgttaatgatgagaacaacctgggccctgtgtgaggctctcactttggccacgggacccatatccacactgtgggaaggcaatccagggaggttctggaacaccactatcgcagtctctatggctaatatttttcgcggaagctatctagccggcgcgggtctactcttctccatcatgaagaacaccgccaacacacggcgagggactggaaataccggcgagacacttggtgagaaatggaagaacagactgaatgcattgggcaaatcagaatttcaaatttacaagaaatctgggatccaggaggtggacaggacgctggctaaggaaggaataaaacgcggcgagaccgatcatcacgccgttagtcgggggtcggcaaagctcagatggttcgtggagcgtaacctggtaactcctgaaggaaaggtggtcgacttaggctgcggtagagggggatggagctattactgtggcggtcttaaaaatgttaaggaggtgaaaggcctgacaaaagggggacccggccatgaagaacctatcccaatgtccacctatgggtggaacctcgtccggctacagtctggagtggatgtattctttactccccctgaaaaatgcgacacactgttgtgtgatattggcgagtcaagcccaaatcccaccgtggaggctggtcgcacgctgcgagttctcaaccttgtggaaaattggctgaacaataacacccaattctgcatcaaggtcttgaatccgtacatgccttccgtgattgagaagatggaagccctgcagagaaaatacgggggagccctcgtcaggaacccattaagtagaaattctacacacgagatgtattgggtgagcaacgcgtcaggcaacatcgtttccagtgtaaatatgataagccgcatgctgattaacagatttactatgaggcacaagaaagctacctacgaacccgacgtggatcttggctctgggacacgaaatatcggaatcgagtccgagactcctaacctggacattataggtaagcggatcgagaaaattaagcaggaacatgaaacctcatggcactatgatcaggaccatccatacaagacatgggcatatcacggcagctacgagaccaaacaaactgggtcggcctctagtatggtcaatggagtggttcgtctactcacgaagccctgggacgtgatcccgatggtcacacagatggctatgaccgatactacccctttcggccagcagagagtgtttaaagaaaaggtagacacacgcacgcaagagcccaaagagggtaccaagaagctgatgaaaattactgccgaatggttgtggaaggagctggggaaaaagaaaacaccaaggatgtgtacccgggaagagttcactagaaaggtgcgctccaacgcagccctcggagctatctttacagatgagaataaatggaaaagcgcgagggaagccgttgaggactcaggcttctgggaacttgtcgataaggagcgaaacctgcacttagaaggcaaatgcgagacctgtgtgtataatatgatggggaagcgggagaaaaagctgggagaatttggtaaagcaaagggctccagagctatatggtacatgtggttgggggccaggttcctcgagtttgaagcactgggattcctaaacgaggaccattggttttctcgcgaaaatagccttagtggcgtggagggtgaggggctgcacaagctcggatacatcctgcgtgatgtctccaaaaaggaaggcggcgccatgtatgctgacgatacagccgggtgggacactcggattaccttggaggatctgaaaaacgaagagatggttacgaatcatatggaaggagagcacaagaaactcgcggaggcaatcttcagacttacctaccagaacaaggtggtaagggtgcagcgccctacaccccgaggtactgtcatggacattatcagccggagagaccagaggggctctgggcaagtggttacctatggactgaatacattcactaacatggaagcccagttaattcgccagatggagggcgaaggtctgtttaagtcaatacaacatttgaccgtgacggaggagatcgctgtcaaaaactggctcgtgagagtagggcgggaaaggctgagtcgtatggccatttccggagatgactgcgttgtgaagccactagatgaccgattcgcaagcgctcttacagccctgaatgatatgggcaaagtccgcaaggacatccagcagtgggagccctctagaggctggaacgattggacccaggtgcctttttgctcgcaccacttccatgaactcatcatgaaagacgggcgggtgctggtcgttccatgtaggaatcaagatgagttgattggacgcgctagaatatcacagggtgccggctggagcttacgggaaactgcatgcctggggaagtcctacgcgcagatgtggagtctcatgtattttcacaggcgagaccttcgtctggccgctaacgccatctgttctgcagtgccgagccattgggtacccacatccagaaccacttggtcaattcacgctacccacgagtggatgacaacggaggatatgctaaccgtgtggaatcgcgtctggatccaggaaaacccttggatggaggacaagactccagtggaaagttgggaggaaattccctacctgggaaaacgggaggatcaatggtgcggctctctcatcggtttgacaagcagggccacctgggcaaagaatatacagactgccatcaaccaggttagatccctgattgggaatgaggaatatacagactacatgccttcaatgaaacgcttccggagggaggaagaggaagcgggagtgctttggtga

SEQ ID NO: 14328 - RNA, 9876 nt, synthetic construct
  misc_feature 1..9876: note = derived and/or modified CDS sequence (opt3) from DENV-2__KX380832__SS-prME
  source 1..9876: mol_type = other RNA
accgccggaatcattataatgatgatccccacggtgatggctttccacctgactacgagaaacggggaacctcatatgattgtaagcaggcaggaaaagggaaaatccctcctttttaagaccgagaatggtgttaacatgtgcacactgatggcaatggacttgggcgaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactcggaccgaaacatggatgagctccgagggggcttggaagcacgcccagaggatcgagacttgggtgcttcggcatcctggattcaccgttatggcagccatactggcttacacaatcggcaccacgtattttcagcgcgtgttgattttcatcctcctgactgcagtcgccccatctatgacaatgagatgcattggcatctcgaacagggactttgtggaaggggtatcaggaggtagctgggttgatatagtgctggagcacggcagttgtgtcaccactatggctaaaaataagcccacactcgacttcgaattaattaagaccgaggccaaacaccctgcgacgctgcggaagtactgcatcgaagcaaaacttaccaacacaactaccgcctcccgctgtccaacacagggggagccctctttgaatgaggaacaagataagcgatttgtgtgcaaacatagcatggtggacagaggatggggcaacggttgtgggctgttcggaaagggcggcattgtcacttgcgctatgtttacctgcaagaaaaatatggaggggaagatcgttcagcctgaaaacctagagtatacaatcgtgattaccccacactccggagaagagaatgccgtaggtaacgatactggcaaacatgggaaggagataaaagtgacgccgcagtcaagtatcacagaagcagagctcaccggatacggcactgctaccatggaatgtagccccaggacaggtctggacttcaatgagatggtccttctgcagatggaaaacaaggcctggttggtgcaccggcaatggtttctcgatctgcctttaccatggctgcccggggcggacacccagggctctaactggattcagaaagagactctcgttacattcaagaatcctcacgccaagaaacaggatgtggtcgtgcttggatcccaagagggcgcaatgcatacggctctgaccggggccactgaaatccagatgtcaagcggaaacttgctatttacaggtcacctgaagtgccgtctccgcatggacaaactgcagcttaagggcatgagttattctatgtgtaccgggaaattcaaggtagttaaggagatagctgaaacacaacatggaactattgtgatcagagtccagtacgagggcgacggttccccatgcaaaatccccttcgagattatggatctggaaaagaggcacgtgttggggcggctcatcaccgtcaatccgattgtgacggagaaagacagccctgttaacatagaagccgagcccccatttggcgattcgtacatcattatcggagtggaacctggccagctgaagttatcttggttcaaaaaggggtcctcaatcggacagatgtttgagaccacaatgcgaggtgcaaagcgcatggccattctgggcgacactgcttgggatttcgggagtctaggaggcgtatttaccagcataggtaaagcgctccatcaagtcttcggggcaatctatggcgccgctttttccggagtgtcttggacaatgaagattctgatcggcgttgtgattacttggatcgggatgaatagcagatcaaccagtctttccgtcagcttggtgctggtaggaatagtgacgctctacctgggcgttatggtccaggccgactctggttgtgtggtgtcatggaaaaacaaggagcttaaatgcgggagtggaatcttcattacagataatgtccacacctggactgaacagtataagtttcagcccgagagcccatccaagctggcatctgccatccaaaaagctcacgaagagggcatttgtggtatcaggtcggttacacggttggaaaacctcatgtggaagcagataacccccgagctgaatcatattttaagcgagaacgaagtgaaactgactatcatgaccggcgacattaaggggatcatgcaggccggaaaacgctccctaagacctcagccaacagagctcaagtactcatggaaagcatggggcaaggcgaagatgctgagtacggaacttcacaatcataccttcttgatagatgggccggagactgctgaatgccccaacacaaatagggcctggaactctctggaggtggaggactatggatttggcgtattcaccacaaatatctggctcaaactgaaggaacgtcaagatgtcttttgtgacagcaaattaatgtccgcagccattaaggacaaccgggctgtgcacgccgatatgggttactggatcgagtcagcactgaacgacacttggaaaattgaaaaggctagcttcatcgaggttaagtcttgccactggcctaaatcccataccctttggagtaatggggtgttggagagcgaaatgataattccaaagaacttcgccggacccgtctctcagcacaattatcgacctggctaccatacgcagacagcgggtccatggcacctcggcagactggagatggattttgacttctgtgaagggaccactgtggttgtgaccgaggattgcggaaacaggggcccctccctacgcacaactaccgcctcagggaaactgatcacagaatggtgctgtcggagttgcacgctcccgcctctgagatacaggggagaggacggctgttggtatggtatggagatccgcccacttaaggaaaaagaggaaaatttggtaaacagcctggtcaccgctgggcatggacagattgataatttttcgttaggcgtgctcggtatggcactgttccttgaggaaatgctgcgaactcgggtgggcacaaagcacgccatcttgctcgtcgctgtttcctttgtgaccctgattactgggaacatgtctttccgtgacctaggaagagtaatggtgatggtcggcgccacaatgaccgatgacatagggatgggagtgacgtacctggcactcctggcggcctttaaggttaggcccactttcgctgccggccttttgctgcgcaaattaaccagcaaggagctcatgatgacaaccatcggtattgtgctgctttcacaaagtactatccctgagacaattctggaactaaccgatgcactcgctctggggatgatggtcttgaaaatcgtgcggaatatggagaagtatcagctggccgttacaataatgactatcttatgcgtgcccaacgcagtcattctccagaatgcctggaaagtatcctgtaccatcctggctgtggtttctgtgagcccacttctgttgacgtcctcacaacagaaggcggactggattcctctcgccctgacaatcaagggactaaaccccaccgcaatatttctgactacccttagcagaacaagtaaaaagaggtcttggccactcaatgaagctattatggccgtcggcatggtgtccatcctggccagctcgttgctgaaaaacgatatcccgatgactggccctttagtagctgggggactcctgaccgtgtgctacgtccttacgggtcgatcagcagacctggagttggaacgcgccgcggacgttcggtgggaggagcaggctgaaatttctggcagttcccccatactcagcatcacaatttctgaggatgggagcatgtccatcaagaatgaagaggaggaacagaccctgactattctaatcagaacaggactgcttgtgatatcaggcctcttcccagtgagtatccccattaccgccgcagcctggtatctgtgggaggtcaaaaagcaaagggctggtgtgttgtgggacgttcctagcccaccccctgtagggaaagcagaattagaggatggagcctaccgtatcaagcagaagggcattctgggctattctcagatcggggcgggagtgtacaaagaaggtacttttcacacaatgtggcatgtcacccgcggcgctgtgctcatgcacaaggggaaacggatagagccgtcctgggccgacgttaagaaagatctgatttcatacggaggcggttggaaacttgagggggaatggaaggagggagaagaggtgcaggtcctggcattggaaccaggcaaaaaccccagagccgtgcaaacgaagcctggcctattcaaaactaacaccgggacaatcggagctgtaagtctggactttagcccaggtacctccggctctcccatcgtcgataagaaagggaaggtggttggactctatggcaatggtgtggtcacaaggtcggggacttacgtgagcgccattgcacagaccgagaagtcaatcgaggacaaccctgaaatagaggatgacattttcagaaagaaacggctgacgatcatggatcttcatccgggagctggcaaaacaaagcgctatttacccgccattgttagagaagcgatcaaaaggggcctgcggactctcatattggccccaacccgagtggtcgcagctgagatggaagaggccctgagagggctccctattcgctaccagacacccgctatcagggcagagcacaccggacgtgaaatcgtggacctgatgtgtcatgccactttcaccatgcggcttctgtccccaattagagtacctaattataacttgatcattatggatgaggcccactttacagaccccgctagtatagcggcaaggggttacatctctacgcgcgtggaaatgggcgaggccgctgggattttcatgactgccaccccaccgggaagccgagacccttttccccagtccaatgcaccaatcatggatgaggaaagagagatccccgaacggtcatggaactctggccacgagtgggttacagacttcaagggtaagaccgtctggtttgtgcctagcattaaagccgggaatgatataactgcttgcctaaggaagaacggcaaaaaggtgatccaactgagtcgcaaaacattcgactccgaatatattaagacccgtacgaatgattgggactttgtcgtaactacagatatcagcgagatgggcgcgaacttcaaggccgagagagtgattgacccacggaggtgtatgaaacccgttatcctcaccgatggcgaagaacgcgtgatattagcagggcctatgccggtcacccattcttcagctgcccagcgaagaggacgggtgggtaggaatccaaagaacgaaaatgaccagtacatctacatgggcgagcccctggaaaacgatgaggactgcgcacactggaaagaggccaagatgcttctggacaatattaacactcctgaagggatcattccctccatgtttgagccagaacgcgagaaagttgatgctatcgacggagaatatagactcaggggcgaggcccggaagacattcgtggatttgatgcgtcgcggtgacctgcctgtctggctcgcgtaccgagtggcagccgaggggataaactatgctgatagaaggtggtgttttgacggcgtcaaaaataaccaaattctggaagagaatgtggaagttgagatctggaccaaggagggagaacggaagaaacttaagccccgctggctagatgccagaatttacagtgacccactggctttgaaagagttcaaggagttcgcagccggcaggaagtcgttaacactgaacctcatcactgagatggggcggctgcctacgtttatgacccagaaggctcgaaatgcccttgataacctggcagtcctccatacagcggaagccggaggtagagcttataatcacgccttgagcgagctgccggagactctagaaaccctgctccttctgacattattggcaaccgtgactggcgggatattcctgtttctcatgtctggaaagggcatcggtaaaatgacgctggggatgtgctgcattatcaccgcttccattcttctgtggtacgcccagatccagccccactggatagcagccagcattatcctcgagttctttttgatcgtgctgttaattccagaacctgagaagcaacgcacaccccaggacaaccagctaacttatgtcgttatcgctatactgaccgtggtagcggccacaatggcaaatgaaatgggcttcctcgagaaaaccaagaaagattttggacttggctcaattactacacagcaaccagacagtaacatcctggatattgacttgaggcctgcttctgcctggacgctgtacgccgtggcaaccactttcatcacacccatgctccggcattccatagagaatagctcagtcaacgtgagtctgaccgctatcgccaatcaggcgaccgttcttatggggctcggaaagggttggccgctgagcaagatggacattggcgtgccattgctggctatcgggtgttactcccaggtcaaccctattacattaactgccgcactactgctccttgtagcccactatgctatcattggacccggcctgcaggcaaaagccacgcgtgaagcgcaaaagagagctgccgcaggtatcatgaaaataccagccgctgatgggattaccgtgatcgacttggatcccatcccttacgacccgaagtttgagaaacagctgggccaggttatgctcctggtgctttgcgtcacacaggtgttaatgatgaggactacctgggccctgtgtgaagcactcacattggctaccggacccatttctactctgtgggagggcaatccagggcgcttctggaacacgacaatagccgtcagcatggcgaatatctttcggggatcctatctagccggcgcaggtctactcttctcaattatgaagaacaccgctaacactcgaagagggaccggaaatacaggcgaaactcttggtgagaagtggaaaaacaggctgaatgccttgggcaagtctgagtttcaaatctacaaaaagagtgggattcaggaagtggatcgcaccctggcaaaagagggaatcaagcggggcgaaacagaccatcacgctgtttcgagagggagcgccaaactccgttggttcgtggagaggaacctggtaacgcctgagggaaaggtggtcgatttaggctgcggtagagggggatggtcctattactgtggcggtcttaagaatgttaaagaagtgaagggcctgaccaaagggggacccggccatgaggaacctataccaatgtctacttatgggtggaacctcgtccgcctacagtcaggagtggacgtattctttacaccccctgagaagtgcgataccctgttgtgtgacatcggcgaaagctccccaaatcccactgtggaggccggtcgaacactgagagttctcaaccttgtggagaattggctgaacaataacacccaattctgcattaaagtcttgaatccgtacatgcctagtgtgatcgaaaagatggaggcgctgcagaggaagtacgggggagctctcgtccggaacccattatctcgcaatagcacgcacgaaatgtattgggtgtcaaacgcatccggcaacattgttagtagcgtaaatatgatctctagaatgctgataaacaggtttaccatgaaacacaagaaagccacatacgagcccgatgtggaccttggctccgggactcgaaatattggaatcgaatcagagacccctaacctggatatcattggtaagcggatagagaaaatcaagcaggaacatgagacaagctggcactatgaccaggaccatccatacaagacttgggcttatcacggctcgtacgaaaccaaacaaacagggtctgccagttccatggtcaatggagtggttcgtctactcaccaagccctgggatgtgattccgatggtcactcagatggcaatgacggacacaacccctttcggccagcagagagtgtttaaagagaaggtagatactcgcacccaagaacccaaagagggtacaaagaagctgatgaaaatcacggccgagtggttgtggaaggaactggggaaaaagaaaaccccaaggatgtgtactcgggaggagttcacaagaaaggtgcgcagcaacgctgcgctcggagccatttttaccgacgagaataaatggaagtcagcaagggaggctgttgaagattccggcttctgggagcttgtcgacaaggaacgaaacctgcacttagagggcaaatgcgaaacttgtgtgtataatatgatggggaagcgggagaaaaagctgggagagtttggtaaagccaagggctctagagcaatctggtacatgtggttgggggccaggttcctcgaatttgaggctctgggattcctaaacgaagatcattggtttagccgcgagaatagtctttccggcgtggaaggtgaggggctgcacaagctcggatacatactgcgtgacgtcagcaaaaaggagggcggcgccatgtatgcggatgacacagcagggtgggatacccggatcacattggaagacctgaaaaacgaggaaatggttactaatcatatggagggagaacacagaaagctcgccgaggctattttcaggcttacctaccagaacaaagtggtacgcgtgcagcgacctacgccccggggtaccgtcatggacatcatttctagaagggatcagcgcggctcagggcaagtggttacatatggactgaatactttcaccaacatggaggcccagttaatcagacagatggaaggcgagggtgtgtttaagagtattcaacatctgacagtcactgaagagatagcagtgaagaactggttggagcgggtagggagggaacgtctctcccgaatggctatcagcggagacgattgcgttgtgaaaccactggacgatcgcttcgcctctgctctaaccgcccttaatgacatgggcaaggtcagaaaagatattcagcagtgggagccctcgcggggctggaacgactggacacaggtgcctttttgctcacaccacttccatgaactgatcatgaaggatgggagggtgctcgtcgttccatgtcgcaatcaagacgagctgatcggacgagcacggattagccagggtgcgggctggtccttgagggaaacagcctgcttagggaaaagttacgctcagatgtggtctctgatgtattttcaccgacgtgatctcagacttgccgcaaacgctatatgtagcgccgtgccgtcccattgggtacccacctcacgcactacatggagtatccacgcaacccacgagtggatgactaccgaggacatgctgacagtgtggaatcgggtctggattcaggaaaacccttggatggaggataagacgccagtggaatcttgggaggaaatcccctacctaggaaagagggaggaccaatggtgcggcagcctgattggtctcacctccagagccacttgggcgaaaaatatccagacagctataaaccaggttcgctcattgatcgggaatgaggaatataccgactacatgcctagcatgaagcggttcaggcgagaggaagaggaagccggagtgctgtggtga

SEQ ID NO: 14329 - RNA, 9876 nt, synthetic construct
  misc_feature 1..9876: note = derived and/or modified CDS sequence (opt3) from DENV-2__KX380833__SS-prME
  source 1..9876: mol_type = other RNA
accgccggaatcattataatgatgatccccacggtgatggctttccacctgactacgagaaacggggaacctcatatgattgtaagcaggcaggaaaagggaaaatccctcctttttaagaccgagaatggtgttaacatgtgcaccctgatggcaatggacttgggcgaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactcggaccgaaacatggatgagctccgagggggcttggaagcacgcccagaggatcgagacttgggtgcttcggcatcctggattcaccgttatggcagccatactggcttacacaatcggcaccacgtattttcagcgcgtgttgattttcatcctcctgactgcagtcgccccatctatgacaatgagatgcattggcatctcgaacagggactttgtggaaggggtatcaggaggtagctgggttgatatagtgctggagcacggcagttgtgtcaccactatggctaaaaataagcccacactcgacttcgaattaattaagaccgaggccaaacaccctgcgacgctgcggaagtactgcatcgaagcaaaacttaccaacacaactaccgcctcccgctgtccaacacagggggagccctctttgaatgaggaacaagataagcgatttgtgtgcaaacatagcatggtggacagaggatggggcaacggttgtgggctgttcggaaagggcggcattgtcacttgcgctatgtttacctgcaagaaaaatatggaggggaagatcgttcagcctgaaaacctagagtatacaatcgtgattaccccacactccggagaagagaatgccgtaggtaacgatactggcaaacatgggaaggagataaaagtgacgccgcagtcaagtatcacagaagcagagctcaccggatacggcactgctaccatggaatgtagccccaggacaggtctggacttcaatgagatggtccttctgcagatggaaaacaaggcctggttggtgcaccggcaatggtttctcgatctgcctttaccatggctgcccggggcggacacccagggctctaactggattcagaaagagactctcgttacattcaagaatcctcacgccaagaaacaggatgtggtcgtgcttggatcccaagagggcgcaatgcatacggctctgaccggggccactgaaatccagatgtcaagcggaaacttgctatttacaggtcacctgaagtgccgtctccgcatggacaaactgcagcttaagggcatgagttattctatgtgtaccgggaaattcaaggtagttaaggagatagctgaaacacaacatggaactattgtgatcagagtccagtacgagggcgacggttccccatgcaaaatccccttcgagattatggatctggaaaagaggcacgtgttggggcggctcatcaccgtcaatccgattgtgacggagaaagacagccctgttaacatagaagccgagcccccatttggcgattcgtacatcattatcggagtggaacctggccagctgaagttatcttggttcaaaaaggggtcctcaatcggacagatgtttgagaccacaatgcgaggtgcaaagcgcatggccattctgggcgacactgcttgggatttcgggagtctaggaggcgtatttaccagcataggtaaagcgctccatcaagtcttcggggcaatctatggcgccgctttttccggagtgtcttggacaatgaagattctgatcggcgttgtgattacttggatcgggatgaatagcagatcaaccagtctttccgtcagcttggtgctggtaggaatagtgacgctctacctgggcgttatggtccaggccgactctggttgtgtggtgtcatggaaaaacaaggagcttaaatgcgggagtggaatcttcattacagataatgtccacacctggactgaacagtataagtttcagcccgagagcccatccaagctggcatctgccatccaaaaagctcacgaagagggcatttgtggtatcaggtcggttacacggttggaaaacctcatgtggaagcagataacccccgagctgaatcatattttaagcgagaacgaagtgaaactgactatcatgaccggcgacattaaggggatcatgcaggccggaaaacgctccctaagacctcagccaacagagctcaagtactcatggaaagcatggggcaaggcgaagatgctgagtacggaacttcacaatcataccttcttgatagatgggccggagactgctgaatgccccaacacaaatagggcctggaactctctggaggtggaggactatggatttggcgtattcaccacaaatatctggctcaaactgaaggaacgtcaagatgtcttttgtgacagcaaattaatgtccgcagccattaaggacaaccgggctgtgcacgccgatatgggttactggatcgagtcagcactgaacgacacttggaaaattgaaaaggctagcttcatcgaggttaagtcttgccactggcctaaatcccataccctttggagtaatggggtgttggagagcgaaatgataattccaaagaacttcgccggacccgtctctcagcacaattatcgacctggctaccatacgcagacagcgggtccatggcacctcggcagactggagatggattttgacttctgtgaagggaccactgtggttgtgaccgaggattgcggaaacaggggcccctccctacgcacaactaccgcctcagggaaactgatcacagaatggtgctgtcggagttgcacgctcccgcctctgagatacaggggagaggacggctgttggtatggtatggagatccgcccacttaaggaaaaagaggaaaatttggtaaacagcctggtcaccgctgggcatggacagattgataatttttcgttaggcgtgctcggtatggcactgttccttgaggaaatgctgcgaactcgggtgggcacaaagcacgccatcttgctcgtcgctgtttcctttgtgaccctgattactgggaacatgtctttccgtgacctaggaagagtaatggtgatggtcggcgccacaatgaccgatgacatagggatgggagtgacgtacctggcactcctggcggcctttaaggttaggcccactttcgctgccggccttttgctgcgcaaattaaccagcaaggagctcatgatgacaaccatcggtattgtgctgctttcacaaagtactatccctgagacaattctggaactaaccgatgcactcgctctggggatgatggtcttgaaaatcgtgcggaatatggagaagtatcagctggccgttacaataatggcaatcttatgcgtgcccaacgccgtcattctccagaatgcttggaaagtatcctgtactatcctggcggtggtttctgtgagcccacttctgttgacctcctcacaacagaaggccgactggattcctctcgcactgacgatcaagggactaaaccccacagctatatttctgaccactcttagcagaaccagtaaaaagaggtcttggccactcaatgaagccattatggccgtcggcatggtgtccatcctggctagctcgttgctgaaaaacgatatcccgatgacaggccctttagtagcagggggactcctgactgtgtgctacgtccttaccggtcgatcagccgacctggagttggaacgcgcggctgacgttcggtgggaggagcaggccgaaatttctggcagttcccccatactcagcatcacgatttctgaggatgggagcatgtccatcaagaatgaagaggaggaacagacactgaccattctaatcagaactggactgcttgtgatatcaggcctcttcccagtgagtatccccattacagcagccgcttggtatctgtgggaggtcaaaaagcaaagggccggtgtgttgtgggacgttcctagcccaccccctgtagggaaagccgaattagaggatggagcgtaccgtatcaagcagaagggcattctgggctattctcagatcggggctggagtgtacaaagaaggtacctttcacactatgtggcatgtcacacgcggcgccgtgctcatgcacaaggggaaacggatagagccgtcctgggcagacgttaagaaagatctgatttcatacggaggcggttggaaacttgagggggaatggaaggagggagaagaggtgcaggtcctggccttggaaccaggcaaaaaccccagagctgtgcaaaccaagcctggcctattcaaaacgaacactgggaccatcggagccgtaagtctggactttagcccaggtacatccggctctcccatcgtcgataagaaagggaaggtggttggactctatggcaatggtgtggtcaccaggtcggggacatacgtgagcgcaattgctcagactgagaagtcaatcgaggacaaccctgaaatagaggatgacattttcagaaagaaacggctgaccatcatggatcttcatccgggagccggcaaaacgaagcgctatttacccgcgattgttagagaagccatcaaaaggggcctgcggacactcatattggcaccaactcgagtggtcgctgccgagatggaagaggctctgagagggctccctattcgctaccagacccccgcaatcagggccgagcacacaggacgtgaaatcgtggacctgatgtgtcatgccaccttcactatgcggcttctgtccccaattagagtacctaattataacttgatcattatggatgaggctcactttaccgaccccgcgagtatagcagccaggggttacatctctacacgcgtggaaatgggcgaggctgccgggattttcatgacggcaactccaccgggaagccgagacccttttccccagtccaatgccccaatcatggatgaggaaagagagatccccgaacggtcatggaactctggccacgagtgggttaccgacttcaagggtaagacagtctggtttgtgcctagcattaaagctgggaatgatatagcggcctgcctaaggaagaacggcaaaaaggtgatccaactgagtcgcaaaaccttcgactccgaatatattaagactcgtacaaatgattgggactttgtcgtaaccacggatatcagcgagatgggcgcaaacttcaaggctgagagagtgattgacccacggaggtgtatgaaacccgttatcctcactgatggcgaagaacgcgtgatattagccgggcctatgccggtcacacattcttcagcagcccagcgaagaggacgggtgggtaggaatccaaagaacgaaaatgaccagtacatctacatgggcgagcccctggaaaacgatgaggactgcgctcactggaaagaggccaagatgcttctggacaatattaacacccctgaagggatcattccctccatgtttgagccagaacgcgagaaagttgatgcgatcgacggagaatatagactcaggggcgaggcacggaagaccttcgtggatttgatgcgtcgcggtgacctgcctgtctggctcgcctaccgagtggctgccgaggggataaactatgctgatagaaggtggtgttttgacggcgtcaaaaataaccaaattctggaagagaatgtggaagttgagatctggactaaggagggagaacggaagaaacttaagccccgctggctagatgcaagaatttacagtgacccactggccttgaaagagttcaaggagttcgctgccggcaggaagtcgttaacactgaacctcatcaccgagatggggcggctgcctacatttatgactcagaaggcacgaaatgcgcttgataacctggccgtcctccatacggctgaagccggaggtagagcatataatcacgctttgagcgagctgccggagaccctagaaacactgctccttctgactttattggccaccgtgacaggcgggatattcctgtttctcatgtctggaaagggcatcggtaaaatgaccctggggatgtgctgcattatcactgcatccattcttctgtggtacgcccagatccagccccactggatagctgcgagcattatcctcgagttctttttgatcgtgctgttaattccagaacctgagaagcaacgcacgccccaggacaaccagctaacctatgtcgttatcgccatactgacagtggtagcagctactatggccaatgaaatgggcttcctcgagaaaaccaagaaagattttggacttggctcaattacaacccagcaaccagacagtaacatcctggatattgacttgaggcctgcctctgcatggactctgtacgctgtggccacaacgttcatcacccccatgctccggcattccatagagaatagctcagtcaacgtgagtctgactgcgatcgctaatcaggccacagttcttatggggctcggaaagggttggccgctgagcaagatggacattggcgtgccattgctggcaatcgggtgttactcccaggtcaaccctattaccttaaccgccgctctactgctccttgtagcacactatgccatcattggacccggcctgcaggcgaaagctacacgtgaagcccaaaagagagcagccgctggtatcatgaaaataccagccgcagatgggattactgtgatcgacttggatcccatcccttacgacccgaagtttgagaaacagctgggccaggttatgctcctggtgctttgcgtcacacaggtgttaatgatgaggaccacatgggctctgtgtgaagccctcactttggcgaccggacccatttctacactgtgggagggcaatccagggcgcttctggaacaccactatagccgtcagcatggcaaatatctttcggggatcctatctagctggcgccggtctactcttctcaattatgaagaacacggcaaacacacgaagagggaccggaaatactggcgaaacccttggtgagaagtggaaaaacaggctgaatgctttgggcaagtctgagtttcaaatctacaaaaagagtgggattcaggaagtggatcgcacactggccaaagagggaatcaagcggggcgaaactgaccatcacgccgtttcgagagggagcgcgaaactccgttggttcgtggagaggaacctggtaacccctgagggaaaggtggtcgatttaggctgcggtagagggggatggtcctattactgtggcggtcttaagaatgttaaagaagtgaagggcctgacaaaagggggacccggccatgaggaacctataccaatgtctacgtatgggtggaacctcgtccgcctacagtcaggagtggacgtattctttacaccccctgagaagtgcgatactctgttgtgtgacatcggcgaaagctccccaaatcccacagtggaggctggtcgaaccctgagagttctcaaccttgtggagaattggctgaacaataacactcaattctgcattaaagtcttgaatccgtacatgcctagtgtgatcgaaaagatggaggcactgcagaggaagtacgggggagccctcgtccggaacccattatctcgcaatagcacacacgaaatgtattgggtgtcaaacgcttccggcaacattgttagtagcgtaaatatgatctctagaatgctgataaacaggtttaccatgaaacacaagaaagccacgtacgagcccgatgtggaccttggctccgggacccgaaatattggaatcgaatcagagacacctaacctggatatcattggtaagcggatagagaaaatcaagcaggaacatgagactagctggcactatgaccaggaccatccatacaagacctgggcatatcacggctcgtacgaaacaaaacaaactgggtctgccagttccatggtcaatggagtggttcgtctactcaccaagccctgggatgtgattccgatggtcacacagatggctatgaccgacactacgcctttcggccagcagagagtgtttaaagagaaggtagatacacgcacccaagaacccaaagagggtactaagaagctgatgaaaatcaccgcggagtggttgtggaaggaactggggaaaaagaaaacaccaaggatgtgtacgcgggaggagttcaccagaaaggtgcgcagcaacgccgcactcggagctatttttactgacgagaataaatggaagtcagccagggaggcagttgaagattccggcttctgggagcttgtcgacaaggaacgaaacctgcacttagagggcaaatgcgaaacatgtgtgtataatatgatggggaagcgggagaaaaagctgggagagtttggtaaagccaagggctctagagctatctggtacatgtggttgggggccaggttcctcgaatttgaggcgctgggattcctaaacgaagatcattggtttagccgcgagaatagtctttccggcgtggaaggtgaggggctgcacaagctcggatacatactgcgtgacgtcagcaaaaaggagggcggcgcaatgtatgccgatgacaccgctgggtgggatactcggatcacattggaagacctgaaaaacgaggaaatggttaccaatcatatggagggagaacacagaaagctcgccgaggcaattttcaggcttacataccagaacaaagtggtacgcgtgcagcgacctactccccggggtaccgtcatggacatcatttctagaagggatcagcgcggctcagggcaagtggttacgtatggactgaataccttcacaaacatggaggctcagttaatcagacagatggaaggcgagggtgtgtttaagagtattcaacatctgactgtcaccgaagagatagccgtgaagaactggttggagcgggtagggagggaacgtctctcccgaatggctatcagcggagacgattgcgttgtgaaaccactggacgatcgcttcgcctctgcactaacagcgcttaatgacatgggcaaggtcagaaaagatattcagcagtgggagccctcgcggggctggaacgactggactcaggtgcctttttgctcacaccacttccatgaactgatcatgaaggatgggagggtgctcgtcgttccatgtcgcaatcaagacgagctgatcggacgagcacggattagccagggtgctggctggtccttgagggaaaccgcctgcttagggaaaagttacgcacagatgtggtctctgatgtattttcaccgacgtgatctcagacttgctgccaacgcaatatgtagcgccgtgccgtcccattgggtacccatctcacgcacgacatggagtattcacgcgacccacgagtggatgactacagaggacatgctgaccgtgtggaatcgggtctggatccaggaaaacccttggatggaggataagactccagtggaatcttgggaggaaattccctacctaggaaagagggaggaccaatggtgcggcagcctgatcggtctcacctccagagctacatgggccaaaaatatacagacggcaatcaaccaggttcgctcattgattgggaatgaggaatataccgactacatgcctagcatgaagcggttcaggcgagaggaagaggaagccggagtgctgtggtga

SEQ ID NO: 14330 - RNA, 9876 nt, synthetic construct
  misc_feature 1..9876: note = derived and/or modified CDS sequence (opt3) from DENV-2__KX380834__SS-prME
  source 1..9876: mol_type = other RNA
accgccggcatcattataatgatgatccccacagtgatggctttccacctgactacgaggaatggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgttgcgctcgtgccccatgtcggcatgggtctggagactaggaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcagcctcagaccccagcctacggagctgaagtactcctggaaagcctggggcaaggcaaagatgctttcaaccgaattgcacaatcatactttcctgatcgatgggccagagacagcggaatgcccgaacaccaatagggcttggaacagtctcgaggtcgaggactatggatttggcgtgttcacaactaatatatggctgaaattaaaggaacgtcaagatgtattttgtgactctaacctgatgagcgccgcaatcaaagacaaccgggccgtgcacgctgatatgggttactggattgagtccgcccttaatgacacctggaagatcgaaaaagcatcattcattgaggtcaagagctgccactggcccaagtctcatacgttgtggtccaacggggtgctcgagagtgaaatgatcatacctaaaaatttcgctggaccagttagccagcacaactatcgacccggctaccatacacagaccgccggtccttggcacctgggcagactagagatggattttgacttctgtgaagggactaccgtggtagtcacagaggattgcggaaataggggcccatctctgcgcactaccacagcgtccgggaagctcattacggaatggtgctgtcggtcatgcaccctgcccccgcttagatacaggggagaggacggctgttggtatggtatggagatccgccctttgaaagaaaaggaggaaaacctggtgaatagtttagtgactgccgggcatggacagatcgataactttagcctcggcgtcctgggtatggctcttttcctggaggaaatgttgcgaacacgggttggcaccaaacacgcaattctcctggtggccgtatcgtttgtgactctaatcacagggaatatgtccttccgtgacctgggaagagtcatggtgatggttggcgctaccatgacggatgacattgggatgggagtgacttacctcgccctgcttgcagcgtttaaggtcaggccaaccttcgccgctggcttgctgttacgcaagctcacatctaaagagctgatgatgaccactataggtatcgtgcttctgagccaatcaacaattcccgagagtatcctagaactcaccgatgccctggcattggggatgatggttctgaagattgtgcggaacatggagaaatatcagttagctgtcacaatcatggccatactctgcgtacctaatgcagtgatcctgcagaacgcctggaaggtttcctgtactacccttgctgtggtctctgtgagccccctgttgctcacgtcctcacaacagaaagcggactggattccactggccctaacaatcaagggactgaatcctaccgcaatttttcttactaccctcagcagaacaagtaagaaaaggtcttggcccctgaacgaagctatcatggccgtaggcatggtgtccatattggccagctcgctgttaaagaatgatattccaatgactggcccgctcgtcgctgggggactgcttaccgtttgctacgtgctgacgggtcgatcagcagacttggagctcgaacgcgccgcggacgtgcggtgggaggagcaggctgaaatctctggcagttcccctatcctgagcattacaatatctgaggatgggagcatgtccatcaaaaacgaagaggaggaacagaccctaactattctgatcagaacaggacttctcgtcatttcaggcctgttccccgtgagtatcccaataaccgccgcagcctggtatttgtgggaggttaagaaacaaagggctggtgtattatgggacgtgcccagccctccacccgtcgggaaggcagaactggaggatggagcctaccgtatcaaacagaagggcattctcggctattctcagatcggggcgggagtgtacaaggaaggtacttttcacacaatgtggcatgttacccgcggcgctgtgctgatgcacaaagggaagcggattgagccttcctgggccgacgtcaaaaaggatcttatctcatacggaggcggttggaaactggagggggaatggaaggagggagaagaggtgcaggtattggcactagaaccgggcaagaacccaagagccgtccaaacgaaacccggcctgttcaagactaataccgggacaataggagctgtgagtctcgactttagccctggtacctccggctctccaattgttgataaaaaggggaaagtggtcggactgtatggcaacggtgtggttacaaggtcggggacttacgtgagcgccatcgcacagaccgagaagtcaatcgaggacaatcccgaaattgaggatgacatcttccgaaagaaacggcttacgataatggatttacatcctggagctggcaagacaaaacgctatctgccggccattgtcagagaagcgatcaagaggggcctccggactttgattctggcccccacccgagtggtagcagctgagatggaagaggccctcagagggctgccaatccgctaccagacccctgctataagggcagagcacaccggacgtgaaattgtggaccttatgtgtcatgccactttcaccatgcggctgttgtcccccatcagagttccaaactataatctaatcattatggatgaggcccactttacagaccctgctagtatcgcggcaaggggttacatttctacgcgcgtcgaaatgggcgaggccgctgggatattcatgactgccacacccccaggaagccgagacccgtttcctcagtccaacgcacccatcatggatgaggaaagagagattccagaacggtcatggaactctggccacgagtgggtgacagacttcaaaggtaagaccgtgtggtttgtccccagcatcaaggccgggaacgatatcgctgcgtgcctgaggaaaaatggaaagaaagtaattcaactcagtcgcaagactttcgactccgaatatataaaaacacgtaccaacgattgggactttgtggttacgactgatatcagcgagatgggcgccaatttcaaggcagagagagtgattgaccctcggaggtgtatgaagccagtcatcttaacagatggcgaagaacgcgtgattctggctgggcccatgcctgttacccattcttcagccgcacagcgaagaggacgggtgggtaggaacccgaaaaatgaaaacgaccagtacatctacatgggcgagccacttgaaaatgatgaggactgcgcccactggaaggaggctaaaatgctgctcgacaacataaacacccccgaagggatcattccttccatgtttgagcccgaacgcgagaaggtcgatgccatcgacggagaatatagattgaggggcgaggcgcggaaaactttcgtggatctgatgcgtcgcggtgacctcccagtatggctggcataccgagtggccgctgaggggattaattatgccgatagaaggtggtgttttgacggcgttaagaacaatcaaatccttgaagagaacgtcgaagtggagatatggacaaaagagggagaacggaagaagctaaaacctcgctggctggatgctagaatttacagtgaccccttggcattaaaggagttcaaagagttcgccgctggcagaaagagcctgaccctcaatctgatcacagagatggggcggcttccaacttttatgacgcagaaagccaagaacgcactggataatctcgcggtgttgcataccgccgaagctggaggtcgagcctataaccacgcactgtcggagctacctgagacactggaaactctccttctgttaaccttgctggctacagtcaccggcgggattttcctctttctgatgtctggaaagggcatcggtaaaatgactcttgggatgtgctgcataatcacggcctccattctgctctggtacgcacagatccagccgcactggattgccgctagcatcatattggagttctttctgattgttttactaatccccgaaccagagaagcaaagaacccctcaggacaatcagctgacatatgtggtaatcgcgattctcactgtggtcgccgcaaccatggctaacgaaatgggcttccttgagaaaacaaagaaagattttggactgggctcaatcaccactcagcaacccgagagtaatatattggacattgatctgcgcccagcctctgcctggacactctacgcagtggctacgaccttcatcactcctatgctgaggcattccattgaaaacagctcagttaatgtgagtcttacagccatcgcgaaccaggctaccgtcctcatggggctgggaaagggttggcccttgagcaagatggacataggcgtaccgctgttagccatcgggtgttactcccaggtgaatccaattaccctaacagcagccctgctccttctggttgctcactatgcaatcattggacctggcttgcaggccaaagcgactcgggaggctcaaaagcgtgccgcagccggtatcatgaaaaaccccacggtggacgggatgaccgtcattgatctggacccaatcccctacgatcctaagtttgaaaaacagctcggccaggtgatgctgcttgtcttatgcgtgacacaggttctgatgatgagaactacctgggctctctgtgaggccttgacactggcaaccggaccgatatctactctatgggaaggcaatcccgggaggttctggaacacgacaattgctgtgagcatggccaacatctttcgcggatcctatctggcgggcgccggtctccttttctcaatcatgaagaataccgcaaacactcggcgagggaccggaaatacaggcgagactctgggtgagaagtggaaaaacagattgaatgctctgggcaagtctgaatttcaaatttacaaaaagagtgggatacaggaggtagacaggaccctcgccaaagaaggaatcaagcgcggcgagacagatcatcacgcagtgtcgcgggggagcgctaaactgagatggttcgtcgagcgtaacttagttacgccagaaggaaaggtggtcgaccttggctgcggtagagggggatggtcctattactgtggcggtctgaagaatgtgaaagaggtaaagggcctcaccaaagggggacctggccatgaggaacccattcctatgtctacttatgggtggaacctagtgcggctgcagtcaggagttgatgtgttctttacaccacccgaaaagtgcgacaccttgctgtgtgatatcggcgagagctcccctaatccaactgtcgaggccggtcgcacactccgagtgcttaacctggtcgaaaattggttgaacaataacacccaattctgcattaaagtgctgaatccctacatgccgagtgttatcgagaagatggaagccctccagagaaagtacgggggagcgttagtaaggaaccctctgtctcggaacagcacgcacgagatgtattgggtgtcaaatgcttccggcaacatagtcagtagcgtgaatatgatctctcgcatgcttattaacagatttaccatgaggcacaaaaaggcaacatacgaaccagacgttgatctgggctccgggactcgaaatatcggaattgagtcagagacccccaacctagacatcataggtaaacggattgaaaagatcaaacaggagcatgaaacaagctggcactatgatcaggaccatccttacaagacttgggcctatcacggctcgtacgagaccaagcaaacagggtctgctagttccatggtgaatggagtcgtgcgtctcctgaccaaaccatgggacgtaatccccatggtgactcagatggccatgacggatacaaccccgttcggccagcagagagtttttaaggaaaaagtcgacactcgcacccaagagcctaaggagggtaccaagaagttgatgaagattacggcagaatggctgtggaaagagctcgggaagaaaaagacccccaggatgtgtactcgggaagagttcacaagaaaagtgcgcagcaacgccgctcttggagcgatatttaccgatgagaataagtggaaatcagccagggaagcagtggaggactccggcttctgggaactggtcgataaggagcgaaacttacacctggaaggcaagtgcgagacttgtgtttataatatgatggggaaacgggagaagaaattgggagaatttggtaaggctaaaggctctagagccatctggtacatgtggctcggggcaaggttcctggagtttgaagccctaggattccttaacgaggaccattggtttagccgcgaaaatagtctgtccggcgtggagggtgaggggctccacaagctgggatacattttgcgtgatgtaagcaagaaagaaggcggcgctatgtatgccgacgatacagcggggtgggacacccggatcacactggaggatctcaagaacgaagagatggtgactaatcatatggaaggagagcacaagaaacttgcagaggccattttcaaactgacctaccagaacaaagtcgtgagagttcagaggccaacgcctcgcggtaccgtgatggacatcatatctcgacgggaccagagaggctcagggcaagtcgtgacatatggattaaacactttcaccaatatggaagctcagctgatcaggcagatggagggcgaaggtgtatttaagagtattcaacagttgacagttaaagaggagatcgccgtgaagaactggctcattcgcgtcgggagagaacggctgtccaggatggcaatcagcggagatgactgcgtggtgaaacccctagatgaccgtttcgcttctgcccttactgctctgaatgatatgggcaaggtccgaaaagacattcagcagtgggagccatcgcgcggctggaacgattggacccaagttcccttttgctcacatcacttccacgaactcataatgaaggacgggagagtgctggtagtgccttgtcggaatcaggatgagttgatcggaagggcccgcattagccagggtgcaggctggtccttaagagaaacggcgtgcctggggaagagttacgcccagatgtggtctctcatgtattttcatcggagggaccttcgactggctgccaacgcaatctgtagcgctgtcccatcccactggatcccgacatcacgtaccacttggagtattcatgccacacacgagtggatgaccactgaggatatgctaaccgtgtggaatagagtttggatacaagaaaacccctggatggaggacaaaacacctgtggaatcttgggaggaaatcccatacctgggaaagcgcgaggatcagtggtgcggcagcctcattggtttgacgtcccgggcaacctgggccaaaaatatccagactgcgattaaccaggtcaggtcactgatcgggaatgaggaatatacagactacatgcccagcatgaagagattccgccgggaggaagaggaagctggagtgctttggtga

SEQ ID NO: 14331 - RNA, 9876 nt, synthetic construct
  misc_feature 1..9876: note = derived and/or modified CDS sequence (opt3) from DENV-2__KX380835__SS-prME
  source 1..9876: mol_type = other RNA
accgcaggaatcattataatgatgatccccaccgtgatggctttccacctgactacgagaaacggggaacctcatatgattgtaagcaggcaggaaaagggaaaatccctcctttttaagaccgagaatggtgttaacatgtgcacactgatggcaatggacttgggcgaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactcggaccgaaacatggatgagctccgagggggcttggaagcacgcccagaggatcgagacttgggtgcttcggcatcctggattcaccgttatggcagccatactggcttacacaatcggcaccacgtattttcagcgcgtgttgattttcatcctcctgactgcagtcgccccatctatgacaatgagatgcattggcatctcgaacagggactttgtggaaggggtatcaggaggtagctgggttgatatagtgctggagcacggcagttgtgtcaccactatggctaaaaataagcccacactcgacttcgaattaattaagaccgaggccaaacaccctgcgacgctgcggaagtactgcatcgaagcaaaacttaccaacacaactaccgcctcccgctgtccaacacagggggagccctctttgaatgaggaacaagataagcgatttgtgtgcaaacatagcatggtggacagaggatggggcaacggttgtgggctgttcggaaagggcggcattgtcacttgcgctatgtttacctgcaagaaaaatatggaggggaagatcgttcagcctgaaaacctagagtatacaatcgtgattaccccacactccggagaagagaatgccgtaggtaacgatactggcaaacatgggaaggagataaaagtgacgccgcagtcaagtatcacagaagcagagctcaccggatacggcactgctaccatggaatgtagccccaggacaggtctggacttcaatgagatggtccttctgcagatggaaaacaaggcctggttggtgcaccggcaatggtttctcgatctgcctttaccatggctgcccggggcggacacccagggctctaactggattcagaaagagactctcgttacattcaagaatcctcacgccaagaaacaggatgtggtcgtgcttggatcccaagagggcgcaatgcatacggctctgaccggggccactgaaatccagatgtcaagcggaaacttgctatttacaggtcacctgaagtgccgtctccgcatggacaaactgcagcttaagggcatgagttattctatgtgtaccgggaaattcaaggtagttaaggagatagctgaaacacaacatggaactattgtgatcagagtccagtacgagggcgacggttccccatgcaaaatccccttcgagattatggatctggaaaagaggcacgtgttggggcggctcatcaccgtcaatccgattgtgacggagaaagacagccctgttaacatagaagccgagcccccatttggcgattcgtacatcattatcggagtggaacctggccagctgaagttatcttggttcaaaaaggggtcctcaatcggacagatgtttgagaccacaatgcgaggtgcaaagcgcatggccattctgggcgacactgcttgggatttcgggagtctaggaggcgtatttaccagcataggtaaagcgctccatcaagtcttcggggcaatctatggcgccgctttttccggagtgtcttggacaatgaagattctgatcggcgttgtgattacttggatcgggatgaatagcagatcaaccagtctttccgtcagcttggtgctggtaggaatagtgacgctctacctgggcgttatggtccaggccgactctggttgtgtggtgtcatggaaaaacaaggagcttaaatgcgggagtggaatcttcattacagataatgtccacacctggactgaacagtataagtttcagcccgagagcccatccaagctggcatctgccatccaaaaagctcacgaagagggcatttgtggtatcaggtcggttacacggttggaaaacctcatgtggaagcagataacccccgagctgaatcatattttaagcgagaacgaagtgaaactgactatcatgaccggcgacattaaggggatcatgcaggccggaaaacgctccctaagacctcagccaacagagctcaagtactcatggaaagcatggggcaaggcgaagatgctgagtacggaacttcacaatcataccttcttgatagatgggccggagactgctgaatgccccaacacaaatagggcctggaactctctggaggtggaggactatggatttggcgtattcaccacaaatatctggctcaaactgaaggaacgtcaagatgtcttttgtgacagcaaattaatgtccgcagccattaaggacaaccgggctgtgcacgccgatatgggttactggatcgagtcagcactgaacgacacttggaaaattgaaaaggctagcttcatcgaggttaagtcttgccactggcctaaatcccataccctttggagtaatggggtgttggagagcgaaatgataattccaaagaacttcgccggacccgtctctcagcacaattatcgacctggctaccatacgcagacagcgggtccatggcacctcggcagactggagatggattttgacttctgtgaagggaccactgtggttgtgaccgaggattgcggaaacaggggcccctccctacgcacaactaccgcctcagggaaactgatcacagaatggtgctgtcggagttgcacgctcccgcctctgagatacaggggagaggacggctgttggtatggtatggagatccgcccacttaaggaaaaagaggaaaatttggtaaacagcctggtcaccgctgggcatggacagattgataatttttcgttaggcgtgctcggtatggcactgttccttgaggaaatgctgcgaactcgggtgggcacaaagcacgccatcttgctcgtcgctgtttcctttgtgaccctgattactgggaacatgtctttccgtgacctaggaagagtaatggtgatggtcggcgccacaatgaccgatgacatagggatgggagtgacgtacctggcactcctggcggcctttaaggttaggcccactttcgctgccggccttttgctgcgcaaattaaccagcaaggagctcatgatgacaaccatcggtattgtgctgctttcacaaagtactatccctgagacaattctggaactaaccgatgcactcgctctggggatgatggtcttgaaaatcgtgcggaatatggagaagtatcagctggccgttacaataatggcaatcttatgcgtgcccaacgccgtcattctccagaatgcttggaaagtatcctgtactatcctggcggtggtttctgtgagcccacttctgttgacctcctcacaacagaaggccgactggattcctctcgcactgacgatcaagggactaaaccccacagctatatttctgaccactcttagcagaaccagtaaaaagaggtcttggccactcaatgaagccattatggccgtcggcatggtgtccatcctggctagctcgttgctgaaaaacgatatcccgatgacaggccctttagtagcagggggactcctgactgtgtgctacgtccttaccggtcgatcagccgacctggagttggaacgcgcggctgacgttcggtgggaggagcaggccgaaatttctggcagttcccccatactcagcatcacgatttctgaggatgggagcatgtccatcaagaatgaagaggaggaacagacactgaccattctaatcagaactggactgcttgtgatatcaggcctcttcccagtgagtatccccattacagcagccgcttggtatctgtgggaggtcaaaaagcaaagggccggtgtgttgtgggacgttcctagcccaccccctgtagggaaagccgaattagaggatggagcgtaccgtatcaagcagaagggcattctgggctattctcagatcggggctggagtgtacaaagaaggtacctttcacactatgtggcatgtcacacgcggcgccgtgctcatgcacaaggggaaacggatagagccgtcctgggcagacgttaagaaagatctgatttcatacggaggcggttggaaacttgagggggaatggaaggagggagaagaggtgcaggtcctggccttggaaccaggcaaaaaccccagagctgtgcaaaccaagcctggcctattcaaaacgaacactgggaccatcggagccgtaagtctggactttagcccaggtacatccggctctcccatcgtcgataagaaagggaaggtggttggactctatggcaatggtgtggtcaccaggtcggggacatacgtgagcgcaattgctcagactgagaagtcaatcgaggacaaccctgaaatagaggatgacattttcagaaagaaacggctgaccatcatggatcttcatccgggagccggcaaaacgaagcgctatttacccgcgattgttagagaagccatcaaaaggggcctgcggacactcatattggcaccaactcgagtggtcgctgccgagatggaagaggctctgagagggctccctattcgctaccagacccccgcaatcagggccgagcacacaggacgtgaaatcgtggacctgatgtgtcatgccaccttcactatgcggcttctgtccccaattagagtacctaattataacttgatcattatggatgaggctcactttaccgaccccgcgagtatagcagccaggggttacatctctacacgcgtggaaatgggcgaggctgccgggattttcatgacggcaactccaccgggaagccgagacccttttccccagtccaatgccccaatcatggatgaggaaagagagatccccgaacggtcatggaactctggccacgagtgggttaccgacttcaagggtaagacagtctggtttgtgcctagcattaaagctgggaatgatatagcggcctgcctaaggaagaacggcaaaaaggtgatccaactgagtcgcaaaaccttcgactccgaatatattaagactcgtacaaatgattgggactttgtcgtaaccacggatatcagcgagatgggcgcaaacttcaaggctgagagagtgattgacccacggaggtgtatgaaacccgttatcctcactgatggcgaagaacgcgtgatattagccgggcctatgccggtcacacattcttcagcagcccagcgaagaggacgggtgggtaggaatccaaagaacgaaaatgaccagtacatctacatgggcgagcccctggaaaacgatgaggactgcgctcactggaaagaggccaagatgcttctggacaatattaacacccctgaagggatcattccctccatgtttgagccagaacgcgagaaagttgatgcgatcgacggagaatatagactcaggggcgaggcacggaagaccttcgtggatttgatgcgtcgcggtgacctgcctgtctggctcgcctaccgagtggctgccgaggggataaactatgctgatagaaggtggtgttttgacggcgtcaaaaataaccaaattctggaagagaatgtggaagttgagatctggactaaggagggagaacggaagaaacttaagccccgctggctagatgcaagaatttacagtgacccactggccttgaaagagttcaaggagttcgctgccggcaggaagtcgttaacactgaacctcatcaccgagatggggcggctgcctacatttatgactcagaaggcacgaaatgcgcttgataacctggccgtcctccatacggctgaagccggaggtagagcatataatcacgctttgagcgagctgccggagaccctagaaacactgctccttctgactttattggccaccgtgacaggcgggatattcctgtttctcatgtctggaaagggcatcggtaaaatgaccctggggatgtgctgcattatcactgcatccattcttctgtggtacgcccagatccagccccactggatagctgcgagcattatcctcgagttctttttgatcgtgctgttaattccagaacctgagaagcaacgcacgccccaggacaaccagctaacctatgtcgttatcgccatactgacagtggtagcagctactatggccaatgaaatgggcttcctcgagaaaaccaagaaagattttggacttggctcaattacaacccagcaaccagacagtaacatcctggatattgacttgaggcctgcctctgcatggactctgtacgctgtggccacaacgttcatcacccccatgctccggcattccatagagaatagctcagtcaacgtgagtctgactgcgatcgctaatcaggccacagttcttatggggctcggaaagggttggccgctgagcaagatggacattggcgtgccattgctggcaatcgggtgttactcccaggtcaaccctattaccttaaccgccgctctactgctccttgtagcacactatgccatcattggacccggcctgcaggcgaaagctacacgtgaagcccaaaagagagcagccgctggtatcatgaaaaatccaactgtggatgggatgacggttatagacttggatcccattccttacgacccgaagtttgagaaacagctgggccaggtgatgctcctggtcctttgcgtgacccaggtcttaatgatgaggacaacttgggccctgtgtgaagcactcaccttggctacaggacccatctctaccctgtgggagggcaacccagggcgcttctggaatactacgatcgccgtgagcatggcgaacatttttcggggatcctatctagccggcgcaggtctactcttctcaataatgaagaacacagctaatacccgaagagggactggaaacaccggcgaaacacttggtgagaagtggaaaaataggctgaacgccttgggcaagtctgagtttcaaatctacaaaaagagtgggattcaggaagttgatcgcactctggcaaaagagggaatcaagcggggcgaaaccgaccatcacgctgtgtcgagagggagcgccaaactccgttggttcgtagagaggaatctggtgacacctgagggaaaggtcgttgatttaggctgcggtagagggggatggtcctattactgtggcggtcttaagaacgtgaaagaagtcaagggcctgacgaaagggggacccggccatgaggaacctattccaatgtctacctatgggtggaatctcgtgcgcctacagtcaggagtagacgtgttctttactccccctgagaagtgcgatacactgttgtgtgacatcggcgaaagctccccaaaccccaccgttgaggccggtcgaactctgagagtgctcaatcttgtcgagaactggctgaataacaatacacaattctgcataaaagtgttgaacccgtacatgcctagtgtcatcgaaaagatggaggcgctgcagaggaagtacgggggagctctcgtgcggaatccattatctcgcaacagcacccacgaaatgtattgggtttcaaacgcatccggcaatattgtaagtagcgtgaacatgatctctagaatgctgattaataggtttacgatgaaacacaagaaagccacctacgagcccgatgtcgaccttggctccgggacacgaaacatcggaatagaatcagagactcctaatctggatattatcggtaagcggatcgagaaaattaagcaggaacatgagaccagctggcactatgaccaggaccatccatacaagacatgggcttatcacggctcgtacgaaactaaacaaaccgggtctgccagttccatggtgaacggagttgtgcgtctactcacaaagccctgggatgtcataccgatggtgacccagatggcaatgactgacacgacacctttcggccagcagagagtatttaaagagaaggtggatacccgcactcaagaacccaaagagggtaccaagaagctgatgaaaatcacagccgagtggttgtggaaggaactggggaaaaagaaaacgccaaggatgtgtacccgggaggagttcactagaaaggttcgcagcaatgctgcgctcggagccatttttacagacgagaacaaatggaagtcagcaagggaggctgtcgaagattccggcttctgggagcttgtggacaaggaacgaaatctgcacttagagggcaaatgcgaaacctgtgtgtataacatgatggggaagcgggagaaaaagctgggagagtttggtaaagccaagggctctagagcaatctggtacatgtggttgggggccaggttcctcgaatttgaggctctgggattcctaaatgaagatcattggtttagccgcgagaacagtctttccggcgtcgaaggtgaggggctgcacaagctcggatacattctgcgtgacgttagcaaaaaggagggcggcgccatgtatgcggatgacactgcagggtgggatacacggatcaccttggaagacctgaaaaatgaggaaatggtgacaaaccatatggagggagaacacagaaagctcgccgaggctatattcaggcttacttaccagaataaagtagtgcgcgtccagcgacctacaccccggggtacggtgatggacatcatttctagaagggatcagcgcggctcagggcaagttgtgacctatggactgaacacattcactaacatggaggcccagttaatcagacagatggaaggcgagggtgtctttaagagtattcaacatctgaccgtgacagaagagatcgcagtaaagaattggttggagcgggttgggagggaacgtctctcccgaatggctattagcggagacgattgcgtggtcaaaccactggacgatcgcttcgcctctgctctaactgcccttaacgacatgggcaaggtgagaaaagatatacagcagtgggagccctcgcggggctggaatgactggacccaggtgcctttttgctcacaccacttccatgaactgatcatgaaggatgggagggtcctcgttgtgccatgtcgcaaccaagacgagctgattggacgagcacggatcagccagggtgcgggctggtccttgagggaaacggcctgcttagggaaaagttacgctcagatgtggtctctgatgtattttcaccgacgtgatctcagacttgccgcaaatgctatctgtagcgccgtaccgtcccattgggtgcccatttcacgcacaacctggagtatacacgcaactcacgagtggatgacaaccgaggacatgctgactgtctggaaccgggtgtggatccaggaaaatccttggatggaggataagaccccagttgaatcttgggaggaaattccctacctaggaaagagggaggaccaatggtgcggcagcctgatcggtctcacatccagagccacgtgggcgaaaaacattcagaccgctatcaatcaggtgcgctcattgatagggaacgaggaatatactgactacatgcctagcatgaagcggttcaggcgagaggaagaggaagccggagtcctgtggtga

SEQ ID NO: 14332 - RNA, 9876 nt, synthetic construct
  misc_feature 1..9876: note = derived and/or modified CDS sequence (opt3) from DENV-2__KX380836__SS-prME
  source 1..9876: mol_type = other RNA
accgcaggaatcattataatgatgatccccaccgtgatggctttccacctgactacgcgaaacggggagcctcatatgattgtaagcaggcaggaaaagggaaaatccctcctttttaagaccgagaatggtgttaacatgtgcacactgatggcaatggacttgggcgaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgtagcgctcgtgccccatgtaggcatgggtctggagactagaaccgaaacatggatgagctccgagggggcttggaagcacgcccagaggatcgagacttgggtgcttcggcatcctggattcaccgttatggcagccatactggcttacacaatcggcaccacgtattttcagcgcgtgttgattttcatcctcctgactgcagtcgccccatctatgacaatgaggtgcattggcatctcgaacagggactttgtggaaggggtatcaggaggtagctgggttgatatagtgctggagcacggcagttgtgtcaccactatggctaaaaataagcccacactcgacttcgaattaattaagaccgaggccaaacaccctgcgacgctgcggaagtactgcatcgaagcaaaacttaccaacacaactaccgcctcccgctgtccaacacagggggagccctctttgaatgaggaacaagataagcgatttgtgtgcaaacatagcatggtggacagaggatggggcaacggttgtgggctgttcggaaagggcggcattgtcacttgcgctatgtttacctgcaagaaaaatatggaggggaagatcgttcagcctgaaaacctagagtatacaatcgtgattaccccacactccggagaagagaatgccgtaggtaacgatactggcaaacatgggaaggagataaaagtgacgccgcagtcaagtatcacagaagcagagctcaccggatacggcactgctaccatggaatgtagccccaggacaggtctggacttcaatgagatggtccttctgcagatggaaaacaaggcctggttggtgcaccggcaatggtttctcgatctgcctttaccatggctgcccggggcggacacccagggctctaactggattcagaaagagactctcgttacattcaagaatcctcacgccaagaaacaggatgtggtcgtgcttggatcccaagagggcgcaatgcatacggctctgaccggggccactgaaatccagatgtcaagcggaaacttgctatttacaggtcacctgaagtgccgtctccgcatggacaaactgcagcttaagggcatgagttattctatgtgtaccgggaaattcaaggtagttaaggagatagctgaaacacaacatggaactattgtgatcagagtccagtacgagggcgacggttccccatgcaaaatccccttcgagattatggatctggaaaagaggcacgtgttggggcggctcatcaccgtcaatccgattgtgacggagaaagacagccctgttaacatagaagccgagcccccatttggcgattcgtacatcattatcggagtggaacctggccagctgaagttatcttggttcaaaaaggggtcctcaatcggacagatgtttgagaccacaatgcgaggtgcaaagcgcatggccattctgggcgacactgcttgggatttcgggagtctaggaggcgtatttaccagcataggtaaagcgctccatcaagtcttcggggcaatctatggcgccgctttttccggagtgtcttggacaatgaagattctgatcggcgttgtgattacttggatcgggatgaatagcagatcaaccagtctttccgtcagcttggtgctggtaggaatagtgacgctctacctgggcgttatggtccaggccgactctggttgtgtggtgtcatggaaaaacaaggagcttaaatgcgggagtggaatcttcattacagataatgtccacacctggactgaacagtataagtttcagcccgagagcccatccaagctggcatctgccatccaaaaagctcacgaagagggcatttgtggtatcaggtcggttacacggttggaaaacctcatgtggaagcagataacccccgagctgaatcatattttaagcgagaacgaagtgaaactgactatcatgaccggcgacattaaggggatcatgcaggccggaaaacgctccctaagacctcagccaacagagctcaagtactcatggaaagcatggggcaaggcgaagatgctgagtacggaacttcacaatcataccttcttgatagatgggccggagactgctgaatgccccaacacaaatagggcctggaactctctggaggtggaggactatggatttggcgtattcaccacaaatatctggctcaaactgaaggaacgtcaagatgtcttttgtgacagcaaattaatgtccgcagccattaaggacaaccgggctgtgcacgccgatatgggttactggatcgagtcagcactgaacgacacttggaaaattgaaaaggctagcttcatcgaggttaagtcttgccactggcctaaatcccataccctttggagtaatggggtgttggagagcgaaatgataattccaaagaacttcgccggacccgtctctcagcacaattatcgacctggctaccatacgcagacagcgggtccatggcacctcggcagactggagatggattttgacttctgtgaagggaccactgtggttgtgaccgaggattgcggaaacaggggcccctccctacgcacaactaccgcctcagggaaactgatcacagaatggtgctgtcggagttgcacgctcccgcctctgagatacaggggagaggacggctgttggtatggtatggagatccgcccacttaaggaaaaagaggaaaatttggtaaacagcctggtcaccgctgggcatggacagattgataatttttcgttaggcgtgctcggtatggcactgttccttgaggaaatgctgcgaactcgggtgggcacaaagcacgccatcttgctcgtcgctgtttcctttgtgaccctgattactgggaacatgtctttccgtgacctaggaagagtaatggtgatggtcggcgccacaatgaccgatgacatagggatgggagtgacgtacctggcactcctggcggcctttaaggttaggcccactttcgctgccggccttttgctgcgcaaattaaccagcaaggagctcatgatgacaaccatcggtattgtgctgctttcacaaagtactatccctgagacaattctggaactaaccgatgcactcgctctggggatgatggtcttgaaaatcgtgcggaatatggagaagtatcagctggccgttacaataatggcaatcttatgcgtgcccaacgccgtcattctccagaatgcttggaaagtatcctgtactatcctggcggtggtttctgtgagcccacttctgttgacctcctcacaacagaaggccgactggattcctctcgcactgacgatcaagggactaaaccccacagctatatttctgaccactcttagcagaaccagtaaaaagaggtcttggccactcaatgaagccattatggccgtcggcatggtgtccatcctggctagctcgttgctgaaaaacgatatcccgatgacaggccctttagtagcagggggactcctgactgtgtgctacgtccttaccggtcgatcagccgacctggagttggaacgcgcggctgacgttcggtgggaggagcaggccgaaatttctggcagttcccccatactcagcatcacgatttctgaggatgggagcatgtccatcaagaatgaagaggaggaacagacactgaccattctaatcagaactggactgcttgtgatatcaggcctcttcccagtgagtatccccattacagcagccgcttggtatctgtgggaggtcaaaaagcaaagggccggtgtgttgtgggacgttcctagcccaccccctgtagggaaagccgaattagaggatggagcgtaccgtatcaagcagaagggcattctgggctattctcagatcggggctggagtgtacaaagaaggtacctttcacactatgtggcatgtcacacgcggcgccgtgctcatgcacaaggggaaacggatagagccgtcctgggcagacgttaagaaagatctgatttcatacggaggcggttggaaacttgagggggaatggaaggagggagaagaggtgcaggtcctggccttggaaccaggcaaaaaccccagagctgtgcaaaccaagcctggcctattcaaaacgaacactgggaccatcggagccgtaagtctggactttagcccaggtacatccggctctcccatcgtcgataagaaagggaaggtggttggactctatggcaatggtgtggtcaccaggtcggggacatacgtgagcgcaattgctcagactgagaagtcaatcgaggacaaccctgaaatagaggatgacattttcagaaagaaacggctgaccatcatggatcttcatccgggagccggcaaaacgaagcgctatttacccgcgattgttagagaagccatcaaaaggggcctgcggacactcatattggcaccaactcgagtggtcgctgccgagatggaagaggctctgagagggctccctattcgctaccagacccccgcaatcagggccgagcacacaggacgtgaaatcgtggacctgatgtgtcatgccaccttcactatgcggcttctgtccccaattagagtacctaattataacttgatcattatggatgaggctcactttaccgaccccgcgagtatagcagccaggggttacatctctacacgcgtggaaatgggcgaggctgccgggattttcatgacggcaactccaccgggaagccgagacccttttccccagtccaatgccccaatcatggatgaggaaagagagatccccgaacggtcatggaactctggccacgagtgggttaccgacttcaagggtaagacagtctggtttgtgcctagcattaaagctgggaatgatatagcggcctgcctaaggaagaacggcaagaaggtgatccaactgagtcgcaaaaccttcgactccgaatatattaagactcgtacaaatgattgggactttgtcgtaaccacggatatcagcgagatgggcgcaaacttcaaggctgagagagtgattgacccacggaggtgtatgaaacccgttatcctcactgatggcgaagaacgcgtgatattagccgggcctatgccggtcacacattcttcagcagcccagcgaagaggacgggtgggtaggaatccaaagaacgaaaatgaccagtacatctacatgggcgagcccctggaaaacgatgaggactgcgctcactggaaagaggccaagatgcttctggacaatattaacacccctgaagggatcattccctccatgtttgagccagaacgcgagaaagttgatgcgatcgacggagaatatagactcaggggcgaggcacggaagaccttcgtggatttgatgcgtcgcggtgacctgcctgtctggctcgcctaccgagtggctgccgaggggataaactatgctgatagaaggtggtgttttgacggcgtcaaaaataaccaaattctggaagagaatgtggaagttgagatctggactaaggagggagaacggaagaaacttaagccccgctggctagatgcaagaatttacagtgacccactggccttgaaagagttcaaggagttcgctgccggcaggaagtcgttaacactgaacctcatcaccgagatggggcggctgcctacatttatgactcagaaggcaaagaatgcgcttgataacctggccgtcctccatacggctgaagccggaggtcgagcatataatcacgctttgagcgagctgccggagaccctagaaacactgctccttctgactttattggccaccgtgacaggcgggatattcctgtttctcatgtctggaaaaggcatcggtaagatgaccctggggatgtgctgcattatcactgcatccattcttctgtggtacgcccagatccagccccactggatagctgcgagcattatcctcgagttctttttgatcgtgctgttaattccagaacctgagaaacaaagaacgccccaggacaaccagctaacctatgtcgttatcgccatactgacagtggtagcagctactatggccaatgaaatgggcttcctcgagaagaccaaaaaggattttggacttggctcaattacaacccagcaaccagagagtaacatcctggacattgatttgcgccctgcctctgcatggactctgtacgctgtggccacaacgttcatcacccccatgctcaggcattccatagaaaatagctcagtcaacgtgagtctgactgcgatcgctaatcaggccacagttcttatggggctcggaaagggttggccgctgagcaaaatggacattggcgtgccattgctggcaatcgggtgttactcccaggtcaaccctattaccttaaccgccgctctactgctccttgtagcacactatgccatcattggacccggcctgcaggcgaaggctacacgggaggcccaaaaacgtgcagccgctggtatcatgaagaatccaactgtggacgggatgacggttatagatttggaccccattccttacgatccgaaatttgaaaagcagctgggccaggtgatgctcctggtcctttgcgtgacccaggtcttaatgatgagaacaacttgggccctgtgtgaggcactcaccttggctacaggacccatctctaccctgtgggaaggcaacccagggaggttctggaatactacgatcgccgtgagcatggcgaacatttttcgcggatcctatctagccggcgcaggtctactcttctcaataatgaagaacacagctaatacccggcgagggactggaaacaccggcgagacacttggtgagaaatggaagaatagactgaacgccttgggcaaatctgaatttcaaatctacaagaaaagtgggattcaggaggttgacaggactctggcaaaggaaggaatcaaacgcggcgagaccgatcatcacgctgtgtcgcgggggagcgccaagctcagatggttcgtagagcgtaatctggtgacacctgaaggaaaggtcgttgacttaggctgcggtagagggggatggtcctattactgtggcggtcttaaaaacgtgaaggaggtcaaaggcctgacgaaagggggacccggccatgaggaacctattccaatgtctacctatgggtggaatctcgtgcggctacagtcaggagtagatgtgttctttactccccctgaaaaatgcgacacactgttgtgtgatatcggcgagagctccccaaaccccaccgttgaggccggtcgcactctgcgagtgctcaatcttgtcgaaaactggctgaataacaatacacaattctgcataaaggtgttgaacccgtacatgcctagtgtcatcgagaagatggaagcgctgcagagaaaatacgggggagctctcgtgaggaatccattatctcggaacagcacccacgagatgtattgggtttcaaacgcatccggcaatattgtaagtagcgtgaacatgatctctcgcatgctgattaatagatttacgatgaagcacaaaaaggccacctacgaacccgacgtcgatcttggctccgggacaaggaacatcggaatagagtcagagactcctaatctggacattatcggtaaacgaatcgaaaagattaagcaggagcatgaaaccagctggcactatgatcaggaccatccatacaaaacatgggcttatcacggctcgtacgagactaagcaaaccgggtctgccagttccatggtgaacggagttgtgcggctactcacaaaaccctgggacgtcataccgatggtgacccagatggcaatgactgatacgacacctttcggccagcagcgtgtatttaaggaaaaagtggacaccagaactcaagagcccaaggagggtaccaagaaactgatgaagatcacagccgaatggttgtggaaagagctggggaagaaaaagacgccacgcatgtgtaccagggaagagttcactcggaaagttagaagcaatgctgcgctcggagccatttttacagatgagaacaagtggaagtcagcacgcgaagctgtcgaggactccggcttctgggaacttgtggataaagagaggaatctgcacttagaaggcaagtgcgagacctgtgtgtataacatgatggggaaacgagagaagaaactgggagaatttggtaaggccaagggctctcgggcaatctggtacatgtggttgggggccagattcctcgagtttgaagctctgggattcctaaatgaggaccattggtttagcagggaaaacagtctttccggcgtcgagggtgaggggctgcacaaactcggatacattctgcgcgatgttagcaagaaagaaggcggcgccatgtatgcggacgatactgcagggtgggacacacgtatcaccttggaggatctgaagaatgaagagatggtgacaaaccatatggaaggagagcaccggaaactcgccgaggctatattcagacttacttaccagaataaggtagtgagggtccagcgccctacaccccgaggtacggtgatggacatcatttctcggagagaccagaggggctcagggcaagttgtgacctatggactgaacacattcactaacatggaagcccagttaatccgccagatggagggcgaaggtgtctttaagagtattcaacatctgaccgtgacagaggagatcgcagtcaaaaattggttggaaagagttgggcgggagaggctctcccgtatggctattagcggagatgactgcgtggtcaagccactggatgaccgattcgcctctgctctaactgcccttaacgatatgggcaaagtgcgcaaggacatacagcagtgggaaccctcgagaggctggaatgattggacccaggtgcctttttgctcacaccacttccatgagctgatcatgaaagacgggcgggtcctcgttgtgccatgtaggaaccaagatgaactgattggacgcgcaagaatcagccagggtgcgggctggtccttgcgggagacggcctgcttagggaagagttacgctcagatgtggtctctgatgtattttcacaggcgagacctccgtcttgccgcaaatgctatctgtagcgccgtaccgtcccattgggtgcccatttcaagaacaacctggagtatacacgcaactcacgagtggatgacaaccgaagatatgctgactgtctggaaccgcgtgtggatccaggagaatccttggatggaagacaagaccccagttgagtcttgggaagagattccctacctaggaaaacgggaggatcaatggtgcggcagcctgatcggtctcacatccagggccacgtgggcgaagaacattcagaccgctatcaatcaggtgagatcattgatagggaacgaagagtatactgactacatgcctagcatgaaacgcttccggagggaagaggaagaggccggagtcctgtggtga

SEQ ID NO: 14333 - RNA, 9876 nt, synthetic construct
  misc_feature 1..9876: note = derived and/or modified CDS sequence (opt3) from DENV-2__KX380838__SS-prME
  source 1..9876: mol_type = other RNA
accgccggaatcattataatgatgatccccaccgtgatggctttccacctgactacgagaaacggggaacctcatatgattgtaagcaggcaggaaaagggaaaatccctcctttttaagaccgagaatggtgttaacatgtgcaccctgatggcaatggacttgggcgaattatgtgaggatactatcacctacaattgcccactgctgcggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactcggaccgaaacatggatgagctccgagggggcttggaagcacgcccagaggatcgagacttgggtgcttcggcatcctggattcaccgttatggcagccatactggcttacacaatcggcaccacgtattttcagcgcgtgttgattttcatcctcctgactgcagtcgccccatctatgacaatgagatgcattggcatctcgaacagggactttgtggaaggggtatcaggaggtagctgggttgatatagtgctggagcacggcagttgtgtcaccactatggctaaaaataagcccacactcgacttcgaattaattaagaccgaggccaaacaccctgcgacgctgcggaagtactgcatcgaagcaaaacttaccaacacaactaccgcctcccgctgtccaacacagggggagccctctttgaatgaggaacaagataagcgatttgtgtgcaaacatagcatggtggacagaggatggggcaacggttgtgggctgttcggaaagggcggcattgtcacttgcgctatgtttacctgcaagaaaaatatggaggggaagatcgttcagcctgaaaacctagagtatacaatcgtgattaccccacactccggagaagagaatgccgtaggtaacgatactggcaaacatgggaaggagataaaagtgacgccgcagtcaagtatcacagaagcagagctcaccggatacggcactgctaccatggaatgtagccccaggacaggtctggacttcaatgagatggtccttctgcagatggaaaacaaggcctggttggtgcaccggcaatggtttctcgatctgcctttaccatggctgcccggggcggacacccagggctctaactggattcagaaagagactctcgttacattcaagaatcctcacgccaagaaacaggatgtggtcgtgcttggatcccaagagggcgcaatgcatacggctctgaccggggccactgaaatccagatgtcaagcggaaacttgctatttacaggtcacctgaagtgccgtctccgcatggacaaactgcagcttaagggcatgagttattctatgtgtaccgggaaattcaaggtagttaaggagatagctgaaacacaacatggaactattgtgatcagagtccagtacgagggcgacggttccccatgcaaaatccccttcgagattatggatctggaaaagaggcacgtgttggggcggctcatcaccgtcaatccgattgtgacggagaaagacagccctgttaacatagaagccgagcccccatttggcgattcgtacatcattatcggagtggaacctggccagctgaagttatcttggttcaaaaaggggtcctcaatcggacagatgtttgagaccacaatgcgaggtgcaaagcgcatggccattctgggcgacactgcttgggatttcgggagtctaggaggcgtatttaccagcataggtaaagcgctccatcaagtcttcggggcaatctatggcgccgctttttccggagtgtcttggacaatgaagattctgatcggcgttgtgattacttggatcgggatgaatagcagatcaaccagtctttccgtcagcttggtgctggtaggaatagtgacgctctacctgggcgttatggtccaggccgactctggttgtgtggtgtcatggaaaaacaaggagcttaaatgcgggagtggaatcttcattacagataatgtccacacctggactgaacagtataagtttcagcccgagagcccatccaagctggcatctgccatccaaaaagctcacgaagagggcatttgtggtatcaggtcggttacacggttggaaaacctcatgtggaagcagataacccccgagctgaatcatattttaagcgagaacgaagtgaaactgactatcatgaccggcgacattaaggggatcatgcaggccggaaaacgctccctaagacctcagccaacagagctcaagtactcatggaaagcatggggcaaggcgaagatgctgagtacggaacttcacaatcataccttcttgatagatgggccggagactgctgaatgccccaacacaaatagggcctggaactctctggaggtggaggactatggatttggcgtattcaccacaaatatctggctcaaactgaaggaacgtcaagatgtcttttgtgacagcaaattaatgtccgcagccattaaggacaaccgggctgtgcacgccgatatgggttactggatcgagtcagcactgaacgacacttggaaaattgaaaaggctagcttcatcgaggttaagtcttgccactggcctaaatcccataccctttggagtaatggggtgttggagagcgaaatgataattccaaagaacttcgccggacccgtctctcagcacaattatcgacctggctaccatacgcagacagcgggtccatggcacctcggcagactggagatggattttgacttctgtgaagggaccactgtggttgtgaccgaggattgcggaaacaggggcccctccctacgcacaactaccgcctcagggaaactgatcacagaatggtgctgtcggagttgcacgctcccgcctctgagatacaggggagaggacggctgttggtatggtatggagatccgcccacttaaggaaaaagaggaaaatttggtaaacagcctggtcaccgctgggcatggacagattgataatttttcgttaggcgtgctcggtatggcactgttccttgaggaaatgctgcgaactcgggtgggcacaaagcacgccatcttgctcgtcgctgtttcctttgtgaccctgattactgggaacatgtctttccgtgacctaggaagagtaatggtgatggtcggcgccacaatgaccgatgacatagggatgggagtgacgtacctggcactcctggcggcctttaaggttaggcccactttcgctgccggccttttgctgcgcaaattaaccagcaaggagctcatgatgacaaccatcggtattgtgctgctttcacaaagtactatccctgagacaattctggaactaaccgatgcactcgctctggggatgatggtcttgaaaatcgtgcggaatatggagaagtatcagctggccgttacaataatggcaactttatgcgtgcccaacgccgtcatcctccagaatgcttggaaagtatcctgtaccattctggcggtggtttctgtgagcccacttctgttgacgtcctcacaacagaaggccgactggatccctctcgcactgacaattaagggactaaaccccaccgctatctttctgactacccttagcagaacaagtaaaaagaggtcttggccactcaatgaagccataatggccgtcggcatggtgtccattctggctagctcgttgctgaaaaacgatatcccgatgactggccctttagtagcagggggactcctgaccgtgtgctacgtccttacgggtcgatcagccgacctggagttggaacgcgcggctgacgttcggtgggaggagcaggccgaaatctctggcagttcccccattctcagcataacaatctctgaggatgggagcatgtccattaagaatgaagaggaggaacagaccctgactatcctaattagaacaggactgcttgtgatctcaggcctcttcccagtgagtatacccatcaccgcagccgcttggtatctgtgggaggtcaaaaagcaaagggccggtgtgttgtgggacgttcctagcccaccccctgtagggaaagccgaattagaggatggagcgtaccgtattaagcagaagggcatcctgggctattctcagattggggctggagtgtacaaagaaggtacttttcacacaatgtggcatgtcacccgcggcgccgtgctcatgcacaaggggaaacggatcgagccgtcctgggcagacgttaagaaagatctgatatcatacggaggcggttggaaacttgagggggaatggaaggagggagaagaggtgcaggtcctggccttggaaccaggcaaaaaccccagagctgtgcaaacgaagcctggcctattcaaaactaacaccgggacaattggagccgtaagtctggactttagcccaggtacctccggctctcccatcgtcgataagaaagggaaggtggttggactctatggcaatggtgtggtcacaaggtcggggacttacgtgagcgcaatcgctcagaccgagaagtcaattgaggacaaccctgaaatcgaggatgacatattcagaaagaaacggctgacgattatggatcttcatccgggagccggcaaaacaaagcgctatttacccgcgatcgttagagaagccattaaaaggggcctgcggactctcatcttggcaccaacccgagtggtcgctgccgagatggaagaggctctgagagggctccctatacgctaccagacacccgcaattagggccgagcacaccggacgtgaaatcgtggacctgatgtgtcatgccactttcaccatgcggcttctgtccccaatcagagtacctaattataacttgattatcatggatgaggctcactttacagaccccgcgagtattgcagccaggggttacatatctacgcgcgtggaaatgggcgaggctgccgggatcttcatgactgcaaccccaccgggaagccgagacccttttccccagtccaatgccccaattatggatgaggaaagagagatccccgaacggtcatggaactctggccacgagtgggttacagacttcaagggtaagaccgtctggtttgtgcctagcatcaaagctgggaatgatattgcggcctgcctaaggaagaacggcaaaaaggtgatacaactgagtcgcaaaactttcgactccgaatatatcaagacacgtaccaatgattgggactttgtcgtaacgactgatattagcgagatgggcgcaaacttcaaggctgagagagtgatcgacccacggaggtgtatgaaacccgttattctcacagatggcgaagaacgcgtgatcttagccgggcctatgccggtcacccattcttcagcagcccagcgaagaggacgggtgggtaggaatccaaagaacgaaaatgaccagtacatatacatgggcgagcccctggaaaacgatgaggactgcgctcactggaaagaggccaagatgcttctggacaatatcaacacccctgaagggattatcccctccatgtttgagccagaacgcgagaaagttgatgcgattgacggagaatatagactcaggggcgaggcacggaagactttcgtggatttgatgcgtcgcggtgacctgcctgtctggctcgcctaccgagtggctgccgaggggatcaactatgctgatagaaggtggtgttttgacggcgtcaaaaataaccaaatactggaagagaatgtggaagttgagatttggacaaaggagggagaacggaagaaacttaagccccgctggctagatgcaagaatctacagtgacccactggccttgaaagagttcaaggagttcgctgccggcaggaagtcgttaaccctgaacctcattacagagatggggcggctgcctacttttatgacgcagaaggcacgaaatgcgcttgataacctggccgtcctccataccgctgaagccggaggtagagcatataatcacgctttgagcgagctgccggagacactagaaactctgctccttctgaccttattggccacagtgaccggcgggatcttcctgtttctcatgtctggaaagggcataggtaaaatgactctggggatgtgctgcatcattacggcatccatccttctgtggtacgcccagattcagccccactggatcgctgcgagcataattctcgagttctttttgatcgtgctgttaatcccagaacctgagaagcaacgcacaccccaggacaaccagctaacatatgtcgttattgccatcctgactgtggtagcagctaccatggccaatgaaatgggcttcctcgagaaaacaaagaaagattttggacttggctcaataaccactcagcaaccagacagtaacattctggatatcgacttgaggcctgcctctgcatggacactgtacgctgtggccacgaccttcattactcccatgctccggcattccatcgagaatagctcagtcaacgtgagtctgacagcgatagctaatcaggccaccgttcttatggggctcggaaagggttggccgctgagcaagatggacatcggcgtgccattgctggcaattgggtgttactcccaggtcaaccctatcaccttaacagccgctctactgctccttgtagcacactatgccattatcggacccggcctgcaggcgaaagctactcgtgaagcccaaaagagagcagccgctggtattatgaaaatcccagccgcagatgggataacggtgattgacttggatcccatcccttacgacccgaagtttgagaaacagctgggccaggttatgctcctggtgctttgcgtcacccaggtgttaatgatgaggacaacttgggctctgtgtgaagccctcaccttggcgacaggacccatctctaccctgtgggagggcaatccagggcgcttctggaacactacgattgccgtcagcatggcaaatatatttcggggatcctatctagctggcgccggtctactcttctcaatcatgaagaacacagcaaacacccgaagagggactggaaataccggcgaaacacttggtgagaagtggaaaaacaggctgaatgctttgggcaagtctgagtttcaaatttacaaaaagagtgggatccaggaagtggatcgcactctggccaaagagggaattaagcggggcgaaaccgaccatcacgccgtttcgagagggagcgcgaaactccgttggttcgtggagaggaacctggtaacacctgagggaaaggtggtcgatttaggctgcggtagagggggatggtcctattactgtggcggtcttaagaatgttaaagaagtgaagggcctgacgaaagggggacccggccatgaggaacctatcccaatgtctacctatgggtggaacctcgtccgcctacagtcaggagtggacgtattctttactccccctgagaagtgcgatacactgttgtgtgacataggcgaaagctccccaaatcccaccgtggaggctggtcgaactctgagagttctcaaccttgtggagaattggctgaacaataacacacaattctgcatcaaagtcttgaatccgtacatgcctagtgtgattgaaaagatggaggcactgcagaggaagtacgggggagccctcgtccggaacccattatctcgcaatagcacccacgaaatgtattgggtgtcaaacgcttccggcaacatcgttagtagcgtaaatatgatttctagaatgctgatcaacaggtttacgatgaaacacaagaaagccacctacgagcccgatgtggaccttggctccgggacacgaaatataggaattgaatcagagactcctaacctggatatcatcggtaagcggattgagaaaataaagcaggaacatgagaccagctggcactatgaccaggaccatccatacaagacatgggcatatcacggctcgtacgaaactaaacaaaccgggtctgccagttccatggtcaatggagtggttcgtctactcacaaagccctgggatgtgatcccgatggtcacccagatggctatgactgacacgacacctttcggccagcagagagtgtttaaagagaaggtagatacccgcactcaagaacccaaagagggtaccaagaagctgatgaaaattacagcggagtggttgtggaaggaactggggaaaaagaaaacgccaaggatgtgtacccgggaggagttcactagaaaggtgcgcagcaacgccgcactcggagctatctttacagacgagaataaatggaagtcagccagggaggcagttgaagattccggcttctgggagcttgtcgacaaggaacgaaacctgcacttagagggcaaatgcgaaacctgtgtgtataatatgatggggaagcgggagaaaaagctgggagagtttggtaaagccaagggctctagagctatttggtacatgtggttgggggccaggttcctcgaatttgaggcgctgggattcctaaacgaagatcattggtttagccgcgagaatagtctttccggcgtggaaggtgaggggctgcacaagctcggatacatcctgcgtgacgtcagcaaaaaggagggcggcgcaatgtatgccgatgacactgctgggtgggatacacggataaccttggaagacctgaaaaacgaggaaatggttacaaatcatatggagggagaacacagaaagctcgccgaggcaatcttcaggcttacttaccagaacaaagtggtacgcgtgcagcgacctacaccccggggtacggtcatggacattatctctagaagggatcagcgcggctcagggcaagtggttacctatggactgaatacattcactaacatggaggctcagttaattagacagatggaaggcgagggtgtgtttaagagtatccaacatctgaccgtcacagaagagattgccgtgaagaactggttggagcgggtagggagggaacgtctctcccgaatggctataagcggagacgattgcgttgtgaaaccactggacgatcgcttcgcctctgcactaactgcgcttaatgacatgggcaaggtcagaaaagatatccagcagtgggagccctcgcggggctggaacgactggacccaggtgcctttttgctcacaccacttccatgaactgattatgaaggatgggagggtgctcgtcgttccatgtcgcaatcaagacgagctgatcggacgagcacggatcagccagggtgctggctggtccttgagggaaacggcctgcttagggaaaagttacgcacagatgtggtctctgatgtattttcaccgacgtgatctcagacttgctgccaacgcaatttgtagcgccgtgccgtcccattgggtacccatatcacgcacaacctggagtatccacgcgactcacgagtggatgacaaccgaggacatgctgactgtgtggaatcgggtctggattcaggaaaacccttggatggaggataagaccccagtggaatcttgggaggaaatcccctacctaggaaagagggaggaccaatggtgcggcagcctgattggtctcacatccagagctacgtgggccaaaaatatccagaccgcaataaaccaggttcgctcattgatcgggaatgaggaatatactgactacatgcctagcatgaagcggttcaggcgagaggaagaggaagccggagtgctgtggtga

SEQ ID NO: 14334 - RNA, 9876 nt, synthetic construct
  misc_feature 1..9876: note = derived and/or modified CDS sequence (opt3) from DENV-2__KM279515__SS-prME
  source 1..9876: mol_type = other RNA
accgcaggaatcattataatgatgatccccacagtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgtggcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgaggtgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgctctcgggcggctgatcaccgtcaatcccattgtgacggagaaagacagcccggttaacatagaagccgagcctccctttggcgattcgtacatcattatcggagtggaaccaggccagttaaagctgtcttggttcaaaaaggggtcctcaatcggacagatgtttgagaccacaatgcgaggtgcaaagcgcatggccattctaggcgacactgcttgggatttcgggagtctcggaggcgtatttaccagcataggtaaagcgctgcatcaagtcttcggggcaatctatggcgccgctttttccggagtgtcttggacaatgaagattcttatcggcgttgtgattacttggatcgggatgaatagcagatcaaccagtttgtccgtcagcctggtgctcgtaggagtggttacgctgtaccttggcgtcatggtgcaggccgactctggttgtgtggtctcatggaaaaacaaggagctgaaatgcgggagtggaatattcatcacagataatgttcacacctggactgaacagtataagtttcagcctgagagcccctccaagttggcatctgccattcaaaaagctcacgaagagggcatctgtggtattaggtcggtgacacggctcgaaaacctgatgtggaagcagatcaccccagagttaaatcatatactgactgagaacgaagtgaaactaaccattatgacaggcgacatcaaggggattatgcaggccggaaaacgcagcctcagaccccagcctacggagctgaagtactcctggaaagcatggggcaaggcgaagatgctttcaaccgaattgcacaatcatactttcctgatcgatgggccagagacagctgaatgcccgaacaccaatagggcctggaacagtctcgaggtagaggactatggatttggcgtcttcacaactaatatatggctgaaattaaaggaacgtcaagatgtgttttgtgactctaaactgatgagcgcagccatcaaggacaaccgggctgttcacgccgatatgggttactggattgagtccgcacttaacgacacctggaaaatcgaaaaggcttcattcattgaggtaaagagctgccactggcccaaatctcatacgttgtggtccaatggggtcctcgagagtgaaatgatcatacctaagaacttcgccggaccagtgagccagcacaattatcgacccggctaccatacacagaccgcgggtccttggcacctgggcagactagagatggattttgacttctgtgaagggactaccgttgtggtaacagaggattgcggaaacaggggcccatctctgcgcactaccacagcctccgggaaactcattacggaatggtgctgtcggtcatgcaccctgcccccgcttagatacaggggagaggacggctgttggtatggtatggagatccgccctttgaaggaaaaagaggaaaatctggtcaacagtttagtgactgctgggcatggacagatcgataattttagcctcggcgtgctgggtatggcacttttcctggaggaaatgttgcgaacacgggtcggcaccaagcacgccattctcctggttgctgtgtcgtttgtaactctaatcacagggaacatgtccttccgtgacctgggaagagtgatggtcatggtgggcgccaccatgacggatgacattgggatgggagttacttacctcgcactgcttgcggcctttaaggtgaggccaaccttcgctgccggcttgctgttacgcaaactcacatctaaggagctgatgatgaccactataggtatcgtccttctgagccaatcaacaattcccgagagtatcctagaactcaccgatgcactggctttggggatgatggtgctgaaaattgttcggaatatggagaagtatcagttagccgtgacaatcatggcaatactctgcgtccctaacgccgtaatcctgcagaatgcttggaaagtgtcctgtactacccttgcggttgtgtctgtcagccccctgttgctcacgtcctcacaacagaaggccgactggattccactggcactaacaatcaagggactgaaccctaccgctatttttcttactaccctcagcagaacaagtaaaaagaggtcttggcccctgaatgaagccatcatggccgtgggcatggtatccatattggctagctcgctgctaaagaacgatattccaatgactggcccgctcgtggcagggggactgcttaccgtctgctacgttctgacgggtcgatcagccgacttggagctcgaacgcgcggctgacgtgcggtgggaggagcaggccgaaatctctggcagttcccctatcctgagcattacaatatctgaggatgggagcatgtccatcaagaatgaagaggaggaacagaccctaactattctgatcagaacaggacttctcgtgatttcaggcctgttccccgtcagtatcccaataaccgcagccgcttggtatttgtgggaggtgaaaaagcaaagggccggtgttttatgggacgtacccagccctccacccgtggggaaagccgaactggaggatggagcgtaccgtatcaagcagaagggcattctcggctattctcagatcggggctggagtctacaaagaaggtacttttcacacaatgtggcatgtgacccgcggcgccgttctgatgcacaaggggaaacggattgagccttcctgggcagacgtgaagaaagatcttatctcatacggaggcggttggaagctggagggggaatggaaggagggagaagaggtccaggtgttggccctagaaccgggcaaaaacccaagagctgtacaaacgaagcccggcctgttcaaaactaacaccgggacaataggagccgtcagtctcgactttagccctggtacctccggctctccaattgtggataagaaagggaaggttgtgggactgtatggcaatggtgtcgtgacaaggtcggggacttacgttagcgcaatcgctcagaccgagaagtcaatcgaggacaaccccgaaattgaggatgacatcttccggaaaaagagacttacgataatggatttacatcctggagccggcaaaacaaagcgctatctgccggcgattgtgagagaagccatcaaaaggggcctccggactttgattctggcacccacccgagtcgtggctgccgagatggaagaggctctcagagggctgccaatccgctaccagacccctgcaataagggccgagcacaccggacgtgaaattgtagaccttatgtgtcatgccactttcaccatgcggctgttgtcccccatcagagtgccaaattataacctaatcattatggatgaggctcactttacagaccctgcgagtatcgcagccaggggttacatttctacgcgcgttgaaatgggcgaggctgccgggatattcatgactgcaacacccccaggaagccgagacccgtttcctcagtccaatgcccccatcatggatgaggaaagagagattccagaacggtcatggaactctggccacgagtgggtcacagacttcaagggtaagaccgtgtggtttgtgcccagcatcaaagctgggaatgatatcgcggcctgcctgaggaagaacggcaaaaaggtcattcaactcagtcgcaaaactttcgactccgaatatataaagacacgtaccaatgattgggactttgtagtgacgactgatatcagcgagatgggcgcaaacttcaaggctgagagagttattgaccctcggaggtgtatgaaaccagtgatcttaacagatggcgaagaacgcgtcattctggccgggcccatgcctgtgacccattcttcagcagcccagcgaagaggacgggttggtaggaatccgaagaacgaaaatgaccagtacatctacatgggcgagccacttgaaaacgatgaggactgcgctcactggaaagaggccaagatgctgctcgacaatataaacacccccgaagggatcattccttccatgtttgagcccgaacgcgagaaagtggatgcgatcgacggagaatatagattgaggggcgaggcacggaagactttcgtcgatctgatgcgtcgcggtgacctcccagtgtggctggcctaccgagtagctgccgaggggattaactatgctgatagaaggtggtgttttgacggcgtgaaaaataaccaaatccttgaagagaatgttgaagtcgagatatggacaaaggagggagaacggaagaaactaaagcctcgctggctggatgcaagaatttacagtgaccccttggccttaaaagagttcaaggagttcgctgccggcaggaaaagcctgaccctcaacctgatcacagagatggggcggcttccaacttttatgacgcagaaggcaaagaatgcgctggataacctcgccgtgttgcataccgctgaagccggaggtcgagcatataatcacgctctgtcggagctacctgagacactggaaactctccttctgttaaccttgctggccacagtgaccggcgggattttcctctttctgatgtctggaaaaggcatcggtaagatgactcttgggatgtgctgcataatcacggcatccattctgctctggtacgcccagatccagccgcactggattgctgcgagcatcatattggagttctttctgattgtcttactaatccccgaaccagagaaacaaagaacccctcaggacaaccagctgacatatgttgtgatcgccattctcactgtagtggcagctaccatggccaatgaaatgggcttccttgagaagaccaaaaaggattttggactgggctcaatcaccactcagcaacccgagagtaacatattggacattgatctgcgcccagcctctgcatggacactctacgctgtcgccacgaccttcatcactcctatgctgaggcattccattgaaaatagctcagtgaacgttagtcttacagcgatcgctaatcaggccaccgtgctcatggggctgggaaagggttggcccttgagcaaaatggacataggcgtcccgctgttagcaatcgggtgttactcccaggtaaacccaattaccctaacagccgctctgctccttctggtggcacactatgccatcattggacctggcttgcaggcgaaggctactcgggaggcccaaaaacgtgcagccgctggtatcatgaagaatcccacggttgacgggatgaccgtgattgatctggacccaatcccctacgatcctaaatttgaaaagcagctcggccaggtcatgctgcttgtgttatgcgtcacacaggtgctgatgatgagaactacctgggccctctgtgaggcattgacactggctaccggaccgatatctactctatgggaaggcaaccccgggaggttctggaatacgacaattgccgttagcatggcgaacatctttcgcggatcctatctggccggcgcaggtctccttttctcaatcatgaagaacaccgctaatactcggcgagggaccggaaacacaggcgagactctgggtgagaaatggaagaatagattgaacgccctgggcaaatctgaatttcaaatttacaagaaaagtgggatacaggaggtggacaggaccctcgcaaaggaaggaatcaaacgcggcgagacagatcatcacgctgtatcgcgggggagcgccaagctgagatggttcgtggagcgtaatttagtcacgccagaaggaaaggttgtggaccttggctgcggtagagggggatggtcctattactgtggcggtctgaaaaacgtcaaggaggtgaaaggcctcaccaaagggggacctggccatgaagaacccattcctatgtctacttatgggtggaatctagtacggctgcagtcaggagtggatgttttctttacaccacccgaaaaatgcgacaccttgctgtgtgatatcggcgagagctcccctaacccaactgtggaggccggtcgcacactccgagtccttaatctggtggaaaactggttgaataacaatacccaattctgcattaaggtcctgaacccctacatgccgagtgtgatcgagaagatggaagcgctccagagaaaatacgggggagctttagttaggaatcctctgtctcggaacagcacgcacgagatgtattgggtatcaaacgcatccggcaatatagtgagtagcgtcaacatgatctctcgcatgcttattaatagatttaccatgaggcacaagaaagccacatacgaaccagacgtggatctgggctccgggactcgaaacatcggaattgagtcagagacccccaatctagacatcataggtaagcggattgagaaaatcaagcaggagcatgaaacaagctggcactatgatcaggaccatccttacaagacttgggcttatcacggctcgtacgagaccaaacaaacagggtctgccagttccatggttaacggagtggtccgtctcctgaccaagccatgggacgtgatccccatggtaactcagatggcaatgacggatacaaccccgttcggccagcagagagtgtttaaagaaaaggttgacactcgcacccaagagcctaaagagggtacaaagaagttgatgaaaattacggccgaatggctgtggaaggagctcgggaaaaagaaaacccccaggatgtgtactcgggaagagttcacaagaaaggtccgcagcaatgctgcgcttggagccatatttaccgatgagaacaaatggaagtcagcaagggaagctgtggaggactccggcttctgggaactggtggataaggagcgaaatttacacctggaaggcaaatgcgagacttgtgtctataacatgatggggaagcgggagaaaaagttgggagaatttggtaaagccaagggctctagagcaatctggtacatgtggctcggggccaggttcctggagtttgaagctctaggattccttaatgaggaccattggtttagccgcgaaaacagtctgtccggcgttgagggtgaggggctccacaagctgggatacattttgcgtgatgtgagcaaaaaggaaggcggcgccatgtatgcggacgatacagcagggtgggacacccggatcacactggaggatctcaaaaatgaagagatggtaactaaccatatggaaggagagcacaagaaacttgccgaggctattttcaagctgacctaccagaataaggtggtcagagtgcagaggccaacgcctcgcggtaccgttatggacatcatatctcgacgggaccagagaggctcagggcaagtggtcacatatggattaaacactttcaccaacatggaagcccagctgatcaggcagatggagggcgaaggtgtgtttaaaagtattcaacagttgacagtaaaggaggagatcgcagttaaaaattggctcattcgcgtggggagagaacggctgtccaggatggctatcagcggagatgactgcgtcgtgaagcccctagatgaccgtttcgcctctgctcttactgccctgaacgatatgggcaaagtgcgaaaggacattcagcagtgggagccatcgcgcggctggaatgattggacccaagtccccttttgctcacatcacttccacgaactcataatgaaggacgggagagttctggtggtaccttgtcggaaccaggatgagttgatcggaagggcacgcattagccagggtgcgggctggtccttaagagaaacggcctgcctggggaaaagttacgctcagatgtggtctctcatgtattttcatcggagggaccttcgactggccgcaaatgctatctgtagcgccgtgccatcccactggatcccgacatcacgtaccacttggagtattcatgcaacacacgagtggatgaccactgaggatatgctaaccgtctggaacagagtgtggatacaagaaaatccctggatggaggacaagacacctgttgaaacgtgggaggaaatcccatacctgggaaaacgcgaggatcagtggtgcggctctctcattggtttgaccagccgggccacttgggcgaagaacatccagacagctattaatcaggtgaggtccctgatcgggaacgaggaatataccgactacatgccctcaatgaaaagattccgccgggaggaagaggaagccggagtcctttggtga

SEQ ID NO: 14335 - RNA, 9876 nt, synthetic construct
  misc_feature 1..9876: note = derived and/or modified CDS sequence (opt3) from DENV-2__KM279516__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcagcctcagaccccagcctacggagctgaagtactcctggaaagcctggggcaaggcaaagatgctttcaaccgaattgcacaatcatactttcctgatcgatgggccagagacagcggaatgcccgaacaccaatagggcttggaacagtctcgaggtcgaggactatggatttggcgtgttcacaactaatatatggctgaaattaaaggaacgtcaagatgttttttgtgactctaaactgatgagcgccgcaatcaaggacaaccgggccgtgcacgctgatatgggttactggattgagtccgcccttaacgacacctggaaaatcgaaaaggcatcattcattgaggtcaagagctgccactggcccaaatctcatacgttgtggtccaatggggtgctcgagagtgaaatgatcatacctaagaacttcgctggaccagttagccagcacaattatcgacccggctaccatacacagaccgccggtccttggcacctgggcagactagagatggattttgacttctgtgaagggactaccgtggtagtcacagaggattgcggaaacaggggcccatctctgcgcactaccacagcgtccgggaaactcattacggaatggtgctgtcggtcatgcaccctgcccccgcttagatacaggggagaggacggctgttggtatggtatggagatccgccctttgaaggaaaaagaggaaaatctggtgaacagtttagtgactgccgggcatggacagatcgataattttagcctcggcgtcctgggtatggctcttttcctggaggaaatgttgcgaacacgggttggcaccaagcacgcaattctcctggtggccgtatcgtttgtgactctaatcacagggaacatgtccttccgtgacctgggaagagtcatggtgatggttggcgctaccatgacggatgacattgggatgggagtgacttacctcgccctgcttgcagcgtttaaggtcaggccaaccttcgccgctggcttgctgttacgcaaactcacatctaaggagctgatgatgaccactataggtatcgtgcttctgagccaatcaacaattcccgagaatatcctagaactcaccgatgccctggcattggggatgatggttctgaaaattgtgcggaacatggagaagtatcagttagctgtcacaatcatggccatactctgcgtacctaatgcagtgatcctgcagaacgcctggaaagttagttgtactacccttgctgtggtctccgtgtctcccctgttgctcacgagctcccaacagaaggcggactggattccactggccctaacaatcaagggactgaatcctaccgcaatttttcttactaccctctcaagaacaagcaaaaagaggagttggcccctgaacgaagctatcatggccgtaggcatggtgtctatattggcctccagcctgttaaaaaatgatattccaatgactggcccgctcgtcgctgggggactgcttaccgtttgctacgtgctgacgggtcgatcggcagacttggagctcgaacgcgccgcggacgtgcggtgggaggagcaggctgaaatctcaggctctagtcctatcctgtccattacaataagcgaggatgggtctatgagcatcaagaacgaagaggaggaacagaccctaactattctgatcagaacaggacttctcgtcatttccggcctgttccccgtgtcaatcccaataaccgccgcagcctggtatttgtgggaggttaaaaagcaaagggctggtgtattatgggacgtgcccagtcctccacccgtcgggaaagcagaactggaggatggagcctaccgtatcaagcagaagggcattctcggctatagccagatcggggcgggagtgtacaaagaaggtacttttcacacaatgtggcatgttacccgcggcgctgtgctgatgcacaaggggaaacggattgagccttcttgggccgacgtcaagaaagatcttatctcctacggaggcggttggaagctggagggggaatggaaggagggagaagaggtgcaggtattggcactagaaccgggcaaaaacccaagagccgtccaaacgaagcccggcctgttcaaaactaataccgggacaataggagctgtgtcactcgactttagtcctggtaccagcggctccccaattgttgataagaaagggaaggtggtcggactgtatggcaacggtgtggttacaaggtctgggacttacgtgtcggccatcgcacagaccgagaagagcatcgaggacaatcccgaaattgaggatgacatcttccgaaaaaagcggcttacgataatggatttacatcctggagctggcaaaacaaagcgctatctgccggccattgtcagagaagcgatcaaaaggggcctccggactttgattctggcccccacccgagtggtagcagctgagatggaagaggccctcagagggctgccaatccgctaccagacacctgctataagggcagagcacaccggacgtgaaattgtggaccttatgtgtcatgccactttcaccatgcggctgttgtcacccatcagagttccaaactataatctaatcattatggatgaggcccactttacagaccctgcttccatcgcggcaaggggttacattagtacgcgcgtcgaaatgggcgaggccgctgggatattcatgactgccacccccccaggatctcgagacccgtttcctcagagcaacgcacccatcatggatgaggaaagagagattccagaacggtcctggaattcaggccacgagtgggtgacagacttcaagggtaagaccgtgtggtttgtcccctctatcaaagccgggaacgatatcgctgcgtgcctgaggaagaatggaaaaaaggtaattcaactcagccgcaaaactttcgacagtgaatatataaagacacgtaccaacgattgggactttgtggttacgactgatatctccgagatgggcgccaatttcaaggcagagagagtgattgaccctcggaggtgtatgaaaccagtcatcttaacagatggcgaagagcgcgtgattctggctgggcccatgcctgttacccatagctctgccgcacagcgaagaggacgggtgggtaggaacccgaagaatgaaaacgaccagtacatctacatgggcgagccacttgaaaatgatgaggactgcgcccactggaaagaggctaagatgctgctcgacaacataaacacccccgaagggatcattccttcaatgtttgagcccgaacgcgagaaagtcgatgccatcgacggagaatatagattgaggggcgaggcgcggaagactttcgtggatctgatgcgtcgcggtgacctcccagtatggctggcataccgagtggccgctgaggggattaattatgccgatagaaggtggtgttttgacggcgttaaaaacaatcaaatccttgaagagaacgtcgaagtggagatatggacaaaggagggagaacggaagaaactaaagcctcgctggctggatgctagaatttactccgaccccttggcattaaaagagttcaaggaattcgccgctggcaggaaaagtctgaccctcaatctgatcacagagatggggcggcttccaacttttatgacgcagaaggccaagaacgcactggataatctcgcggtgttgcataccgccgaagctggaggtcgagcctataaccacgcactgagcgagctacctgagacactggaaactctccttctgttaaccttgctggctacagtcaccggcgggattttcctctttctgatgtcgggaaaaggcatcggtaagatgactcttgggatgtgctgcataatcacggcctctattctgctctggtacgcacagatccagccgcactggattgccgcttccatcatattggagttctttctgattgttttactaatccccgaaccagagaaacaaagaacccctcaggacaatcagctgacatatgtggtaatcgcgattctcactgtggtcgccgcaaccatggctaacgaaatgggcttccttgagaagacaaaaaaggattttggactgggcagcatcaccactcagcaacccgagtcaaatatattggacattgatctgcgcccagccagtgcctggacactctacgcagtggctacgaccttcatcactcctatgctgaggcattctattgaaaactccagcgttaatgtgtcacttacagccatcgcgaaccaggctaccgtcctcatggggctgggaaagggttggcccttgagtaaaatggacataggcgtaccgctgttagccatcgggtgttacagccaggtgaatccaattaccctaacagcagccctgctccttctggttgctcactatgcaatcattggacctggcttgcaggccaaggcgactcgggaggctcaaaaacgtgccgcagccggtatcatgaagaaccccacggtggacgggatgaccgtcattgatctggacccaatcccctacgatcctaaatttgaaaagcagctcggccaggtgatgctgcttgtcttatgcgtgacacaggttctgatgatgagaactacctgggctctctgtgaggccttgacactggcaaccggaccgatatccactctatgggaaggcaatcccgggaggttctggaacacgacaattgctgtgtctatggccaacatctttcgcggaagctatctggcgggcgccggtctccttttctccatcatgaagaataccgcaaacactcggcgagggaccggaaatacaggcgagactctgggtgagaaatggaagaacagattgaatgctctgggcaaatcagaatttcaaatttacaagaaatctgggatacaggaggtagacaggaccctcgccaaggaaggaatcaaacgcggcgagacagatcatcacgcagtgagtcgggggtcggctaagctgagatggttcgtcgagcgtaacttagttacgccagaaggaaaggtggtcgaccttggctgcggtagggggggatggagctattactgtggcggtctgaaaaatgtgaaggaggtaaaaggcctcaccaaggggggacctggccatgaagagcccattcctatgtccacttatgggtggaacctagtgcggctgcagtctggagttgatgtgttctttacaccacccgaaaaatgcgacaccttgctgtgtgatatcggcgagtcaagccctaatccaactgtcgaggccggtcgcacactccgagtgcttaacctggtcgaaaattggttgaacaataacacccaattctgcattaaggtgctgaatccctacatgccgtccgttatcgagaagatggaagccctccagagaaaatacgggggagcgttagtaaggaaccctctgagtcggaactctacgcacgagatgtattgggtgagcaatgcttcaggcaacatagtctccagtgtgaatatgatcagccgcatgcttattaacagatttaccatgaggcacaagaaagcaacatacgaaccagacgttgatctgggctctgggactcgaaatatcggaattgagtccgagacccccaacctagacatcataggtaagcggattgaaaaaatcaagcaggagcatgaaacatcatggcactatgatcaggaccatccttacaagacttgggcctatcacggcagctacgagaccaaacaaacagggtcggcttctagtatggtgaatggagtcgtgcgtctcctgaccaagccatgggacgtaatccccatggtgactcagatggccatgacggatacaaccccgttcggccagcagagagtttttaaagaaaaggtcgacactcgcacccaagagcctaaagagggtacaaagaagttgatgaaaattacggcagaatggctgtggaaggagctcgggaaaaagaaaacccccaggatgtgtactcgggaagagttcacaagaaaggtgcgctccaacgccgctcttggagcgatatttaccgatgagaataaatggaagagcgccagggaagcagtggaggactcaggcttctgggaactggtcgataaggagcgaaacttacacctggaaggcaaatgcgagacttgtgtttataatatgatggggaagcgggagaaaaagttgggagaatttggtaaagctaagggctccagagccatctggtacatgtggctcggggcaaggttcctggagtttgaagccctaggattccttaacgaggaccattggttttctcgcgaaaatagcctgagtggcgtggagggtgaggggctccacaagctgggatacattttgcgtgatgtatccaaaaaggaaggcggcgctatgtatgccgacgatacagcggggtgggacacccggatcacactggaggatctcaaaaacgaagagatggtgactaatcatatggaaggagagcacaagaaacttgcagaggccattttcaagctgacctaccagaacaaggtcgtgagagttcagaggccaacgcctcgcggtaccgtgatggacatcataagccgacgggaccagagaggctctgggcaagtcgtgacatatggattaaacactttcaccaatatggaagctcagctgatcaggcagatggagggcgaaggtgtatttaaatcaattcaacagttgacagttaaggaggagatcgccgtgaaaaactggctcattcgcgtcgggagagaacggctgagtaggatggcaatctccggagatgactgcgtggtgaagcccctagatgaccgtttcgctagcgcccttactgctctgaatgatatgggcaaagtccgaaaggacattcagcagtgggagccatctcgcggctggaacgattggacccaagttcccttttgctcgcatcacttccacgaactcataatgaaggacgggagagtgctggtagtgccttgtcggaatcaggatgagttgatcggaagggcccgcatttcacagggtgcaggctggagcttaagagaaacggcgtgcctggggaaatcctacgcccagatgtggagtctcatgtattttcatcggagggaccttcgactggctgccaacgcaatctgttctgctgtcccaagccactggatcccgacatcccgtaccacttggtcaattcatgccacacacgagtggatgaccactgaggatatgctaaccgtgtggaatagagtttggatacaagaaaacccctggatggaggacaagacacctgtggaaagttgggaggaaatcccatacctgggaaaacgcgaggatcagtggtgcggctctctcattggtttgacgagccgggcaacctgggccaagaatatccagactgcgattaaccaggtcaggtccctgatcgggaatgaggaatatacagactacatgccctcaatgaaaagattccgccgggaggaagaggaagctggagtgctttggtga

SEQ ID NO: 14336 - RNA, 9876 nt, synthetic construct
  misc_feature 1..9876: note = derived and/or modified CDS sequence (opt3) from DENV-2__KM279517__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagccccccaaagttggcctccgcaattcaaaaagcccacgaagagggcatctgtggtattaggtctgtgacacggctcgaaaacctgatgtggaagcagatcacccccgagttaaatcatatactgactgagaacgaagtaaaactaaccattatgacaggcgacatcaaggggattatgcaggctggaaaacgctcgctcagacctcagccaacggagctgaagtacagctggaaagcctggggcaaggcaaagatgctttccaccgaattgcacaatcatactttcctgatcgatgggccggagacagcggaatgccccaacaccaatagggcttggaactcactcgaggtcgaggactatggatttggcgtgttcacaactaatatatggctgaaattaaaggaacgtcaagatgttttttgtgacagtaaactgatgtctgccgcaatcaaggacaaccgggccgtgcacgctgatatgggttactggattgagagcgcccttaacgacacctggaaaatcgaaaaggcatccttcattgaggtcaagtcatgccactggcctaaaagccatacgttgtggtctaatggggtgctcgagtccgaaatgatcataccaaagaacttcgctggacccgttagtcagcacaattatcgacctggctaccatacacagaccgccggtccatggcacctgggcagactagagatggattttgacttctgtgaagggactaccgtggtagtcacagaggattgcggaaacaggggccccagcctgcgcactaccacagcgtctgggaaactcattacggaatggtgctgtcggtcctgcaccctgccgcctcttagatacaggggagaggacggctgttggtatggtatggagatccgcccattgaaggaaaaagaggaaaatctggtgaactcattagtgactgccgggcatggacagatcgataattttagtctcggcgtcctgggtatggctcttttcctggaggaaatgttgcgaacacgggttggcaccaagcacgcaattctcctggtggccgtaagctttgtgactctaatcacagggaacatgtcgttccgtgacctgggaagagtcatggtgatggttggcgctaccatgacggatgacattgggatgggagtgacttacctcgccctgcttgcagcgtttaaggtcaggcccaccttcgccgctggcttgctgttacgcaaactcacatccaaggagctgatgatgaccactataggtatcgtgcttctgtctcaaagcacaattcctgagtcaatcctagaactcaccgatgccctggcattggggatgatggttctgaaaattgtgcggaatatggagaagtatcagttagctgtcacaatcatggccatactctgcgtacccaacgcagtgatcctgcagaatgcctggaaagttagttgtactacccttgctgtggtctccgtgtctccactgttgctcacgagctcccaacagaaggcggactggattcctctggccctaacaatcaagggactgaaccccaccgcaatttttcttactaccctctcaagaacaagcaaaaagaggagttggccactgaatgaagctatcatggccgtaggcatggtgtctatattggcctccagcctgttaaaaaacgatattccgatgactggccctctcgtcgctgggggactgcttaccgtttgctacgtgctgacgggtcgatcggcagacttggagctcgaacgcgccgcggacgtgcggtgggaggagcaggctgaaatctcaggctctagtcccatcctgtccattacaataagcgaggatgggtctatgagcatcaagaatgaagaggaggaacagaccctaactattctgatcagaacaggacttctcgtcatttccggcctgttcccagtgtcaatccccataaccgccgcagcctggtatttgtgggaggttaaaaagcaaagggctggtgtattatgggacgtgcctagtccaccccctgtcgggaaagcagaactggaggatggagcctaccgtatcaagcagaagggcattctcggctatagccagatcggggcgggagtgtacaaagaaggtacttttcacacaatgtggcatgttacccgcggcgctgtgctgatgcacaaggggaaacggattgagccgtcttgggccgacgtcaagaaagatcttatctcctacggaggcggttggaagctggagggggaatggaaggagggagaagaggtgcaggtattggcactagaaccaggcaaaaaccccagagccgtccaaacgaagcctggcctgttcaaaactaacaccgggacaataggagctgtgtcactcgactttagtccaggtaccagcggctcccccattgttgataagaaagggaaggtggtcggactgtatggcaatggtgtggttacaaggtctgggacttacgtgtcggccatcgcacagaccgagaagagcatcgaggacaaccctgaaattgaggatgacatcttccgaaaaaagcggcttacgataatggatttacatccgggagctggcaaaacaaagcgctatctgcccgccattgtcagagaagcgatcaaaaggggcctccggactttgattctggccccaacccgagtggtagcagctgagatggaagaggccctcagagggctgcctatccgctaccagacacccgctataagggcagagcacaccggacgtgaaattgtggaccttatgtgtcatgccactttcaccatgcggctgttgtcaccaatcagagttcctaattataacctaatcattatggatgaggcccactttacagaccccgcttccatcgcggcaaggggttacattagtacgcgcgtcgaaatgggcgaggccgctgggatattcatgactgccaccccaccgggatctcgagacccttttccccagagcaatgcaccaatcatggatgaggaaagagagattcccgaacggtcctggaactcaggccacgagtgggtgacagacttcaagggtaagaccgtgtggtttgtcccttctatcaaagccgggaatgatatcgctgcgtgcctgaggaagaacggaaaaaaggtaattcaactcagccgcaaaactttcgacagtgaatatataaagacacgtaccaatgattgggactttgtggttacgactgatatctccgagatgggcgccaacttcaaggcagagagagtgattgacccacggaggtgtatgaaacccgtcatcttaacagatggcgaagagcgcgtgattctggctgggcctatgccggttacccatagctctgccgcacagcgaagaggacgggtgggtaggaatccaaagaacgaaaatgaccagtacatctacatgggcgagccccttgaaaacgatgaggactgcgcccactggaaagaggctaagatgctgctcgacaatataaacacccctgaagggatcattccctcaatgtttgagccagaacgcgagaaagtcgatgccatcgacggagaatatagattgaggggcgaggcgcggaagactttcgtggatctgatgcgtcgcggtgacctccctgtatggctggcataccgagtggccgctgaggggattaactatgccgatagaaggtggtgttttgacggcgttaaaaataaccaaatccttgaagagaatgtcgaagtggagatatggacaaaggagggagaacggaagaaactaaagccccgctggctggatgctagaatttactccgacccattggcattaaaagagttcaaggaattcgccgctggcaggaaaagtctgaccctcaacctgatcacagagatggggcggcttcctacttttatgacgcagaaggccaagaatgcactggataacctcgcggtgttgcataccgccgaagctggaggtcgagcctataatcacgcactgagcgagctaccggagacactggaaactctccttctgttaaccttgctggctacagtcaccggcgggattttcctctttctgatgtcgggaaaaggcatcggtaagatgactcttgggatgtgctgcataatcacggcctctattctgctctggtacgcacagatccagccccactggattgccgcttccatcatattggagttctttctgattgttttactaatcccagaacctgagaaacaaagaaccccccaggacaaccagctgacatatgtggtaatcgcgattctcactgtggtcgccgcaaccatggctaatgaaatgggcttccttgagaagacaaaaaaggattttggactgggcagcatcaccactcagcaaccagagtcaaacatattggacattgatctgcgccctgccagtgcctggacactctacgcagtggctacgaccttcatcactcccatgctgaggcattctattgaaaattccagcgttaacgtgtcacttacagccatcgcgaatcaggctaccgtcctcatggggctgggaaagggttggccgttgagtaaaatggacataggcgtaccactgttagccatcgggtgttacagccaggtgaaccctattaccctaacagcagccctgctccttctggttgctcactatgcaatcattggacccggcttgcaggccaaggcgactcgggaggctcaaaaacgtgccgcagccggtatcatgaagaatccaacggtggacgggatgaccgtcattgatctggaccccatcccttacgatccgaaatttgaaaagcagctcggccaggtgatgctgcttgtcttatgcgtgacacaggttctgatgatgagaactacctgggctctctgtgaggccttgacactggcaaccggacccatatccactctatgggaaggcaacccagggaggttctggaatacgacaattgctgtgtctatggccaacatctttcgcggaagctatctggcgggcgccggtctccttttctccatcatgaagaacaccgcaaatactcggcgagggaccggaaacacaggcgagactctgggtgagaaatggaagaatagattgaacgctctgggcaaatcagaatttcaaatttacaagaaatctgggatacaggaggtagacaggaccctcgccaaggaaggaatcaaacgcggcgagacagatcatcacgcagtgagtcgggggtcggctaagctgagatggttcgtcgagcgtaatttagttacgcctgaaggaaaggtggtcgaccttggctgcggtagggggggatggagctattactgtggcggtctgaaaaacgtgaaggaggtaaaaggcctcaccaaggggggacccggccatgaagagcctattccaatgtccacttatgggtggaatctagtgcggctgcagtctggagttgatgtgttctttacaccccctgaaaaatgcgacaccttgctgtgtgatatcggcgagtcaagcccaaaccccactgtcgaggccggtcgcacactccgagtgcttaatctggtcgaaaactggttgaataacaatacccaattctgcattaaggtgctgaacccgtacatgccttccgttatcgagaagatggaaacgctccagagaaaatacgggggagccttagtaaggaatccactgagtcggaactctacccacgagatgtattgggtgagcaacgcgtcaggcaatatagtctccagtgtgaacatgatcagccgcatgcttattaatagatttacaatgaggcacaagaaagctacttacgaacccgacgttgatctgggctctgggacccgaaacatcggaattgagtccgagacacctaatctagacatcataggtaagcggattgaaaaaatcaagcaggagcatgaaacttcatggcactatgatcaggaccatccatacaagacctgggcatatcacggcagctacgagacaaaacaaaccgggtcggcctctagtatggtgaacggagtcgtgcgtctcctgactaagccctgggacgtaatcccgatggtgacgcagatggctatgacagataccactcctttcggccagcagagagtttttaaagaaaaggtcgacacccgcacacaagagcccaaagagggtacgaagaagttgatgaaaattaccgccgaatggctgtggaaggagctcgggaaaaagaaaactccaaggatgtgtacacgggaagagttcaccagaaaggtgcgctccaatgcagcccttggagctatatttactgatgagaacaaatggaagagcgcgagggaagccgtggaggactcaggcttctgggaactggtcgataaggagcgaaatttacacctggaaggcaaatgcgagacatgtgtttataacatgatggggaagcgggagaaaaagttgggagaatttggtaaagcaaagggctccagagctatctggtacatgtggctcggggccaggttcctggagtttgaagcactaggattccttaatgaggaccattggttttctcgcgaaaacagcctgagtggcgtggagggtgaggggctccacaagctgggatacattttgcgtgatgtatccaaaaaggaaggcggcgccatgtatgctgacgataccgccgggtgggacacacggatcactctggaggatctcaaaaatgaagagatggtgaccaaccatatggaaggagagcacaagaaacttgcggaggcaattttcaagctgacgtaccagaataaggtcgtgagagttcagaggcctaccccccgcggtacagtgatggacatcataagccgacgggaccagagaggctctgggcaagtcgtgacttatggattaaacaccttcacaaacatggaagcccagctgatcaggcagatggagggcgaaggtgtatttaaatcaattcaacagttgactgttaaggaggagatcgctgtgaaaaattggctcattcgcgtcgggagagaacggctgagtaggatggccatctccggagatgactgcgtggtgaagccactagatgaccgtttcgcaagcgctcttaccgccctgaacgatatgggcaaagtccgaaaggacattcagcagtgggagccctctcgcggctggaatgattggacgcaagttcctttttgctcgcatcacttccacgaactcataatgaaggacgggagagtgctggtagtgccatgtcggaaccaggatgagttgatcggaagggctcgcatttcacagggtgccggctggagcttaagagaaacagcatgcctggggaaatcctacgcgcagatgtggagtctcatgtattttcatcggagggaccttcgactggccgctaatgccatctgttctgcagtcccgagccactggatccccacctcccgtactacatggtcaattcatgctacccacgagtggatgactaccgaggatatgctaacagtgtggaacagagtttggatacaagaaaatccttggatggaggacaagacgccagtggaaagttgggaggaaatcccctacctgggaaaacgcgaggatcagtggtgcggctctctcattggtttgaccagccgggccacttgggcaaagaacatccagacagccattaatcaggtcaggtccctgatcgggaacgaggaatataccgactacatgccttcaatgaaaagattccgccgggaggaagaggaagcgggagtgctttggtga

SEQ ID NO: 14337 - RNA, 9876 nt, synthetic construct
  misc_feature 1..9876: note = derived and/or modified CDS sequence (opt3) from DENV-2__KM279518__SS-prME
  source 1..9876: mol_type = other RNA
accgccggaatcattataatgatgatccccacagtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgttgcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgaggtgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcagcctcagaccccagcctacggagctgaagtactcctggaaagcctggggcaaggcaaagatgctttcaaccgaattgcacaatcatactttcctgatcgatgggccagagacagcggaatgcccgaacaccaatagggcttggaacagtctcgaggtcgaggactatggatttggcgtgttcacaactaatatatggctgaaattaaaggaacgtcaagatgtattttgtgactctaaactgatgagcgccgcaatcaaggacaaccgggccgtgcacgctgatatgggttactggattgagtccgcccttaacgacacctggaaaatcgaaaaggcatcattcattgaggtcaagagctgccactggcccaaatctcatacgttgtggtccaatggggtgctcgagagtgaaatgatcatacctaagaacttcgctggaccagttagccagcacaattatcgacccggctaccatacacagaccgccggtccttggcacctgggcagactagagatggattttgacttctgtgaagggactaccgtggtagtcacagaggattgcggaaacaggggcccatctctgcgcactaccacagcgtccgggaaactcattacggaatggtgctgtcggtcatgcaccctgcccccgcttagatacaggggagaggacggctgttggtatggtatggagatccgccctttgaaggaaaaagaggaaaatctggtgaacagtttagtgactgccgggcatggacagatcgataattttagcctcggcgtcctgggtatggctcttttcctggaggaaatgttgcgaacacgggttggcaccaagcacgcaattctcctggtggccgtatcgtttgtgactctaatcacagggaacatgtccttccgtgacctgggaagagtcatggtgatggttggcgctaccatgacggatgacattgggatgggagtgacttacctcgccctgcttgcagcgtttaaggtcaggccaaccttcgccgctggcttgctgttacgcaaactcacatctaaggagctgatgatgaccactataggtatcgtgcttctgagccaatcaacaattcccgagagtatcctagaactcaccgatgccctggcattggggatgatggttctgaaaattgtgcggaatatggagaagtatcagttagctgtcacaatcatggccatactctgcgtacctaacgcagtgatcctgcagaatgcctggaaagtttcctgtactacccttgctgtggtctctgtgagccccctgttgctcacgtcctcacaacagaaggcggactggattccactggccctaacaatcaagggactgaaccctaccgcaatttttcttactaccctcagcagaacaagtaaaaagaggtcttggcccctgaatgaagctatcatggccgtaggcatggtgtccatattggccagctcgctgctaaagaacgatattccaatgactggcccgctcgtcgctgggggactgcttaccgtttgctacgtgctgacgggtcgatcagcagacttggagctcgaacgcgccgcggacgtgcggtgggaggagcaggctgaaatctctggcagttcccctatcctgagcattacaatatctgaggatgggagcatgtccatcaagaatgaagaggaggaacagaccctaactattctgatcagaacaggacttctcgtcatttcaggcctgttccccgtgagtatcccaataaccgccgcagcctggtatttgtgggaggttaaaaagcaaagggctggtgtattatgggacgtgcccagccctccacccgtcgggaaagcagaactggaggatggagcctaccgtatcaagcagaagggcattctcggctattctcagatcggggcgggagtgtacaaagaaggtacttttcacacaatgtggcatgttacccgcggcgctgtgctgatgcacaaggggaaacggattgagccttcctgggccgacgtcaagaaagatcttatctcatacggaggcggttggaagctggagggggaatggaaggagggagaagaggtgcaggtattggcactagaaccgggcaaaaacccaagagccgtccaaacgaagcccggcctgttcaaaactaacaccgggacaataggagctgtgagtctcgactttagccctggtacctccggctctccaattgttgataagaaagggaaggtggtcggactgtatggcaatggtgtggttacaaggtcggggacttacgtgagcgccatcgcacagaccgagaagtcaatcgaggacaaccccgaaattgaggatgacatcttccggaaaaagagacttacgataatggatttacatcctggagctggcaaaacaaagcgctatctgccggccattgtcagagaagcgatcaaaaggggcctccggactttgattctggcccccacccgagtggtagcagctgagatggaagaggccctcagagggctgccaatccgctaccagacccctgctataagggcagagcacaccggacgtgaaattgtggaccttatgtgtcatgccactttcaccatgcggctgttgtcccccatcagagttccaaattataacctaatcattatggatgaggcccactttacagaccctgctagtatcgcggcaaggggttacatttctacgcgcgtcgaaatgggcgaggccgctgggatattcatgactgccacacccccaggaagccgagacccgtttcctcagtccaatgcacccatcatggatgaggaaagagagattccagaacggtcatggaactctggccacgagtgggtgacagacttcaagggtaagaccgtgtggtttgtccccagcatcaaagccgggaatgatatcgctgcgtgcctgaggaagaacggcaaaaaggtaattcaactcagtcgcaaaactttcgactccgaatatataaagacacgtaccaatgattgggactttgtggttacgactgatatcagcgagatgggcgccaacttcaaggcagagagagtgattgaccctcggaggtgtatgaaaccagtcatcttaacagatggcgaagaacgcgtgattctggctgggcccatgcctgttacccattcttcagccgcacagcgaagaggacgggtgggtaggaatccgaagaacgaaaatgaccagtacatctacatgggcgagccacttgaaaacgatgaggactgcgcccactggaaagaggctaagatgctgctcgacaatataaacacccccgaagggatcattccttccatgtttgagcccgaacgcgagaaagtcgatgccatcgacggagaatatagattgaggggcgaggcgcggaagactttcgtggatctgatgcgtcgcggtgacctcccagtatggctggcataccgagtggccgctgaggggattaactatgccgatagaaggtggtgttttgacggcgttaaaaataaccaaatccttgaagagaatgtcgaagtggagatatggacaaaggagggagaacggaagaaactaaagcctcgctggctggatgctagaatttacagtgaccccttggcattaaaagagttcaaggagttcgccgctggcaggaaaagcctgaccctcaacctgatcacagagatggggcggcttccaacttttatgacgcagaaggccaagaatgcactggataacctcgcggtgttgcataccgccgaagctggaggtcgagcctataatcacgcactgtcggagctacctgagacactggaaactctccttctgttaaccttgctggctacagtcaccggcgggattttcctctttctgatgtctggaaaaggcatcggtaagatgactcttgggatgtgctgcataatcacggcctccattctgctctggtacgcacagatccagccgcactggattgccgctagcatcatattggagttctttctgattgttttactaatccccgaaccagagaaacaaagaacccctcaggacaaccagctgacatatgtggtaatcgcgattctcactgtggtcgccgcaaccatggctaatgaaatgggcttccttgagaagaccaaaaaggattttggactgggctcaatcaccactcagcaacccgagagtaacatattggacattgatctgcgcccagcctctgcctggacactctacgcagtggctacgaccttcatcactcctatgctgaggcattccattgaaaatagctcagttaacgtgagtcttacagccatcgcgaatcaggctaccgtcctcatggggctgggaaagggttggcccttgagcaaaatggacataggcgtaccgctgttagccatcgggtgttactcccaggtgaacccaattaccctaacagcagccctgctccttctggttgctcactatgcaatcattggacctggcttgcaggccaaggcgactcgggaggctcaaaaacgtgccgcagccggtatcatgaagaatcccacggtggacgggatgaccgtcattgatctggacccaatcccctacgatcctaaatttgaaaagcagctcggccaggtgatgctgcttgtcttatgcgtgacacaggttctgatgatgagaactacctgggctctctgtgaggccttgacactggcaaccggaccgatatctactctatgggaaggcaaccccgggaggttctggaatacgacaattgctgtgagcatggccaacatctttcgcggatcctatctggcgggcgccggtctccttttctcaatcatgaagaacaccgcaaatactcggcgagggaccggaaacacaggcgagactctgggtgagaaatggaagaatagattgaacgctctgggcaaatctgaatttcaaatttacaagaaaagtgggatacaggaggtagacaggaccctcgccaaggaaggaatcaaacgcggcgagacagatcatcacgcagtgtcgcgggggagcgctaagctgagatggttcgtcgagcgtaatttagttacgccagaaggaaaggtggtcgaccttggctgcggtagagggggatggtcctattactgtggcggtctgaaaaacgtgaaggaggtaaaaggcctcaccaaagggggacctggccatgaagaacccattcctatgtctacttatgggtggaatctagtgcggctgcagtcaggagttgatgtgttctttacaccacccgaaaaatgcgacaccttgctgtgtgatatcggcgagagctcccctaacccaactgtcgaggccggtcgcacactccgagtgcttaatctggtcgaaaactggttgaataacaatacccaattctgcattaaggtgctgaacccctacatgccgagtgttatcgagaagatggaagccctccagagaaaatacgggggagcgttagtaaggaatcctctgtctcggaacagcacgcacgagatgtattgggtgtcaaacgcttccggcaatatagtcagtagcgtgaacatgatctctcgcatgcttattaatagatttaccatgaggcacaagaaagcaacatacgaaccagacgttgatctgggctccgggactcgaaacatcggaattgagtcagagacccccaatctagacatcataggtaagcggattgagaaaatcaagcaggagcatgaaacaagctggcactatgatcaggaccatccttacaagacttgggcctatcacggctcgtacgagaccaaacaaacagggtctgctagttccatggtgaacggagtcgtgcgtctcctgaccaagccatgggacgtaatccccatggtgactcagatggccatgacggatacaaccccgttcggccagcagagagtttttaaagaaaaggtcgacactcgcacccaagagcctaaagagggtacaaagaagttgatgaaaattacggcagaatggctgtggaaggagctcgggaaaaagaaaacccccaggatgtgtactcgggaagagttcacaagaaaggtgcgcagcaatgccgctcttggagcgatatttaccgatgagaacaaatggaagtcagccagggaagcagtggaggactccggcttctgggaactggtcgataaggagcgaaatttacacctggaaggcaaatgcgagacttgtgtttataacatgatggggaagcgggagaaaaagttgggagaatttggtaaagctaagggctctagagccatctggtacatgtggctcggggcaaggttcctggagtttgaagccctaggattccttaatgaggaccattggtttagccgcgaaaacagtctgtccggcgtggagggtgaggggctccacaagctgggatacattttgcgtgatgtaagcaaaaaggaaggcggcgctatgtatgccgacgatacagcggggtgggacacccggatcacactggaggatctcaaaaatgaagagatggtgactaaccatatggaaggagagcacaagaaacttgcagaggccattttcaagctgacctaccagaataaggtcgtgagagttcagaggcagacgccacgcggtaccgtgatggacatcatatctcgacgggaccaaagaggctcagggcaggtcgtgacatatggattaaacactttcaccaacatggaagctcagctgatcaggcaaatggagggcgaaggtgtatttaaaagtattcagcagttgacagttaaggaggagatcgccgtgaaaaattggctcattcgcgtcgggagagaacggctgtccaggatggcaatcagcggagatgactgcgtggtgaagcctctagatgaccgtttcgcttctgcccttactgctctgaacgatatgggcaaagtccgaaaggacattcagcaatgggagccctcgcgcggctggaatgattggacccaggttccattttgctcacatcacttccacgaactcataatgaaggacgggagagtgctggtagtgccctgtcggaaccaggatgagttgatcggaagggcccgcattagccagggtgcaggctggtccttaagagaaacggcgtgcctggggaaaagttacgcccaaatgtggtctctcatgtattttcatcggagggaccttcgactggctgccaatgcaatctgtagcgctgtcccttcccactggatcccaacatcacgtaccacttggagtattcatgccacacacgagtggatgaccactgaggatatgctaaccgtgtggaacagagtttggatacaggaaaatccgtggatggaggacaagacacccgtggaatcttgggaggaaatcccttacctgggaaaacgcgaggatcagtggtgcggcagcctcattggtttgacgtcccgggcaacctgggccaagaacatccagactgcgattaatcaagtcaggtcactgatcgggaacgaggaatatacagactacatgccaagcatgaaaagattccgccgggaggaagaggaagctggagtgctttggtga

SEQ ID NO: 14338 - RNA, 9876 nt, synthetic construct
  misc_feature 1..9876: note = derived and/or modified CDS sequence (opt3) from DENV-2__KM279519__SS-prME
  source 1..9876: mol_type = other RNA
accgccggcatcattataatgatgatccccaccgtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgttgcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcagcctcagaccccagcctacggagctgaagtactcctggaaagcctggggcaaggcaaagatgctttcaaccgaattgcacaatcatactttcctgatcgatgggccagagacagcggaatgcccgaacaccaatagggcttggaacagtctcgaggtcgaggactatggatttggcgtgttcacaactaatatatggctgaaattaaaggaacgtcaagatgtattttgtgactctaaactgatgagcgccgcaatcaaggacaaccgggccgtgcacgctgatatgggttactggattgagtccgcccttaacgacacctggaaaatcgaaaaggcatcattcattgaggtcaagagctgccactggcccaaatctcatacgttgtggtccaatggggtgctcgagagtgaaatgatcatacctaagaacttcgctggaccagttagccagcacaattatcgacccggctaccatacacagaccgccggtccttggcacctgggcagactagagatggattttgacttctgtgaagggactaccgtggtagtcacagaggattgcggaaacaggggcccatctctgcgcactaccacagcgtccgggaaactcattacggaatggtgctgtcggtcatgcaccctgcccccgcttagatacaggggagaggacggctgttggtatggtatggagatccgccctttgaaggaaaaagaggaaaatctggtgaacagtttagtgactgccgggcatggacagatcgataattttagcctcggcgtcctgggtatggctcttttcctggaggaaatgttgcgaacacgggttggcaccaagcacgcaattctcctggtggccgtatcgtttgtgactctaatcacagggaacatgtccttccgtgacctgggaagagtcatggtgatggttggcgctaccatgacggatgacattgggatgggagtgacttacctcgccctgcttgcagcgtttaaggtcaggccaaccttcgccgctggcttgctgttacgcaaactcacatctaaggagctgatgatgaccactataggtatcgtgcttctgagccaatcaacaattcccgagagtatcctagaactcaccgatgccctggcattggggatgatggttctgaaaattgtgcggaatatggagaagtatcagttagctgtcacaatcatggccatactctgcgtacctaacgcagtgatcctgcagaatgcctggaaagtttcctgtactacccttgctgtggtctctgtgagccccctgttgctcacgtcctcacaacagaaggcggactggattccactggccctaacaatcaagggactgaaccctaccgcaatttttcttactaccctcagcagaacaagtaaaaagaggtcttggcccctgaatgaagctatcatggccgtaggcatggtgtccatattggccagctcgctgctaaagaacgatattccaatgactggcccgctcgtcgctgggggactgcttaccgtttgctacgtgctgacgggtcgatcagcagacttggagctcgaacgcgccgcggacgtgcggtgggaggagcaggctgaaatctctggcagttcccctatcctgagcattacaatatctgaggatgggagcatgtccatcaagaatgaagaggaggaacagaccctaactattctgatcagaacaggacttctcgtcatttcaggcctgttccccgtgagtatcccaataaccgccgcagcctggtatttgtgggaggttaaaaagcaaagggctggtgtattatgggacgtgcccagccctccacccgtcgggaaagcagaactggaggatggagcctaccgtatcaagcagaagggcattctcggctattctcagatcggggcgggagtgtacaaagaaggtacttttcacacaatgtggcatgttacccgcggcgctgtgctgatgcacaaggggaaacggattgagccttcctgggccgacgtcaagaaagatcttatctcatacggaggcggttggaagctggagggggaatggaaggagggagaagaggtgcaggtattggcactagaaccgggcaaaaacccaagagccgtccaaacgaagcccggcctgttcaaaactaacaccgggacaataggagctgtgagtctcgactttagccctggtacctccggctctccaattgttgataagaaagggaaggtggtcggactgtatggcaatggtgtggttacaaggtcggggacttacgtgagcgccatcgcacagaccgagaagtcaatcgaggacaaccccgaaattgaggatgacatcttccggaaaaagagacttacgataatggatttacatcctggagctggcaaaacaaagcgctatctgccggccattgtcagagaagcgatcaaaaggggcctccggactttgattctggcccccacccgagtggtagcagctgagatggaagaggccctcagagggctgccaatccgctaccagacccctgctataagggcagagcacaccggacgtgaaattgtggaccttatgtgtcatgccactttcaccatgcggctgttgtcccccatcagagttccaaattataacctaatcattatggatgaggcccactttacagaccctgctagtatcgcggcaaggggttacatttctacgcgcgtcgaaatgggcgaggccgctgggatattcatgactgccacacccccaggaagccgagacccgtttcctcagtccaatgcacccatcatggatgaggaaaaggagattccagaaagatcatggaactctggccacgagtgggtgacagacttcaagggtaaaaccgtgtggtttgtccccagcatcaaggccgggaatgatatcgctgcgtgcctgcggaaaaacggaaagaaagtaattcaactcagtaggaagactttcgactccgaatatataaagacacgcaccaatgattgggactttgtggttacgactgatatcagcgagatgggcgccaacttcaaagcagagcgtgtgattgaccctagacggtgtatgaagccagtcatcttaacagatggcgaagagagggtgattctggctgggcccatgcctgttacccattcttcagccgcacagcgccgaggaagagtgggtcggaatccgaaaaacgaaaatgaccagtacatctacatgggcgagccacttgaaaacgatgaggactgcgcccactggaaggaggctaaaatgctgctcgacaatataaacacccccgaagggatcattccttccatgtttgagcccgaaagggagaaggtcgatgccatcgacggagaatatcgcttgagaggcgaggcgaggaaaactttcgtggatctgatgcggcgtggtgacctcccagtatggctggcataccgcgtggccgctgaggggattaactatgccgatcgaagatggtgttttgacggcgttaagaataaccaaatccttgaagagaatgtcgaagtggagatatggacaaaggagggagaaaggaaaaagctaaaacctcggtggctggatgctcgcatttacagtgaccccttggcattaaaggagttcaaagagttcgccgctggcagaaagagcctgaccctcaacctgatcacagagatggggaggcttccaacttttatgacgcagaaggccaaaaatgcactggataacctcgcggtgttgcataccgccgaagctggaggtcgggcctataatcacgcactgtcggagctacctgagacactggaaactctccttctgttaaccttgctggctacagtcaccggcgggattttcctctttctgatgtctggaaagggcatcggtaaaatgactcttgggatgtgctgcataatcacggcctccattctgctctggtacgcacagatccagccgcactggattgccgctagcatcatattggagttctttctgattgttttactaatccccgaaccagagaagcaacgaacccctcaggacaaccagctgacatatgtggtaatcgcgattctcactgtggtcgccgcaaccatggctaatgaaatgggcttccttgagaaaacaaagaaggattttggactgggctcaatcaccactcagcaacccgagagtaacatattggacattgatctgagaccagcctctgcctggacactctacgcagtggctacgaccttcatcactcctatgctgcgccattccattgaaaatagctcagttaacgtgagtcttacagccatcgcgaatcaggctaccgtcctcatggggctgggaaaaggttggcccttgagcaagatggacataggcgtaccgctgttagccatcgggtgttactcccaggtgaacccaattaccctaacagcagccctgctccttctggttgctcactatgcaatcattggacctggcttgcaggccaaagcgactagggaggctcaaaagcgggccgcagccggtatcatgaaaaatcccacggtggacgggatgaccgtcattgatctggacccaatcccctacgatcctaagtttgaaaagcagctcggccaggtgatgctgcttgtcttatgcgtgacacaggttctgatgatgcgtactacctgggctctctgtgaggccttgacactggcaaccggaccgatatctactctatgggaaggcaaccccgggagattctggaatacgacaattgctgtgagcatggccaacatctttaggggatcctatctggcgggcgccggtctccttttctcaatcatgaaaaacaccgcaaatactcgccgggggaccggaaacacaggcgagactctgggtgagaagtggaaaaatcgattgaacgctctgggcaagtctgaatttcaaatttacaaaaagagtgggatacaggaggtagacagaaccctcgccaaagaaggaatcaagaggggcgagacagatcatcacgcagtgtcgcgcgggagcgctaagctgcggtggttcgtcgagagaaatttagttacgccagaaggaaaagtggtcgaccttggctgcggtcgtgggggatggtcctattactgtggcggtctgaagaacgtgaaagaggtaaagggcctcaccaaagggggacctggccatgaagaacccattcctatgtctacttatgggtggaatctagtgaggctgcagtcaggagttgatgtgttctttacaccacccgaaaagtgcgacaccttgctgtgtgatatcggcgagagctcccctaacccaactgtcgaggccggtcggacactccgcgtgcttaatctggtcgaaaactggttgaataacaatacccaattctgcattaaggtgctgaacccctacatgccgagtgttatcgagaaaatggaagccctccagcgaaagtacgggggagcgttagtaagaaatcctctgtctaggaacagcacgcacgagatgtattgggtgtcaaacgcttccggcaatatagtcagtagcgtgaacatgatctctcggatgcttattaatcgctttaccatgagacacaaaaaggcaacatacgaaccagacgttgatctgggctccgggactaggaacatcggaattgagtcagagacccccaatctagacatcataggtaaacgaattgaaaagatcaagcaggagcatgaaacaagctggcactatgatcaggaccatccttacaaaacttgggcctatcacggctcgtacgagaccaagcaaacagggtctgctagttccatggtgaacggagtcgtgcggctcctgaccaaaccatgggacgtaatccccatggtgactcagatggccatgacggatacaaccccgttcggccagcagcgtgtttttaaggaaaaagtcgacactagaacccaagagcctaaggagggtacaaagaaattgatgaagattacggcagaatggctgtggaaagagctcgggaagaaaaagacaccccgcatgtgtactagggaagagttcacacggaaagtgagaagcaatgccgctcttggagcgatatttaccgatgagaacaagtggaagtcagcccgcgaagcagtggaggactccggcttctgggaactggtcgataaagagaggaatttacacctggaaggcaagtgcgagacttgtgtttataacatgatggggaaacgagagaagaaattgggagaatttggtaaggctaagggctctcgggccatctggtacatgtggctcggggcaagattcctggagtttgaagccctaggattccttaatgaggaccattggtttagcagggaaaacagtctgtccggcgtggagggtgaggggctccacaaactgggatacattttgcgcgatgtaagcaagaaagaaggcggcgctatgtatgccgacgatacagcggggtgggacacccgtatcacactggaggatctcaagaatgaagagatggtgactaaccatatggaaggagagcacaagaaacttgcagaggccattttcaaactgacctaccagaataaagtcgtgcgggttcagagaccaacgcctaggggtaccgtgatggacatcatatctcgccgagaccagcggggctcagggcaagtcgtgacatatggattaaacactttcaccaacatggaagctcagctgatcagacagatggagggcgaaggtgtatttaagagtattcaacagttgacagttaaagaggagatcgccgtgaagaattggctcattagggtcgggcgcgaaagactgtcccggatggcaatcagcggagatgactgcgtggtgaaacccctagatgacaggttcgcttctgcccttactgctctgaacgatatgggcaaggtccgtaaggacattcagcagtgggagccatcgcgaggctggaatgattggacccaagttcccttttgctcacatcacttccacgaactcataatgaaagacgggcgcgtgctggccgtaccttgtagaaaccaggatgagttgatcggacgggcaaggattagccagggtgcgggctggtccttacgcgaaacggcctgcctggggaagagttacgctcagatgtggtctctcatgtattttcatagacgggaccttaggctggccgcaaatgctatctgtagcgccgtgccatcccactggatcccgacatcacgaaccacttggagtattcatgcaacacacgagtggatgaccactgaggatatgctaaccgtctggaaccgtgtgtggatacaagaaaatccctggatggaggacaaaacacctgttgaatcttgggaggaaatcccatacctgggaaagagagaggatcagtggtgcggcagcctcattggtttgacgtcccgcgccacctgggcgaaaaacatccagactgctattaatcaggtgcggtcactgatcgggaacgaggaatatacagactacatgcccagcatgaagaggttcagacgcgaggaagaggaagccggagtcctttggtga

SEQ ID NO: 14339 - RNA, 9876 nt, synthetic construct
  misc_feature 1..9876: note = derived and/or modified CDS sequence (opt3) from DENV-2__KM279520__SS-prME
  source 1..9876: mol_type = other RNA
accgcaggcatcattataatgatgatccccaccgtgatggctttccacctgactacgcggaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactcggaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctcggaataaacccacactcgacttcgaattaattaagaccgaggccaagcacctggcgacgcttcgcaaatactgcgtggaagcaaagttgaccaacacaactaccgcctcccgatgtcctacacagggggagccatctctgaatgaggaacaagataaaagatttgtctgcaagcatagcatggtggacaggggatggggcaacggttgtgggctattcggaaaaggcggcatcgtgacttgcgctatgtttacctgcaagaagaatatggaggggaaagtcgttcagcccgaaaacctcgagtatacaatcgtgattacccctcactccggagaagagaatgccgtaggtaacgatactggcaagcatgggaaagagataaaggtgacgccacagtcaagtatcacagaagcagagctgaccggatacggcactgtcaccatggaatgtagcccgcggacaggtcttgacttcaatgagatggtgctgttgcagatggaaaacaaggcttggctcgttcaccgtcaatggtttctggatttacccctgccttggctcccaggggccgacacccagggctctaactggattcagaaggagactcttgtgacattcaaaaatccccacgcgaagaagcaggatgtcgtggtactgggatcccaagagggcgccatgcatacggcattgaccggggctactgaaatccagatgtcaagcggaaacctactgtttacaggtcacctcaaatgccgcctgagaatggacaaacttcagctgaaaggcatgagttattctatgtgtaccgggaagttcaaagttgtgaaggagatagccgaaacacaacatggaactattgtcatcagggtgcagtacgagggcgacggttccccttgcaagatcccattcgagattatggatttggaaaaacggcacgctctcgggcgactgatcaccgtcaatcccattgtgacggagaaggacagcccggttaacatagaagccgagcctccctttggcgattcgtacatcattatcggagtggaaccaggccagttaaaactgtcttggttcaagaaagggtcctcaatcggacagatgtttgagaccacaatgcgcggtgcaaagagaatggccattctaggcgacactgcttgggatttcgggagtctcggaggcgtatttaccagcataggtaaggcgctgcatcaagtcttcggggcaatctatggcgccgctttttccggagtgtcttggacaatgaaaattcttatcggcgttgtgattacttggatcgggatgaatagcaggtcaaccagtttgtccgtcagcctggtgctcgtaggagtggttacgctgtaccttggcgtcatggtgcaggccgactctggttgtgtggtctcatggaagaacaaagagctgaagtgcgggagtggaatattcatcacagataatgttcacacctggactgaacagtataaatttcagcctgagagcccctccaagttggcatctgccattcaaaaggctcacgaagagggcatctgtggtattcggtcggtgacacgcctcgaaaacctgatgtggaaacagatcaccccagagttaaatcatatactgactgagaacgaagtgaagctaaccattatgacaggcgacatcaaagggattatgcaggccggaaagagaagcctcaggccccagcctacggagctgaaatactcctggaaggcatggggcaaagcgaagatgctttcaaccgaattgcacaatcatactttcctgatcgatgggccagagacagctgaatgcccgaacaccaatcgtgcctggaacagtctcgaggtagaggactatggatttggcgtcttcacaactaatatatggctgaagttaaaagaacggcaagatgtgttttgtgactctaagctgatgagcgcagccatcaaagacaaccgagctgttcacgccgatatgggttactggattgagtccgcacttaacgacacctggaagatcgaaaaggcttcattcattgaggtgaaaagctgccactggcccaagtctcatacgttgtggtccaatggggtcctcgagagtgaaatgatcatacctaaaaacttcgccggaccagtgagccagcacaattatagacccggctaccatacacagaccgcgggtccttggcacctgggcaggctagagatggattttgacttctgtgaagggactaccgttgtggtaacagaggattgcggaaaccgcggcccatctctgcggactaccacagcctccgggaagctcattacggaatggtgctgtagatcatgcaccctgcccccgcttaggtaccgcggagaggacggctgttggtatggtatggagatccgacctttgaaagaaaaggaggaaaatctggtcaacagtttagtgactgctgggcatggacagatcgataattttagcctcggcgtgctgggtatggcacttttcctggaggaaatgttgcggacacgtgtcggcaccaaacacgccattctcctggttgctgtgtcgtttgtaactctaatcacagggaacatgtccttcagagacctgggaagggtgatggtcatggtgggcgccaccatgacggatgacattgggatgggagttacttacctcgcactgcttgcggcctttaaggtgcgcccaaccttcgctgccggcttgctgttacggaagctcacatctaaagagctgatgatgaccactataggtatcgtccttctgagccaatcaacaattcccgagagtatcctagaactcaccgatgcactggctttggggatgatggtgctgaagattgttagaaatatggagaaatatcagttagccgtgacaatcatggcaatactctgcgtccctaacgccgtaatcctgcagaatgcttggaaggtgtcctgtactacccttgcggttgtgtctgtcagccccctgttgctcacgtcctcacaacagaaagccgactggattccactggcactaacaatcaagggactgaaccctaccgctatttttcttactaccctcagcaggacaagtaagaaacgatcttggcccctgaatgaagccatcatggccgtgggcatggtatccatattggctagctcgctgttaaagaacgatattccaatgactggcccgctcgtggcagggggactgcttaccgtctgctacgttctgacgggtcgctcagccgacttggagctcgaacgggcggctgacgtgagatgggaggagcaggccgaaatctctggcagttcccctatcctgagcattacaatatctgaggatgggagcatgtccatcaaaaatgaagaggaggaacagaccctaactattctgatcaggacaggacttctcgtgatttcaggcctgttccccgtcagtatcccaataaccgcagccgcttggtatttgtgggaggtgaagaaacaacgtgccggtgttttatgggacgtacccagccctccacccgtggggaaggccgaactggaggatggagcgtaccgcatcaaacagaagggcattctcggctattctcagatcggggctggagtctacaaggaaggtacttttcacacaatgtggcatgtgacccggggcgccgttctgatgcacaaagggaagagaattgagccttcctgggcagacgtgaaaaaggatcttatctcatacggaggcggttggaaactggagggggaatggaaggagggagaagaggtccaggtgttggccctagaaccgggcaagaacccaagggctgtacaaacgaaacccggcctgttcaagactaacaccgggacaataggagccgtcagtctcgactttagccctggtacctccggctctccaattgtggataaaaaggggaaagttgtgggactgtatggcaatggtgtcgtgacacgatcggggacttacgttagcgcaatcgctcagaccgagaagtcaatcgaggacaaccccgaaattgaggatgacatcttccggaagaaacgccttacgataatggatttacatcctggagccggcaagacaaaaagatatctgccggcgattgtgagggaagccatcaagcggggcctccgaactttgattctggcacccaccagagtcgtggctgccgagatggaagaggctctccgcgggctgccaatcaggtaccagacccctgcaatacgtgccgagcacaccggacgggaaattgtagaccttatgtgtcatgccactttcaccatgagactgttgtcccccatcagggtgccaaattataacctaatcattatggatgaggctcactttacagaccctgcgagtatcgcagcccgcggttacatttctacgcgagttgaaatgggcgaggctgccgggatattcatgactgcaacacccccaggaagcagagacccgtttcctcagtccaatgcccccatcatggatgaggaacgggagattccagaaaggtcatggaactctggccacgagtgggtcacagacttcaaaggtaagaccgtgtggtttgtgcccagcatcaaggctgggaatgatatcgcggcctgcctgcgcaaaaacggaaagaaagtcattcaactcagtcgtaagactttcgactccgaatatataaaaacaagaaccaatgattgggactttgtagtgacgactgatatcagcgagatgggcgcaaacttcaaggctgagcgggttattgaccctaggcgctgtatgaagccagtgatcttaacagatggcgaagaacgagtcattctggccgggcccatgcctgtgacccattcttcagcagcccagagacggggaagggttggtcgcaatccgaaaaacgaaaatgaccagtacatctacatgggcgagccacttgaaaacgatgaggactgcgctcactggaaggaggccaaaatgctgctcgacaatataaacacccccgaagggatcattccttccatgtttgagcccgaaagagagaaggtggatgcgatcgacggagaatataggttgcggggcgaggcacgtaaaactttcgtcgatctgatgcgccgaggtgacctcccagtgtggctggcctacagagtagctgccgaggggattaactatgctgataggcggtggtgttttgacggcgtgaagaataaccaaatccttgaagagaatgttgaagtcgagatatggacaaaagagggagaacgcaagaagctaaaacctagatggctggatgcaaggatttacagtgaccccttggccttaaaggagttcaaagagttcgctgccggcagaaagagcctgaccctcaacctgatcacagagatggggcgacttccaacttttatgacgcagaaagcaaagaatgcgctggataacctcgccgtgttgcataccgctgaagccggaggtagagcatataatcacgctctgtcggagctacctgagacactggaaactctccttctgttaaccttgctggccacagtgaccggcgggattttcctctttctgatgtctggaaagggcatcggtaaaatgactcttgggatgtgctgcataatcacggcatccattctgctctggtacgcccagatccagccgcactggattgctgcgagcatcatattggagttctttctgattgtcttactaatccccgaaccagagaagcaacgcacccctcaggacaaccagctgacatatgttgtgatcgccattctcactgtagtggcagctaccatggccaatgaaatgggcttccttgagaaaacaaagaaagattttggactgggctcaatcaccactcagcaacccgagagtaacatattggacattgatctgaggccagcctctgcatggacactctacgctgtcgccacgaccttcatcactcctatgctgcggcattccattgaaaatagctcagtgaacgttagtcttacagcgatcgctaatcaggccaccgtgctcatggggctgggaaagggttggcccttgagcaagatggacataggcgtcccgctgttagcaatcgggtgttactcccaggtaaacccaattaccctaacagccgctctgctccttctggtggcacactatgccatcattggacctggcttgcaggcgaaagctactcgtgaggcccaaaagagagcagccgctggtatcatgaaaaatcccacggttgacgggatgaccgtgattgatctggacccaatcccctacgatcctaagtttgaaaaacagctcggccaggtcatgctgcttgtgttatgcgtcacacaggtgctgatgatgaggactacctgggccctctgtgaggcattgacactggctaccggaccgatatctactctatgggaaggcaaccccgggcgcttctggaatacgacaattgccgttagcatggcgaacatctttcggggatcctatctggccggcgcaggtctccttttctcaatcatgaagaacaccgctaatactcgaagagggaccggaaacacaggcgagactctgggtgagaagtggaaaaataggttgaacgccctgggcaagtctgaatttcaaatttacaaaaagagtgggatacaggaggtggaccgcaccctcgcaaaagaaggaatcaagcggggcgagacagatcatcacgctgtatcgagagggagcgccaaactgcgttggttcgtggagaggaatttagtcacgccagaaggaaaggttgtggaccttggctgcggtagagggggatggtcctattactgtggcggtctgaagaacgtcaaagaggtgaagggcctcaccaaagggggacctggccatgaggaacccattcctatgtctacttatgggtggaatctagtacgcctgcagtcaggagtggatgttttctttacaccacccgaaaagtgcgacaccttgctgtgtgatatcggcgagagctcccctaacccaactgtggaggccggtcgaacactcagagtccttaatctggtggaaaactggttgaataacaatacccaattctgcattaaagtcctgaacccctacatgccgagtgtgatcgagaagatggaagcgctccagaggaagtacgggggagctttagttcggaatcctctgtctcgcaacagcacgcacgagatgtattgggtatcaaacgcatccggcaatatagtgagtagcgtcaacatgatctctagaatgcttattaataggtttaccatgcgacacaaaaaggccacatacgaaccagacgtggatctgggctccgggactcggaacatcggaattgagtcagagacccccaatctagacatcataggtaaacgtattgaaaagatcaaacaggagcatgaaacaagctggcactatgatcaggaccatccttacaagacttgggcttatcacggctcgtacgagaccaagcaaacagggtctgccagttccatggttaacggagtggtcagactcctgaccaaaccatgggacgtgatccccatggtaactcagatggcaatgacggatacaaccccgttcggccagcagcgcgtgtttaaggaaaaagttgacactaggacccaagagcctaaggagggtaccaagaagttgatgaagattacggccgaatggctgtggaaagagctcgggaagaaaaagacaccccggatgtgtactagagaagagttcacacgcaaagtcaggagcaatgctgcgcttggagccatatttaccgatgagaacaagtggaaatcagcacgagaagctgtggaggactccggcttctgggaactggtggataaggagcggaatttacacctggaaggcaagtgcgagacttgtgtctataacatgatggggaaaagagagaagaaattgggagaatttggtaaggccaaaggctctagggcaatctggtacatgtggctcggggcccgcttcctggagtttgaagctctaggattccttaatgaggaccattggtttagccgtgaaaacagtctgtccggcgttgagggtgaggggctccacaagctgggatacattttgcgggatgtgagcaagaaagaaggcggcgccatgtatgcggacgatacagcagggtgggacaccagaatcacactggaggatctcaagaatgaagagatggtaactaaccatatggaaggagagcacaagaaacttgccgaggctattttcaaactgacctaccagaataaagtggtcagggtgcagcgcccaacgcctcgaggtaccgttatggacatcatatctcggagagaccagaggggctcagggcaagtggtcacatatggattaaacactttcaccaacatggaagcccagctgatccgccagatggagggcgaaggtgtgtttaagagtattcaacagttgacagtaaaagaggagatcgcagttaagaattggctcattagagtggggcgggaaaggctgtcccgtatggctatcagcggagatgactgcgtcgtgaaacccctagatgaccgattcgcctctgctcttactgccctgaacgatatgggcaaggtgcgcaaagacattcagcagtgggagccatcgagaggctggaatgattggacccaagtccccttttgctcacatcacttccacgaactcataatgaaggacgggcgggttctggtggtaccttgtaggaaccaggatgagttgatcggacgcgcaagaattagccagggtgcgggctggtccttacgggaaacggcctgcctggggaagagttacgctcagatgtggtctctcatgtattttcataggcgagaccttcgtctggccgcaaatgctatctgtagcgccgtgccatcccactggatcccgacatcaagaaccacttggagtattcatgcaacacacgagtggatgaccactgaggatatgctaaccgtctggaaccgcgtgtggatacaagaaaatccctggatggaggacaaaacacctgttgaaacgtgggaggaaatcccatacctgggaaagcgggaggatcagtggtgcggctctctcattggtttgaccagcagggccacttgggcgaaaaacatccagacagctattaatcaggtgagatccctgatcgggaacgaggaatataccgactacatgccctcaatgaagcgcttccggagggaggaagaggaagccggagtcctttggtga

SEQ ID NO: 14340 - RNA, 9876 nt, synthetic construct
  misc_feature 1..9876: note = derived and/or modified CDS sequence (opt3) from DENV-2__KM279521__SS-prME
  source 1..9876: mol_type = other RNA
accgccggaatcattataatgatgatccccactgtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgttgcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgaggtgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcaccgtgaacatagaagctgagccgccttttggcgattcgtacatcattatcggagtagaacccggccagttaaagctgtcttggttcaaaaaggggtcctcaatcggacagatgtttgagacaactatgcgaggtgccaagcgcatggcaattctaggcgacaccgcctgggatttcgggagtctcggaggcgtctttacaagcataggtaaagctctgcatcaagtgttcggggcgatctatggcgcagccttttccggagtttcttggactatgaagattcttatcggcgtggtcattacctggatcgggatgaatagcagatcaacgagtttgtccgtgagcctggtactcgtgggagttgtcacactgtaccttggcgtgatggtgcaggctgactctggttgtgtcgtttcatggaaaaacaaggagctgaaatgcgggagtggaatattcatcaccgataatgtgcacacttggacagaacagtataagtttcagccagagagcccttccaagttggcctctgcaattcaaaaagcccacgaagagggcatctgtggtattaggtcggtgacccggctcgaaaacctgatgtggaagcagatcactcccgagttaaatcatatactgaccgagaacgaagtaaaactaacaattatgacgggcgacatcaaggggattatgcaggctggaaaacgcagcctcagaccacagcccaccgagctgaagtactcctggaaagcctggggcaaggcaaagatgctttcaactgaattgcacaatcatacattcctgatcgatgggcctgagaccgcggaatgcccaaacacaaatagggcttggaacagtctcgaggtcgaggactatggatttggcgtgttcactaccaatatatggctgaaattaaaggaacgtcaagatgtattttgtgactctaaactgatgagcgccgcaatcaaggacaaccgggccgtgcacgctgatatgggttactggattgagtccgcccttaacgacacgtggaaaatcgaaaaggcatcattcattgaggtcaagagctgccactggccgaaatctcatacattgtggtccaatggggtgctcgagagtgaaatgatcatacccaagaacttcgctggacctgttagccagcacaattatcgaccaggctaccatacccagactgccggtccctggcacctgggcagactagagatggattttgacttctgtgaagggaccacagtggtagtcactgaggattgcggaaacaggggcccttctctgcgcaccacaacggcgtccgggaaactcattaccgaatggtgctgtcggtcatgcactctgccaccccttagatacaggggagaggacggctgttggtatggtatggagatccgcccgttgaaggaaaaagaggaaaatctggtgaacagtttagtgacagccgggcatggacagatcgataattttagcctcggcgtcctgggtatggctcttttcctggaggaaatgttgcgaacccgggttggcactaagcacgcaattctcctggtggccgtatcgtttgtgacactaatcaccgggaacatgtccttccgtgacctgggaagagtcatggtgatggttggcgctacgatgactgatgacattgggatgggagtgacctacctcgccctgcttgcagcgtttaaggtcaggcctacattcgccgctggcttgctgttacgcaaactcacctctaaggagctgatgatgactacaataggtatcgtgcttctgagccaatcaaccattccagagagtatcctagaactcacagatgccctggcattggggatgatggttctgaaaattgtgcggaatatggagaagtatcagttagctgtcactatcatggccatactctgcgtacccaacgcagtgatcctgcagaatgcctggaaagtttcctgtaccacgcttgctgtggtctctgtgagccctctgttgctcacatcctcacaacagaaggcggactggattcccctggccctaaccatcaagggactgaacccaactgcaatttttcttaccacactcagcagaacaagcaaaaagaggtcttggcctctgaatgaagctatcatggccgtaggcatggtgtccatattggccagctcgctgctaaagaacgatattcccatgaccggcccactcgtcgctgggggactgcttacggtttgctacgtgctgacaggtcgatcagcagacttggagctcgaacgcgccgcggacgtgcggtgggaggagcaggctgaaatctctggcagttccccgatcctgagcattaccatatctgaggatgggagcatgtccatcaagaatgaagaggaggaacagactctaacaattctgatcagaaccggacttctcgtcatttcaggcctgttccctgtgagtatccccataactgccgcagcctggtatttgtgggaggttaaaaagcaaagggctggtgtattatgggacgtgccaagtccccctccagtcgggaaagcagaactggaggatggagcctaccgtatcaagcagaagggcattctcggctattctcagatcggggcgggagtgtacaaagaaggtacatttcacaccatgtggcatgttacgcgcggcgctgtgctgatgcacaaggggaaacggattgagccctcctgggccgacgtcaagaaagatcttatctcatacggaggcggttggaagctggagggggaatggaaggagggagaagaggtgcaggtattggcactagaacctggcaaaaacccgagagccgtccaaactaagccaggcctgttcaaaaccaacacagggaccataggagctgtgagtctcgactttagccccggtacatccggctctcctattgttgataagaaagggaaggtggtcggactgtatggcaatggtgtggttactaggtcggggacctacgtgagcgccatcgcacagacggagaagtcaatcgaggacaacccagaaattgaggatgacatcttccggaaaaagagacttacaataatggatttacatcccggagctggcaaaactaagcgctatctgcctgccattgtcagagaagcgatcaaaaggggcctccggaccttgattctggccccgacacgagtggtagcagctgagatggaagaggccctcagagggctgcccatccgctaccagaccccagctataagggcagagcacactggacgtgaaattgtggaccttatgtgtcatgccaccttcacaatgcggctgttgtcccctatcagagttcccaattataacctaatcattatggatgaggcccactttacggacccagctagtatcgcggcaaggggttacatttctactcgcgtcgaaatgggcgaggccgctgggatattcatgaccgccacacctcccggaagccgagacccatttccgcagtccaatgcacctatcatggatgaggaaagagagattcccgaacggtcatggaactctggccacgagtgggtgaccgacttcaagggtaagactgtgtggtttgtcccaagcatcaaagccgggaatgatatcgctgcgtgcctgaggaagaacggcaaaaaggtaattcaactcagtcgcaaaacattcgactccgaatatataaagacccgtacgaatgattgggactttgtggttactacagatatcagcgagatgggcgccaacttcaaggcagagagagtgattgacccccggaggtgtatgaaacctgtcatcttaaccgatggcgaagaacgcgtgattctggctgggccaatgcccgttacccattcttcagccgcacagcgaagaggacgggtgggtaggaatcctaagaacgaaaatgaccagtacatctacatgggcgagccgcttgaaaacgatgaggactgcgcccactggaaagaggctaagatgctgctcgacaatataaacactccagaagggatcattccctccatgtttgagcctgaacgcgagaaagtcgatgccatcgacggagaatatagattgaggggcgaggcgcggaagacattcgtggatctgatgcgtcgcggtgacctccccgtatggctggcataccgagtggccgctgaggggattaactatgccgatagaaggtggtgttttgacggcgttaaaaataaccaaatccttgaagagaatgtcgaagtggagatatggaccaaggagggagaacggaagaaactaaagccacgctggctggatgctagaatttacagtgaccctttggcattaaaagagttcaaggagttcgccgctggcaggaaaagcctgacactcaacctgatcactgagatggggcggcttcccacgtttatgacccagaaggccaagaatgcactggataacctcgcggtgttgcatacagccgaagctggaggtcgagcctataatcacgcactgtcggagctaccagagactctggaaaccctccttctgttaacattgctggctaccgtcactggcgggattttcctctttctgatgtctggaaaaggcatcggtaagatgacgcttgggatgtgctgcataatcaccgcctccattctgctctggtacgcacagatccagcctcactggattgccgctagcatcatattggagttctttctgattgttttactaatcccggaacccgagaaacaaagaacaccacaggacaaccagctgacttatgtggtaatcgcgattctcaccgtggtcgccgcaacaatggctaatgaaatgggcttccttgagaagaccaaaaaggattttggactgggctcaatcactacacagcaacctgagagtaacatattggacattgatctgcgccccgcctctgcctggacgctctacgcagtggctaccactttcatcacaccaatgctgaggcattccattgaaaatagctcagttaacgtgagtcttaccgccatcgcgaatcaggctaccgtcctcatggggctgggaaagggttggcctttgagcaaaatggacataggcgtacccctgttagccatcgggtgttactcccaggtgaacccgattacactaactgcagccctgctccttctggttgctcactatgcaatcattggaccaggcttgcaggccaaggcgacgcgggaggctcaaaaacgtgccgcagccggtatcatgaagaatcctaccgtggacgggatgacagtcattgatctggaccccatcccatacgatcccaaatttgaaaagcagctcggccaggtgatgctgcttgtcttatgcgtgactcaggttctgatgatgagaaccacatgggctctctgtgaggccttgaccctggcaactggacctatatctacgctatgggaaggcaacccggggaggttctggaatacaaccattgctgtgagcatggccaacatctttcgcggatcctatctggcgggcgccggtctccttttctcaatcatgaagaacactgcaaatacccggcgagggacaggaaacactggcgagaccctgggtgagaaatggaagaatagattgaacgctctgggcaaatctgaatttcaaatttacaagaaaagtgggatacaggaggtagacaggacactcgccaaggaaggaatcaaacgcggcgagacggatcatcacgcagtgtcgcgggggagcgctaagctgagatggttcgtcgagcgtaatttagttacccccgaaggaaaggtggtcgaccttggctgcggtagagggggatggtcctattactgtggcggtctgaaaaacgtgaaggaggtaaaaggcctcactaaagggggaccaggccatgaagaacctattcccatgtctacatatgggtggaatctagtgcggctgcagtcaggagttgatgtgttctttacccctccagaaaaatgcgacactttgctgtgtgatatcggcgagagctcccccaaccctacagtcgaggccggtcgcaccctccgagtgcttaatctggtcgaaaactggttgaataacaatacgcaattctgcattaaggtgctgaacccatacatgcccagtgttatcgagaagatggaagccctccagagaaaatacgggggagcgttagtaaggaatccgctgtctcggaacagcacccacgagatgtattgggtgtcaaacgcttccggcaatatagtcagtagcgtgaacatgatctctcgcatgcttattaatagatttacaatgaggcacaagaaagcaacttacgaacctgacgttgatctgggctccgggacccgaaacatcggaattgagtcagagacaccaaatctagacatcataggtaagcggattgagaaaatcaagcaggagcatgaaactagctggcactatgatcaggaccatccctacaagacctgggcctatcacggctcgtacgagacaaaacaaaccgggtctgctagttccatggtgaacggagtcgtgcgtctcctgactaagccttgggacgtaatcccaatggtgacgcagatggccatgacagataccactcccttcggccagcagagagtttttaaagaaaaggtcgacacccgcacacaagagccgaaagagggtacgaagaagttgatgaaaattaccgcagaatggctgtggaaggagctcgggaaaaagaaaactcctaggatgtgtacacgggaagagttcaccagaaaggtgcgcagcaatgccgctcttggagcgatatttactgatgagaacaaatggaagtcagccagggaagcagtggaggactccggcttctgggaactggtcgataaggagcgaaatttacacctggaaggcaaatgcgagacatgtgtttataacatgatggggaagcgggagaaaaagttgggagaatttggtaaagctaagggctctagagccatctggtacatgtggctcggggcaaggttcctggagtttgaagccctaggattccttaatgaggaccattggtttagccgcgaaaacagtctgtccggcgtggagggtgaggggctccacaagctgggatacattttgcgtgatgtaagcaaaaaggaaggcggcgctatgtatgccgacgataccgcggggtgggacacacggatcactctggaggatctcaaaaatgaagagatggtgaccaaccatatggaaggagagcacaagaaacttgcagaggccattttcaagctgacgtaccagaataaggtcgtgagagttcagaggcccaccccacgcggtacagtgatggacatcatatctcgacgggaccagagaggctcagggcaagtcgtgacttatggattaaacaccttcacaaacatggaagctcagctgatcaggcagatggagggcgaaggtgtatttaaaagtattcaacagttgactgttaaggaggagatcgccgtgaaaaattggctcattcgcgtcgggagagaacggctgtccaggatggcaatcagcggagatgactgcgtggtgaagcctctagatgaccgtttcgcttctgcccttaccgctctgaacgatatgggcaaagtccgaaaggacattcagcagtgggagccctcgcgcggctggaatgattggacgcaagttccattttgctcacatcacttccacgaactcataatgaaggacgggagagtgctggtagtgccctgtcggaaccaggatgagttgatcggaagggcccgcattagccagggtgcaggctggtccttaagagaaacagcgtgcctggggaaaagttacgcccagatgtggtctctcatgtattttcatcggagggaccttcgactggctgccaatgcaatctgtagcgctgtcccttcccactggatcccaacctcacgtactacatggagtattcatgccacccacgagtggatgactaccgaggatatgctaacagtgtggaacagagtttggatacaagaaaatccgtggatggaggacaagacgcccgtggaatcttgggaggaaatcccttacctgggaaaacgcgaggatcagtggtgcggcagcctcattggtttgacctcccgggcaacttgggccaagaacatccagacagcgattaatcaggtcaggtcactgatcgggaacgaggaatataccgactacatgccaagcatgaaaagattccgccgggaggaagaggaagctggagtgctttggtga

SEQ ID NO: 14341 - RNA, 9876 nt, synthetic construct
  misc_feature 1..9876: note = derived and/or modified CDS sequence (opt3) from DENV-2__KM279583__SS-prME
  source 1..9876: mol_type = other RNA
accgcaggaatcattataatgatgatccccacagtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgtggcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgaggtgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggctctgttgcagatggaaaacaaggcctggctcgtgcaccggcaatggtttctggatttacccctgccttggctcccaggggcggacacccagggctctaactggattcagaaagagactcttgttacattcaagaatccccacgccaagaaacaggatgtggtcgtgctgggatcccaagagggcgcaatgcatacggctttgaccggggccactgaaatccagatgtcaagcggaaacctactgtttacaggtcacctcaagtgccgtctgcgcatggacaaacttcagctgaagggcatgagttattctatgtgtaccgggaaattcaaggtagttaaggagatagctgaaacacaacatggaactattgtgatcagagtccagtacgagggcgacggttccccttgcaaaatcccattcgagattatggatttggaaaagaggcacgtgctcgggcggctgatcaccgtcaatcccattgtgacggagaaagacagcccggttaacatagaagccgagcctccctttggcgattcgtacatcattatcggagtggaaccaggccagttaaagctgtcttggttcaaaaaggggtcctcaatcggacagatgtttgagaccacaatgcgaggtgcaaagcgcatggccattctaggcgacactgcttgggatttcgggagtctcggaggcgtatttaccagcataggtaaagcgctgcatcaagtcttcggggcaatctatggcgccgctttttccggagtgtcttggacaatgaagattcttatcggcgttgtgattacttggatcgggatgaatagcagatcaaccagtttgtccgtcagcctggtgctcgtaggagtggttacgctgtaccttggcgtcatggtgcaggccgactctggttgtgtggtctcatggaaaaacaaggagctgaaatgcgggagtggaatattcatcacagataatgttcacacctggactgaacagtataagtttcagcctgagagcccctccaagttggcatctgccattcaaaaagctcacgaagagggcatctgtggtattaggtcggtgacacggctcgaaaacctgatgtggaagcagatcaccccagagttaaatcatatactgactgagaacgaagtgaaactaaccattatgacaggcgacatcaaggggattatgcaggccggaaaacgcagcctcagaccccagcctacggagctgaagtactcctggaaagcatggggcaaggcgaagatgctttcaaccgaattgcacaatcatactttcctgatcgatgggccagagacagctgaatgcccgaacaccaatagggcctggaacagtctcgaggtagaggactatggatttggcgtcttcacaactaatatatggctgaaattaaaggaacgtcaagatgtgttttgtgactctaaactgatgagcgcagccatcaaggacaaccgggctgttcacgccgatatgggttactggattgagtccgcacttaacgacacctggaaaatcgaaaaggcttcattcattgaggtaaagagctgccactggcccaaatctcatacgttgtggtccaatggggtcctcgagagtgaaatgatcatacctaagaacttcgccggaccagtgagccagcacaattatcgacccggctaccatacacagaccgcgggtccttggcacctgggcagactagagatggattttgacttctgtgaagggactaccgttgtggtaacagaggattgcggaaacaggggcccatctctgcgcactaccacagcctccgggaaactcattacggaatggtgctgtcggtcatgcaccctgcccccgcttagatacaggggagaggacggctgttggtatggtatggagatccgccctttgaaggaaaaagaggaaaatctggtcaacagtttagtgactgctgggcatggacagatcgataattttagcctcggcgtgctgggtatggcacttttcctggaggaaatgttgcgaacacgggtcggcaccaagcacgccattctcctggttgctgtgtcgtttgtaactctaatcacagggaacatgtccttccgtgacctgggaagagtgatggtcatggtgggcgccaccatgacggatgacattgggatgggagttacttacctcgcactgcttgcggcctttaaggtgaggccaaccttcgctgccggcttgctgttacgcaaactcacatctaaggagctgatgatgaccactataggtatcgtccttctgagccaatcaacaattcccgagagtatcctagaactcaccgatgcactggctttggggatgatggtgctgaaaattgttcggaatatggagaagtatcagttagccgtgacaatcatggcaatactctgcgtccctaacgccgtaatcctgcagaatgcttggaaagtgtcctgtactacccttgcggttgtgtctgtcagccccctgttgctcacgtcctcacaacagaaggccgactggattccactggcactaacaatcaagggactgaaccctaccgctatttttcttactaccctcagcagaacaagtaaaaagaggtcttggcccctgaatgaagccatcatggccgtgggcatggtatccatattggctagctcgctgctaaagaacgatattccaatgactggcccgctcgtggcagggggactgcttaccgtctgctacgttctgacgggtcgatcagccgacttggagctcgaacgcgcggctgacgtgcggtgggaggagcaggccgaaatctctggcagttcccctatcctgagcattacaatatctgaggatgggagcatgtccatcaagaatgaagaggaggaacagaccctaactattctgatcagaacaggacttctcgtgatttcaggcctgttccccgtcagtatcccaataaccgcagccgcttggtatttgtgggaggtgaaaaagcaaagggccggtgttttatgggacgtacccagccctccacccgtggggaaagccgaactggaggatggagcgtaccgtatcaagcagaagggcattctcggctattctcagatcggggctggagtctacaaagaaggtacttttcacacaatgtggcatgtgacccgcggcgccgttctgatgcacaaggggaaacggattgagccttcctgggcagacgtgaagaaagatcttatctcatacggaggcggttggaagctggagggggaatggaaggagggagaagaggtccaggtgttggccctagaaccgggcaaaaacccaagagctgtacaaacgaagcccggcctgttcaaaactaacaccgggacaataggagccgtcagtctcgactttagccctggtacctccggctctccaattgtggataagaaagggaaggttgtgggactgtatggcaatggtgtcgtgacaaggtcggggacttacgttagcgcaatcgctcagaccgagaagtcaatcgaggacaaccccgaaattgaggatgacatcttccggaaaaagagacttacgataatggatttacatcctggagccggcaaaacaaagcgctatctgccggcgattgtgagagaagccatcaaaaggggcctccggactttgattctggcacccacccgagtcgtggctgccgagatggaagaggctctcagagggctgccaatccgctaccagacccctgcaataagggccgagcacaccggacgtgaaattgtagaccttatgtgtcatgccactttcaccatgcggctgttgtcccccatcagagtgccaaattataacctaatcattatggatgaggctcactttacagaccctgcgagtatcgcagccaggggttacatttctacgcgcgttgaaatgggcgaggctgccgggatattcatgactgcaacacccccaggaagccgagacccgtttcctcagtccaatgcccccatcatggatgaggaaagagagattccagaacggtcatggaactctggccacgagtgggtcacagacttcaagggtaagaccgtgtggtttgtgcccagcatcaaagctgggaatgatatcgcggcctgcctgaggaagaacggcaaaaaggtcattcaactcagtcgcaaaactttcgactccgaatatataaagacacgtaccaatgattgggactttgtagtgacgactgatatcagcgagatgggcgcaaacttcaaggctgagagagttattgaccctcggaggtgtatgaaaccagtgatcttaacagatggcgaagaacgcgtcattctggccgggcccatgcctgtgacccattcttcagcagcccagcgaagaggacgggttggtaggaatccgaagaacgaaaatgaccagtacatctacatgggcgagccacttgaaaacgatgaggactgcgctcactggaaagaggccaagatgctgctcgacaatataaacacccccgaagggatcattccttccatgtttgagcccgaacgcgagaaagtggatgcgatcgacggagaatatagattgaggggcgaggcacggaagactttcgtcgatctgatgcgtcgcggtgacctcccagtgtggctggcctaccgagtagctgccgaggggattaactatgctgatagaaggtggtgttttgacggcgtgaaaaataaccaaatccttgaagagaatgttgaagtcgagatatggacaaaggagggagaacggaagaaactaaagcctcgctggctggatgcaagaatttacagtgaccccttggccttaaaagagttcaaggagttcgctgccggcaggaaaagcctgaccctcaacctgatcacagagatggggcggcttccaacttttatgacgcagaaggcaaagaatgcgctggataacctcgccgtgttgcataccgctgaagccggaggtcgagcatataatcacgctctgtcggagctacctgagacactggaaactctccttctgttaaccttgctggccacagtgaccggcgggattttcctctttctgatgtctggaaaaggcatcggtaagatgactcttgggatgtgctgcataatcacggcatccattctgctctggtacgcccagatccagccgcactggattgctgcgagcatcatattggagttctttctgattgtcttactaatccccgaaccagagaaacaaagaacccctcaggacaaccagctgacatatgttgtgatcgccattctcactgtagtggcagctaccatggccaatgaaatgggcttccttgagaagaccaaaaaggattttggactgggctcaatcaccactcagcaacccgagagtaacatattggacattgatctgcgcccagcctctgcatggacactctacgctgtcgccacgaccttcatcactcctatgctgaggcattccattgaaaatagctcagtgaacgttagtcttacagcgatcgctaatcaggccaccgtgctcatggggctgggaaagggttggcccttgagcaaaatggacataggcgtcccgctgttagcaatcgggtgttactcccaggtaaacccaattaccctaacagccgctctgctccttctggtggcacactatgccatcattggacctggcttgcaggcgaaggctactcgggaggcccaaaaacgtgcagccgctggtatcatgaagaatcccacggttgacgggatgaccgtgattgatctggacccaatcccctacgatcctaaatttgaaaagcagctcggccaggtcatgctgcttgtgttatgcgtcacacaggtgctgatgatgagaactacctgggccctctgtgaggcattgacactggctaccggaccgatatctactctatgggaaggcaaccccgggaggttctggaatacgacaattgccgttagcatggcgaacatctttcgcggatcctatctggccggcgcaggtctccttttctcaatcatgaagaacaccgctaatactcggcgagggaccggaaacacaggcgagactctgggtgagaaatggaagaatagattgaacgccctgggcaaatctgaatttcaaatttacaagaaaagtgggatacaggaggtggacaggaccctcgcaaaggaaggaatcaaacgcggcgagacagatcatcacgctgtatcgcgggggagcgccaagctgagatggttcgtggagcgtaatttagtcacgccagaaggaaaggttgtggaccttggctgcggtagagggggatggtcctattactgtggcggtctgaaaaacgtcaaggaggtgaaaggcctcaccaaagggggacctggccatgaagaacccattcctatgtctacttatgggtggaatctagtacggctgcagtcaggagtggatgttttctttacaccacccgaaaaatgcgacaccttgctgtgtgatatcggcgagagctcccctaacccaactgtggaggccggtcgcacactccgagtccttaatctggtggaaaactggttgaataacaatacccaattctgcattaaggtcctgaacccctacatgccgagtgtgatcgagaagatggaagcgctccagagaaaatacgggggagctttagttaggaatcctctgtctcggaacagcacgcacgagatgtattgggtatcaaacgcatccggcaatatagtgagtagcgtcaacatgatctctcgcatgcttattaatagatttaccatgaggcacaagaaagccacatacgaaccagacgtggatctgggctccgggactcgaaacatcggaattgagtcagagacccccaatctagacatcataggtaagcggattgagaaaatcaagcaggagcatgaaacaagctggcactatgatcaggaccatccttacaagacttgggcttatcacggctcgtacgagaccaaacaaacagggtctgccagttccatggttaacggagtggtccgtctcctgaccaagccatgggacgtgatccccatggtaactcagatggcaatgacggatacaaccccgttcggccagcagagagtgtttaaagaaaaggttgacactcgcacccaagagcctaaagagggtacaaagaagttgatgaaaattacggccgaatggctgtggaaggagctcgggaaaaagaaaacccccaggatgtgtactcgggaagagttcacaagaaaggtccgcagcaatgctgcgcttggagccatatttaccgatgagaacaaatggaagtcagcaagggaagctgtggaggactccggcttctgggaactggtggataaggagcgaaatttacacctggaaggcaaatgcgagacttgtgtctataacatgatggggaagcgggagaaaaagttgggagaatttggtaaagccaagggctctagagcaatctggtacatgtggctcggggccaggttcctggagtttgaagctctaggattccttaatgaggaccattggtttagccgcgaaaacagtctgtccggcgttgagggtgaggggctccacaagctgggatacattttgcgtgatgtgagcaaaaaggaaggcggcgccatgtatgcggacgatacagcagggtgggacacccggatcacactggaggatctcaaaaatgaagagatggtaactaaccatatggaaggagagcacaagaaacttgccgaggctattttcaagctgacctaccagaataaggtggtcagagtgcagaggccaacgcctcgcggtaccgttatggacatcatatctcgacgggaccagagaggctcagggcaagtggtcacatatggattaaacactttcaccaacatggaagcccagctgatcaggcagatggagggcgaaggtgtgtttaaaagtattcaacagttgacagtaaaggaggagatcgcagttaaaaattggctcattcgcgtggggagagaacggctgtccaggatggctatcagcggagatgactgcgtcgtgaagcccctagatgaccgtttcgcctctgctcttactgccctgaacgatatgggcaaagtgcgaaaggacattcagcagtgggagccatcgcgcggctggaatgattggacccaagtccccttttgctcacatcacttccacgaactcataatgaaggacgggagagttctggtggtaccttgtcggaaccaggatgagttgatcggaagggcacgcattagccagggtgcgggctggtccttaagagaaacggcctgcctggggaaaagttacgctcagatgtggtctctcatgtattttcatcggagggaccttcgactggccgcaaatgctatctgtagcgccgtgccatcccactggatcccgacatcacgtaccacttggagtattcatgcaacacacgagtggatgaccactgaggatatgctaaccgtctggaacagagtgtggatacaagaaaatccctggatggaggacaagacacctgttgaatcttgggaggaaatcccatacctgggaaaacgcgaggatcagtggtgcggcagcctcattggtttgacgtcccgggccacctgggcgaagaacatccagactgctattaatcaggtgaggtcactgatcgggaacgaggaatatacagactacatgcccagcatgaaaagattccgccgggaggaagaggaagccggagtcctttggtga

SEQ ID NO: 14342 - RNA, 9876 nt, synthetic construct
  misc_feature 1..9876: note = derived and/or modified CDS sequence (opt3) from DENV-2__KM279585__SS-prME
  source 1..9876: mol_type = other RNA
accgccggaatcattataatgatgatccccacagtgatggctttccacctgactacgcgaaacggggagcctcatatgattgtaagcaggcaggaaaagggaaaatccctcctttttaagaccgagaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgtggcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgaggtgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcgtgagagtccagtacgagggcgacggttccccttgcaaaatcccattcgagatcatggatttggaaaagaggcacgtgctcgggcggctgattaccgttaatcccatcgtgacggagaaagacagcccggtaaacattgaagctgagcctccctttggcgattcgtacataatcattggagtcgaaccaggccagttaaagctgtcttggttcaaaaaggggtcctcaatcggacagatgtttgagaccacaatgcgaggtgccaagcgcatggcaatcctaggcgacactgcctgggatttcgggagtctcggaggcgtgtttaccagcattggtaaagctctgcatcaagttttcggggcgatatatggcgcagccttttccggagtgtcttggacaatgaagatccttattggcgtcgtgatcacttggattgggatgaatagcagatcaaccagtttgtccgtaagcctggtgctcgttggagtcgtgacgctgtaccttggcgtgatggtccaggctgactctggttgtgttgtgtcatggaaaaacaaggagctgaaatgcgggagtggaatcttcataacagataatgtgcacacctggactgaacagtataagtttcagcctgagagcccctccaagttggcctctgcaatccaaaaagcccacgaagagggcatttgtggtatcaggtcggtaacacggctcgaaaacctgatgtggaagcagattaccccagagttaaatcatatcctgactgagaacgaagtcaaactaaccataatgacaggcgacattaaggggatcatgcaggctggaaaacgcagcctcagaccccagcctacggagctgaagtactcctggaaagcctggggcaaggcaaagatgctttcaaccgaattgcacaatcatactttcctgattgatgggccagagacagcggaatgcccgaacaccaatagggcttggaacagtctcgaggtggaggactatggatttggcgttttcacaactaatatctggctgaaattaaaggaacgtcaagatgtgttttgtgactctaaactgatgagcgccgcaataaaggacaaccgggccgtccacgctgatatgggttactggatcgagtccgcccttaacgacacctggaaaattgaaaaggcatcattcatcgaggtaaagagctgccactggcccaaatctcatacgttgtggtccaatggggttctcgagagtgaaatgattatccctaagaacttcgctggaccagtgagccagcacaattatcgacccggctaccatacacagaccgccggtccttggcacctgggcagactagagatggattttgacttctgtgaagggactaccgtagtcgtgacagaggattgcggaaacaggggcccatctctgcgcactaccacagcgtccgggaaactcataacggaatggtgctgtcggtcatgcaccctgcccccgcttagatacaggggagaggacggctgttggtatggtatggagattcgccctttgaaggaaaaagaggaaaatctggtgaacagtttagtcactgccgggcatggacagatcgataattttagcctcggcgttctgggtatggctcttttcctggaggaaatgttgcgaacacgggtgggcaccaagcacgcaatcctcctggtagccgtgtcgtttgtcactctaattacagggaacatgtccttccgtgacctgggaagagtgatggttatggtgggcgctaccatgacggatgacatcgggatgggagtcacttacctcgccctgcttgcagcgtttaaggtgaggccaaccttcgccgctggcttgctgttacgcaaactcacatctaaggagctgatgatgaccactattggtatagttcttctgagccaatcaacaatccccgagagtattctagaactcaccgatgccctggcattggggatgatggtgctgaaaatcgtccggaatatggagaagtatcagttagctgtaacaattatggccatcctctgcgtgcctaacgcagttatactgcagaatgcctggaaagtgtcctgtactacccttgctgtcgtgtctgtaagccccctgttgctcacgtcctcacaacagaaggcggactggatcccactggccctaacaattaagggactgaaccctaccgcaatctttcttactaccctcagcagaacaagtaaaaagaggtcttggcccctgaatgaagctattatggccgtgggcatggtctccatcttggccagctcgctgctaaagaacgatataccaatgactggcccgctcgttgctgggggactgcttaccgtgtgctacgtgctgacgggtcgatcagcagacttggagctcgaacgcgccgcggacgtccggtgggaggagcaggctgaaatttctggcagttcccctatcctgagcatcacaatttctgaggatgggagcatgtccataaagaatgaagaggaggaacagaccctaactatcctgattagaacaggacttctcgtgatctcaggcctgttccccgttagtattccaatcaccgccgcagcctggtatttgtgggaggtcaaaaagcaaagggctggtgtgttatgggacgtccccagccctccacccgtggggaaagcagaactggaggatggagcctaccgtataaagcagaagggcatcctcggctattctcagattggggcgggagtttacaaagaaggtacttttcacacaatgtggcatgtgacccgcggcgctgtcctgatgcacaaggggaaacggatcgagccttcctgggccgacgtgaagaaagatcttatttcatacggaggcggttggaagctggagggggaatggaaggagggagaagaggtacaggtcttggcactagaaccgggcaaaaacccaagagccgtgcaaacgaagcccggcctgttcaaaactaacaccgggacaatcggagctgttagtctcgactttagccctggtacctccggctctccaatagtggataagaaagggaaggtcgtgggactgtatggcaatggtgttgtgacaaggtcggggacttacgtcagcgccattgcacagaccgagaagtcaatcgaggacaaccccgaaatcgaggatgacattttccggaaaaagagacttacgatcatggatttacatcctggagctggcaaaacaaagcgctatctgccggccatagtgagagaagcgattaaaaggggcctccggactttgatcctggcccccacccgagtagtggcagctgagatggaagaggccctcagagggctgccaattcgctaccagacccctgctatcagggcagagcacaccggacgtgaaatagttgaccttatgtgtcatgccactttcaccatgcggctgttgtcccccattagagtcccaaattataacctaatcatcatggatgaggcccactttacagaccctgctagtattgcggcaaggggttacatctctacgcgcgtggaaatgggcgaggccgctgggattttcatgactgccacacccccaggaagccgagacccgtttcctcagtccaatgcacccataatggatgaggaaagagagatcccagaacggtcatggaactctggccacgagtgggtgacagacttcaagggtaagaccgtctggtttgtacccagcattaaagccgggaatgatatcgctgcgtgcctgaggaagaacggcaaaaaggtgatccaactcagtcgcaaaactttcgactccgaatatattaagacacgtaccaatgattgggactttgttgtgacgactgatataagcgagatgggcgccaacttcaaggcagagagagtcatcgaccctcggaggtgtatgaaaccagtgattttaacagatggcgaagaacgcgttatcctggctgggcccatgcctgtgacccattcttcagccgcacagcgaagaggacgggtcggtaggaatccgaagaacgaaaatgaccagtacatttacatgggcgagccacttgaaaacgatgaggactgcgcccactggaaagaggctaagatgctgctcgacaatatcaacacccccgaagggataatcccttccatgtttgagcccgaacgcgagaaagtggatgccattgacggagaatatagattgaggggcgaggcgcggaagactttcgtagatctgatgcgtcgcggtgacctcccagtgtggctggcataccgagttgccgctgaggggatcaactatgccgatagaaggtggtgttttgacggcgtcaaaaataaccaaattcttgaagagaatgtggaagtggagatctggacaaaggagggagaacggaagaaactaaagcctcgctggctggatgctagaatatacagtgaccccttggcattaaaagagttcaaggagttcgccgctggcaggaaaagcctgaccctcaacctgattacagagatggggcggcttccaacttttatgacgcagaaggccaagaatgcactggataacctcgcggtcttgcataccgccgaagctggaggtcgagcctataatcacgcactgtcggagctacctgagacactggaaactctccttctgttaaccttgctggctacagttaccggcgggatcttcctctttctgatgtctggaaaaggcattggtaagatgactcttgggatgtgctgcatcataacggcctccatcctgctctggtacgcacagattcagccgcactggatcgccgctagcattatcttggagttctttctgatagtgttactaattcccgaaccagagaaacaaagaacccctcaggacaaccagctgacatatgtagtgatcgcgatcctcactgtcgtggccgcaaccatggctaatgaaatgggcttccttgagaagaccaaaaaggattttggactgggctcaattaccactcagcaacccgagagtaacatcttggacatagatctgcgcccagcctctgcctggacactctacgcagttgctacgaccttcattactcctatgctgaggcattccatcgaaaatagctcagtgaacgtcagtcttacagccattgcgaatcaggctaccgtactcatggggctgggaaagggttggcccttgagcaaaatggacatcggcgtgccgctgttagccatagggtgttactcccaggttaacccaatcaccctaacagcagccctgctccttctggtggctcactatgcaattatcggacctggcttgcaggccaaggcgactcgggaggctcaaaaacgtgccgcagccggtattatgaagaatcccacggtcgacgggatgaccgtgatcgatctggacccaattccctacgatcctaaatttgaaaagcagctcggccaggtcatgctgcttgtgttatgcgttacacaggtgctgatgatgagaactacctgggctctctgtgaggccttgacactggcaaccggaccgatctctactctatgggaaggcaaccccgggaggttctggaatacgacaatagctgtaagcatggccaacatttttcgcggatcctatctggcgggcgccggtctccttttctcaatcatgaagaacaccgcaaatactcggcgagggaccggaaacacaggcgagactctgggtgagaaatggaagaatagattgaacgctctgggcaaatctgaatttcaaatctacaagaaaagtgggattcaggaggtggacaggaccctcgccaaggaaggaataaaacgcggcgagacagatcatcacgcagtctcgcgggggagcgctaagctgagatggttcgttgagcgtaatttagtgacgccagaaggaaaggtcgtggaccttggctgcggtagagggggatggtcctattactgtggcggtctgaaaaacgtaaaggaggtgaaaggcctcaccaaagggggacctggccatgaagaacccatccctatgtctacttatgggtggaatctagttcggctgcagtcaggagtggatgtcttctttacaccacccgaaaaatgcgacaccttgctgtgtgatattggcgagagctcccctaacccaactgtggaggccggtcgcacactccgagtccttaatctggtggacaactggttgaataacaatacccaattctgcatcaaggttctgaacccctacatgccgagtgtaattgaaaagatggaggccctccagagaaaatacgggggagcgttagtgaggaatcctctgtctcggaacagcacgcacgaaatgtattgggtctcaaacgcttccggcaatatcgtgagtagcgttaacatgatatctcgcatgcttatcaatagatttaccatgaggcacaagaaagcaacatacgagccagatgtggacctgggctccgggactcgaaacattggaatcgaatcagagacccccaatctagatattatcggtaagcggatagagaaaattaagcaggaacatgagacaagctggcactatgaccaggaccatccttacaagacttgggcctatcacggctcgtacgaaaccaaacaaacagggtctgctagttccatggtcaacggagtggtacgtctcctgaccaagccatgggatgtgatccccatggttactcagatggccatgacggacacaaccccgttcggccagcagagagtctttaaagagaaggtggatactcgcacccaagaacctaaagagggtacaaagaagttgatgaaaatcacggcagagtggctgtggaaggaactcgggaaaaagaaaacccccaggatgtgtactcgggaggagttcacaagaaaggtgcgcagcaatgccgctcttggagcgatttttaccgacgagaacaaatggaagtcagccagggaggcagtcgaagattccggcttctgggagctggttgacaaggaacgaaatttacacctggagggcaaatgcgaaacttgtgtgtataacatgatggggaagcgggagaaaaagttgggagagtttggtaaagctaagggctctagagccatatggtacatgtggctcggggcaaggttcctggaatttgaggccctaggattccttaatgaagatcattggtttagccgcgagaacagtctgtccggcgtagaaggtgaggggctccacaagctgggatacatcttgcgtgacgtgagcaaaaaggagggcggcgctatgtatgccgatgacacagcggggtgggatacccggattacactggaagacctcaaaaatgaggaaatggtcactaaccatatggagggagaacacaagaaacttgcagaggccatcttcaagctgacctaccagaataaggtggttagagtgcagaggccaacgcctcgcggtaccgtcatggacattatctctcgacgggatcagagaggctcagggcaagtggtaacatatggattaaacactttcaccaacatggaggctcagctgataaggcagatggaaggcgagggtgtttttaaaagtatccaacagttgacagtgaaggaagagattgccgtcaaaaattggctcatccgcgtggggagagagcggctgtccaggatggcaattagcggagacgattgcgtggtcaagcccctagacgatcgtttcgcttctgcccttactgctctgaacgacatgggcaaagttcgaaaggatatccagcagtgggaaccatcgcgcggctggaatgactggacccaagtgcccttttgctcacatcacttccacgagctcattatgaaggatgggagagtactggtggtcccttgtcggaaccaggacgaattgataggaagggcccgcatcagccagggtgcaggctggtccttaagagagacggcgtgcctggggaaaagttacgcccagatgtggaatctcatgtattttcatcggagggatcttcgactggctgccaacgcaatttgttctgctgtgccaagccactggatcccgacatcccgtaccacttggtcaatccatgccacacacgaatggatgaccactgaggacatgctaaccgtttggaatagagtgtggattcaagagaacccctggatggaagataagacacctgtcgagagttgggaagagataccatacctgggaaaacgcgaagaccagtggtgcggctctctcatcggtttgacgagccgggcaacctgggccaagaatattcagactgcgatcaaccaggtgaggtccctgattgggaatgaggagtatacagactacatgccctcaatgaaaagattccgccgggaagaggaagaggctggagtactttggtga

SEQ ID NO: 14343 - RNA, 9876 nt, synthetic construct
  misc_feature 1..9876: note = derived and/or modified CDS sequence (opt3) from DENV-2__KM279525__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcagcctcagaccccagcctacggagctgaagtactcctggaaagcctggggcaaggcaaagatgctttcaaccgaattgcacaatcatactttcctgatcgatgggccagagacagcggaatgcccgaacaccaatagggcttggaacagtctcgaggtcgaggactatggatttggcgtgttcacaactaatatatggctgaaattaaaggaacgtcaagatgttttttgtgactctaaactgatgagcgccgcaatcaaggacaaccgggccgtgcacgctgatatgggttactggattgagtccgcccttaacgacacctggaaaatcgaaaaggcatcattcattgaggtcaagagctgccactggcccaaatctcatacgttgtggtccaatggggtgctcgagagtgaaatgatcatacctaagaacttcgctggaccagttagccagcacaattatcgacccggctaccatacacagaccgccggtccttggcacctgggcagactagagatggattttgacttctgtgaagggactaccgtggtagtcacagaggattgcggaaacaggggcccatctctgcgcactaccacagcgtccgggaaactcattacggaatggtgctgtcggtcatgcaccctgcccccgcttagatacaggggagaggacggctgttggtatggtatggagatccgccctttgaaggaaaaagaggaaaatctggtgaacagtttagtgactgccgggcatggacagatcgataattttagcctcggcgtcctgggtatggctcttttcctggaggaaatgttgcgaacacgggttggcaccaagcacgcaattctcctggtggccgtatcgtttgtgatcctaattactgggaacatgtccttccgtgacctgggaagagtcatggtgatggttggcgctacaatgaccgatgacatagggatgggagtgacgtacctcgccctgcttgcagcgtttaaggtcaggccaactttcgccgctggcttgctgttacgcaaactcacctctaaggagctgatgatgacaaccatcggtattgtgcttctgagccaatcaactatccccgagaatattctagaactcacagatgccctggcattggggatgatggttctgaaaatcgtgcggaacatggagaagtatcagttagctgtcaccataatggccatcctctgcgtacctaatgcagtgattctgcagaacgcctggaaagttagttgtacaactcttgctgtggtctccgtgtctcccctgttgctcaccagctcccaacagaaggcggactggatcccactggccctaacgattaagggactgaatcctacagcaatctttcttaccactctctcaagaaccagcaaaaagaggagttggcccctgaacgaagctataatggccgtaggcatggtgtctattttggcctccagcctgttaaaaaatgatatcccaatgacaggcccgctcgtcgctgggggactgcttactgtttgctacgtgctgaccggtcgatcggcagacttggagctcgaacgcgccgcggacgtgcggtgggaggagcaggctgaaatctcaggctctagtcctattctgtccataacgatcagcgaggatgggtctatgagcattaagaacgaagaggaggaacagacactaaccatcctgattagaactggacttctcgtcatctccggcctgttccccgtgtcaataccaatcacagccgcagcctggtatttgtgggaggttaaaaagcaaagggctggtgtattatgggacgtgcccagtcctccacccgtcgggaaagcagaactggaggatggagcctaccgtattaagcagaagggcatcctcggctatagccagattggggcgggagtgtacaaagaaggtacctttcacactatgtggcatgttacacgcggcgctgtgctgatgcacaaggggaaacggatcgagccttcttgggccgacgtcaagaaagatcttatatcctacggaggcggttggaagctggagggggaatggaaggagggagaagaggtgcaggtattggcactagaaccgggcaaaaacccaagagccgtccaaaccaagcccggcctgttcaaaacgaatactgggaccattggagctgtgtcactcgactttagtcctggtacaagcggctccccaatcgttgataagaaagggaaggtggtcggactgtatggcaacggtgtggttaccaggtctgggacatacgtgtcggccatcgcacagactgagaagagcattgaggacaatcccgaaatcgaggatgacatattccgaaaaaagcggcttaccattatggatttacatcctggagctggcaaaacgaagcgctatctgccggccatcgtcagagaagcgattaaaaggggcctccggacattgatcctggcccccactcgagtggtagcagctgagatggaagaggccctcagagggctgccaatacgctaccagacccctgctattagggcagagcacacaggacgtgaaatcgtggaccttatgtgtcatgccaccttcactatgcggctgttgtcacccatcagagttccaaactataatctaattatcatggatgaggcccactttaccgaccctgcttccattgcggcaaggggttacataagtacacgcgtcgaaatgggcgaggccgctgggatcttcatgacggccactcccccaggatctcgagacccgtttcctcagagcaacgcacccattatggatgaggaaagagagatcccagaacggtcctggaattcaggccacgagtgggtgaccgacttcaagggtaagacagtgtggtttgtcccctctatcaaagccgggaacgatattgctgcgtgcctgaggaagaatggaaaaaaggtaatacaactcagccgcaaaaccttcgacagtgaatatatcaagactcgtacaaacgattgggactttgtggttaccacggatatttccgagatgggcgccaatttcaaggcagagagagtgatcgaccctcggaggtgtatgaaaccagtcattttaactgatggcgaagagcgcgtgatcctggctgggcccatgcctgttacacatagctctgccgcacagcgaagaggacgggtgggtaggaacccgaagaatgaaaacgaccagtacatatacatgggcgagccacttgaaaatgatgaggactgcgcccactggaaagaggctaagatgctgctcgacaacatcaacacccccgaagggattatcccttcaatgtttgagcccgaacgcgagaaagtcgatgccattgacggagaatatagattgaggggcgaggcgcggaagaccttcgtggatctgatgcgtcgcggtgacctcccagtatggctggcataccgagtggccgctgaggggatcaattatgccgatagaaggtggtgttttgacggcgttaaaaacaatcaaatacttgaagagaacgtcgaagtggagatttggactaaggagggagaacggaagaaactaaagcctcgctggctggatgctagaatctactccgaccccttggcattaaaagagttcaaggaattcgccgctggcaggaaaagtctgacactcaatctgattaccgagatggggcggcttccaacatttatgactcagaaggccaagaacgcactggataatctcgcggtgttgcatacggccgaagctggaggtcgagcctataaccacgcactgagcgagctacctgagaccctggaaacactccttctgttaactttgctggctaccgtcacaggcgggatcttcctctttctgatgtcgggaaaaggcataggtaagatgacccttgggatgtgctgcatcattactgcctctatcctgctctggtacgcacagattcagccgcactggatcgccgcttccataattttggagttctttctgatcgttttactaatccccgaaccagagaaacaaagaacgcctcaggacaatcagctgacctatgtggtaattgcgatcctcacagtggtcgccgcaactatggctaacgaaatgggcttccttgagaagaccaaaaaggattttggactgggcagcataacaacccagcaacccgagtcaaatattttggacatcgatctgcgcccagccagtgcctggactctctacgcagtggctacaacgttcattacccctatgctgaggcattctatcgaaaactccagcgttaatgtgtcacttactgccatagcgaaccaggctacagtcctcatggggctgggaaagggttggcccttgagtaaaatggacatcggcgtaccgctgttagccattgggtgttacagccaggtgaatccaatcaccctaaccgcagccctgctccttctggttgctcactatgcaattatcggacctggcttgcaggccaaggcgacacgggaggctcaaaaacgtgccgcagccggtattatgaagaaccccactgtggacgggatgacggtcatcgatctggacccaataccctacgatcctaaatttgaaaagcagctcggccaggtgatgctgcttgtcttatgcgtgacccaggttctgatgatgagaacaacttgggctctctgtgaggccttgaccctggcaacaggaccgatttccaccctatgggaaggcaatcccgggaggttctggaacactacgatcgctgtgtctatggccaacatctttcgcggaagctatctggcgggcgccggtctccttttctccattatgaagaatacagcaaacacccggcgagggactggaaataccggcgagacactgggtgagaaatggaagaacagattgaatgctctgggcaaatcagaatttcaaatatacaagaaatctgggatccaggaggtagacaggactctcgccaaggaaggaattaaacgcggcgagaccgatcatcacgcagtgagtcgggggtcggctaagctgagatggttcgtcgagcgtaacttagttacaccagaaggaaaggtggtcgaccttggctgcggtagggggggatggagctattactgtggcggtctgaaaaatgtgaaggaggtaaaaggcctcacgaaggggggacctggccatgaagagcccatccctatgtccacctatgggtggaacctagtgcggctgcagtctggagttgatgtgttctttactccacccgaaaaatgcgacacattgctgtgtgatattggcgagtcaagccctaatccaaccgtcgaggccggtcgcactctccgagtgcttaacctggtcgaaaattggttgaacaataacacacaattctgcatcaaggtgctgaatccctacatgccgtccgttatagagaagatggaagccctccagagaaaatacgggggagcgttagtaaggaaccctctgagtcggaactctacccacgagatgtattgggtgagcaatgcttcaggcaacatcgtctccagtgtgaatatgattagccgcatgcttatcaacagatttacgatgaggcacaagaaagcaacctacgaaccagacgttgatctgggctctgggacacgaaatattggaatcgagtccgagactcccaacctagacataattggtaagcggatcgaaaaaatcaagcaggagcatgaaacctcatggcactatgatcaggaccatccttacaagacatgggcctatcacggcagctacgagactaaacaaaccgggtcggcttctagtatggtgaatggagtcgtgcgtctcctgacaaagccatgggacgtaattcccatggtgacccagatggccatgactgatacgacaccgttcggccagcagagagtttttaaagaaaaggtcgacacccgcactcaagagcctaaagagggtaccaagaagttgatgaaaataacagcagaatggctgtggaaggagctcgggaaaaagaaaacgcccaggatgtgtacccgggaagagttcactagaaaggtgcgctccaacgccgctcttggagcgatctttacagatgagaataaatggaagagcgccagggaagcagtggaggactcaggcttctgggaactggtcgataaggagcgaaacttacacctggaaggcaaatgcgagacctgtgtttataatatgatggggaagcgggagaaaaagttgggagaatttggtaaagctaagggctccagagccatttggtacatgtggctcggggcaaggttcctggagtttgaagccctaggattccttaacgaggaccattggttttctcgcgaaaatagcctgagtggcgtggagggtgaggggctccacaagctgggatacatcttgcgtgatgtatccaaaaaggaaggcggcgctatgtatgccgacgatactgcggggtgggacacacggattaccctggaggatctcaaaaacgaagagatggtgacaaatcatatggaaggagagcacaagaaacttgcagaggccatcttcaagctgacttaccagaacaaggtcgtgagagttcagaggccaacccctcgcggtacggtgatggacataatcagccgacgggaccagagaggctctgggcaagtcgtgacctatggattaaacacattcactaatatggaagctcagctgattaggcagatggagggcgaaggtgtatttaaatcaatccaacagttgaccgttaaggaggagattgccgtgaaaaactggctcatccgcgtcgggagagaacggctgagtaggatggcaatttccggagatgactgcgtggtgaagcccctagatgaccgtttcgctagcgcccttacagctctgaatgatatgggcaaagtccgaaaggacatacagcagtgggagccatctcgcggctggaacgattggactcaagttcccttttgctcgcatcacttccacgaactcatcatgaaggacgggagagtgctggtagtgccttgtcggaatcaggatgagttgattggaagggcccgcatctcacagggtgcaggctggagcttaagagaaaccgcgtgcctggggaaatcctacgcccagatgtggagtctcatgtattttcatcggagggaccttcgactggctgccaacgcaatctgttctgctgtcccaagccactggattccgacgtcccgtacaacctggtcaatacatgccactcacgagtggatgacaaccgaggatatgctaactgtgtggaatagagtttggatccaagaaaacccctggatggaggacaagacccctgtggaaagttgggaggaaattccatacctgggaaaacgcgaggatcagtggtgcggctctctcatcggtttgacaagccgggcaacgtgggccaagaatattcagaccgcgatcaaccaggtcaggtccctgatagggaatgaggaatatactgactacatgccctcaatgaaaagattccgccgggaggaagaggaagctggagtgctttggtga

SEQ ID NO: 14344 - RNA, 9876 nt, synthetic construct
  misc_feature 1..9876: note = derived and/or modified CDS sequence (opt3) from DENV-2__KM279528__SS-prME
  source 1..9876: mol_type = other RNA
accgccggcatcattataatgatgatccccacagtgatggctttccacctgactacgaggaacggggaacctcatatgattgtcagcaggcaggaaaagggaaaatccctcctttttaagaccgaaaatggtgttaacatgtgcacactgatggcaatggacttgggcgaattatgtgaagatactatcacctacaattgcccactgctacggcaaaacgaaccggaagacattgattgttggtgcaattctacatcaacctgggtgacttatgggacatgtaccgccacgggagagcaccgccgagaaaaacgtagtgttgcgctcgtgccccatgtcggcatgggtctggagactaggaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcagcctcagaccccagcctacggagctgaagtactcctggaaagcctggggcaaggcaaagatgctttcaaccgaattgcacaatcatactttcctgatcgatgggccagagacagcggaatgcccgaacaccaatagggcttggaacagtctcgaggtcgaggactatggatttggcgtgttcacaactaatatatggctgaaattaaaggaacgtcaagatgtattttgtgactctaaactgatgagcgccgcaatcaaggacaaccgggccgtgcacgctgatatgggttactggattgagtccgcccttaacgacacctggaaaatcgaaaaggcatcattcattgaggtcaagagctgccactggcccaaatctcatacgttgtggtccaatggggtgctcgagagtgaaatgatcatacctaagaacttcgctggaccagttagccagcacaattatcgacccggctaccatacacagaccgccggtccttggcacctgggcagactagagatggattttgacttctgtgaagggactaccgtggtagtcacagaggattgcggaaacaggggcccatctctgcgcactaccacagcgtccgggaaactcattacggaatggtgctgtcggtcatgcaccctgcccccgcttagatacaggggagaggacggctgttggtatggtatggagatccgccctttgaaggaaaaagaggaaaatctggtgaacagtttagtgactgccgggcatggacagatcgataattttagcctcggcgtcctgggtatggctcttttcctggaggaaatgttgcgaacacgggttggcaccaagcacgcaattctcctggtggccgtatcgtttgtgactctaatcacagggaacatgtccttccgtgacctgggaagagtcatggtgatggttggcgctaccatgacggatgacattgggatgggagtgacttacctcgccctgcttgcagcgtttaaggtcaggccaaccttcgccgctggcttgctgttacgcaaactcacatctaaggagctgatgatgaccactataggtatcgtgcttctgagccaatcaacaattcccaaaagtatcctagagctcaccgatgccctggcattggggatgatggttctgaagattgtgcggaatatggaaaaatatcagttagctgtcacaatcatggccatactctgcgtacctaacgcagtgatcctgcagaatgcctggaaggtttcctgtactacccttgctgtggtctctgtgagccccctgttgctcacgtcctcacaacagaaggcggactggattccactggccctaacaatcaaaggactgaaccctaccgcaatttttcttactaccctcagcagaacaagtaagaaaaggtcttggcccctgaatgaggctatcatggccgtaggcatggtgtccatattggccagctcgctgttaaagaacgatattccaatgactggcccgctcgtcgctgggggactgcttaccgtttgctacgtgctgacgggtcgatcagcagacttggaactcgagcgcgccgcggacgtgcggtgggaagaacaggctgagatctctggcagttcccctatcctgagcattacaatatctgaagatgggagcatgtccatcaaaaatgaggaagaggagcagaccctaactattctgatcagaacaggacttctcgtcatttcaggcctgttccccgtgagtatcccaataaccgccgcagcctggtatttgtgggaagttaagaaacaaagggctggtgtattatgggacgtgcccagccctccacccgtcgggaaggcagagctggaagatggagcctaccgtatcaagcagaaaggcattctcggctattctcagatcggggcgggagtgtacaaggagggtacttttcacacaatgtggcatgttacccgcggcgctgtgctgatgcacaaagggaagcggattgaaccttcctgggccgacgtcaaaaaggatcttatctcatacggaggcggttggaagctggagggggagtggaaagaaggagaggaagtgcaggtattggcactagagccgggcaagaacccaagagccgtccaaacgaaacccggcctgttcaagactaacaccgggacaataggagctgtgagtctcgactttagccctggtacctccggctctccaattgttgataaaaaggggaaggtggtcggactgtatggcaatggtgtggttacaaggtcggggacttacgtgagcgccatcgcacagaccgaaaaatcaatcgaggacaaccccgagattgaagatgacatcttccgaaagaaacggcttacgataatggatttacatcctggagctggcaagacaaaacgctatctgccggccattgtcagagaggcgatcaagaggggcctccggactttgattctggcccccacccgagtggtagcagctgaaatggaggaagccctcagagggctgccaatccgctaccagacccctgctataagggcagagcacacaggacgtgagattgtggaccttatgtgtcatgccactttcaccatgcggctgttgtcccccatcagagttccaaattataacctaatcattatggatgaagcccactttacagaccctgctagtatcgcggcaaggggttacatttctacgcgcgtcgagatgggcgaagccgctgggatattcatgactgccacacccccaggaagccgagacccgtttcctcagtccaatgcacccatcatggatgaggagagagaaattccagagcggtcatggaactctggccacgaatgggtgacagacttcaagggtaaaaccgtgtggtttgtccccagcatcaaggccgggaatgatatcgctgcgtgcctgaggaaaaacggaaagaaagtaattcaactcagtcgcaagactttcgactccgagtatataaagacacgtaccaatgattgggactttgtggttacgactgatatcagcgaaatgggcgccaacttcaaagcagagagagtgattgaccctcggaggtgtatgaagccagtcatcttaacagatggcgaggaacgcgtgattctggctgggcccatgcctgttacccattcttcagccgcacagcgaagaggacgggtgggtaggaatccgaaaaacgagaatgaccagtacatctacatgggcgaaccacttgagaacgatgaagactgcgcccactggaaggaggctaaaatgctgctcgacaatataaacacccccgaggggatcattccttccatgtttgaacccgagcgcgaaaaggtcgatgccatcgacggagagtatagattgaggggcgaagcgcggaaaactttcgtggatctgatgcgtcgcggtgacctcccagtatggctggcataccgagtggccgctgaggggattaactatgccgatagaaggtggtgttttgacggcgttaagaataaccaaatccttgaggaaaatgtcgaggtggaaatatggacaaaggagggagagcggaaaaagctaaaacctcgctggctggatgctagaatttacagtgaccccttggcattaaaggagttcaaagagttcgccgctggcagaaagagcctgaccctcaacctgatcacagaaatggggcggcttccaacttttatgacgcagaaggccaaaaatgcactggataacctcgcggtgttgcataccgccgaggctggaggtcgagcctataatcacgcactgtcggaactacctgagacactggagactctccttctgttaaccttgctggctacagtcaccggcgggattttcctctttctgatgtctggaaagggcatcggtaaaatgactcttgggatgtgctgcataatcacggcctccattctgctctggtacgcacagatccagccgcactggattgccgctagcatcatattggagttctttctgattgttttactaatccccgagccagaaaagcaaagaacccctcaggacaaccagctgacatatgtggtaatcgcgattctcactgtggtcgccgcaaccatggctaatgagatgggcttccttgagaagaccaagaaggattttggactgggctcaatcaccactcagcaacccgagagtaacatattggacattgatctgcgcccagcctctgcctggacactctacgcagtggctacgaccttcatcactcctatgctgaggcattccattgagaatagctcagttaacgtgagtcttacagccatcgcgaatcaggctaccgtcctcatggggctgggaaaaggttggcccttgagcaagatggacataggcgtaccgctgttagccatcgggtgttactcccaggtgaacccaattaccctaacagcagccctgctccttctggttgctcactatgcaatcattggacctggcttgcaggccaaagcgactcgggaagctcaaaagcgtgccgcagccggtatcatgaaaaatcccacggtggacgggatgaccgtcattgatctggacccaatcccctacgatcctaagtttgagaagcagctcggccaggtgatgctgcttgtcttatgcgtgacacaggttctgatgatgagaactacctgggctctctgtgaagccttgacactggcaaccggaccgatatctactctatgggagggcaaccccgggaggttctggaatacgacaattgctgtgagcatggccaacatctttcgcggatcctatctggcgggcgccggtctccttttctcaatcatgaaaaacaccgcaaatactcggcgagggaccggaaacacaggcgaaactctgggtgagaagtggaaaaatagattgaacgctctgggcaagtctgagtttcaaatttacaaaaagagtgggatacaggaagtagacaggaccctcgccaaagagggaatcaagcgcggcgaaacagatcatcacgcagtgtcgcgggggagcgctaagctgagatggttcgtcgagcgtaatttagttacgccagagggaaaagtggtcgaccttggctgcggtagagggggatggtcctattactgtggcggtctgaagaacgtgaaagaagtaaagggcctcaccaaagggggacctggccatgaggaacccattcctatgtctacttatgggtggaatctagtgcggctgcagtcaggagttgatgtgttctttacaccacccgagaagtgcgacaccttgctgtgtgatatcggcgaaagctcccctaacccaactgtcgaggccggtcgcacactccgagtgcttaatctggtcgagaactggttgaataacaatacccaattctgcattaaggtgctgaacccctacatgccgagtgttatcgagaaaatggaggccctccagagaaagtacgggggagcgttagtaaggaatcctctgtctcggaacagcacgcacgaaatgtattgggtgtcaaacgcttccggcaatatagtcagtagcgtgaacatgatctctcgcatgcttattaatagatttaccatgaggcacaaaaaggcaacatacgagccagacgttgatctgggctccgggactcgaaacatcggaattgaatcagagacccccaatctagacatcataggtaaacggattgagaagatcaagcaggaacatgagacaagctggcactatgatcaggaccatccttacaaaacttgggcctatcacggctcgtacgaaaccaagcaaacagggtctgctagttccatggtgaacggagtcgtgcgtctcctgaccaaaccatgggacgtaatccccatggtgactcagatggccatgacggatacaaccccgttcggccagcagagagtttttaaggagaaagtcgacactcgcacccaagaacctaaggagggtacaaagaaattgatgaagattacggcagagtggctgtggaaagaactcgggaagaaaaagacccccaggatgtgtactcgggaggagttcacaagaaaagtgcgcagcaatgccgctcttggagcgatatttaccgatgagaacaagtggaagtcagccagggaggcagtggaagactccggcttctgggagctggtcgataaagaacgaaatttacacctggagggcaagtgcgaaacttgtgtttataacatgatggggaaacgggagaagaaattgggagagtttggtaaggctaagggctctagagccatctggtacatgtggctcggggcaaggttcctggaatttgaggccctaggattccttaatgaagaccattggtttagccgcgagaacagtctgtccggcgtggaaggtgaggggctccacaaactgggatacattttgcgtgatgtaagcaagaaagagggcggcgctatgtatgccgacgatacagcggggtgggacacccggatcacactggaagatctcaagaatgaggaaatggtgactaaccatatggagggagaacacaagaaacttgcagaggccattttcaaactgacctaccagaataaagtcgtgagagttcagaggccaacgcctcgcggtaccgtgatggacatcatatctcgacgggaccagagaggctcagggcaagtcgtgacatatggattaaacactttcaccaacatggaggctcagctgatcaggcagatggaaggcgagggtgtatttaagagtattcaacagttgacagttaaagaagagatcgccgtgaagaattggctcattcgcgtcgggagagagcggctgtccaggatggcaatcagcggagatgactgcgtggtgaaacccctagatgaccgtttcgcttctgcccttactgctctgaacgatatgggcaaggtccgaaaggacattcagcagtgggaaccatcgcgcggctggaatgattggacccaagttcccttttgctcacatcacttccacgagctcataatgaaagacgggagagtgctggtagtgccttgtcggaaccaggatgaattgatcggaagggcccgcattagccagggtgcaggctggtccttaagagagacggcgtgcctggggaagagttacgcccagatgtggtctctcatgtattttcatcggagggaccttcgactggctgccaatgcaatctgtagcgctgtcccatcccactggatcccgacatcacgtaccacttggagtattcatgccacacacgaatggatgaccactgaggatatgctaaccgtgtggaacagagtttggatacaagagaatccctggatggaagacaaaacacctgtggagtcttgggaagagatcccatacctgggaaagcgcgaagatcagtggtgcggcagcctcattggtttgacgtcccgggcaacctgggccaaaaacatccagactgcgattaatcaggtcaggtcactgatcgggaacgaggagtatacagactacatgcccagcatgaagagattccgccgggaagaggaagaggctggagtgctttggtga

SEQ ID NO: 14345 - RNA, 9876 nt, synthetic construct
  misc_feature 1..9876: note = derived and/or modified CDS sequence (opt3) from DENV-2__KM279533__SS-prME
  source 1..9876: mol_type = other RNA
accgccggaatcattataatgatgatccccacagtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgttgcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgaggtgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcagcctcagaccccagcctacggagctgaagtactcctggaaagcctggggcaaggcaaagatgctttcaaccgaattgcacaatcatactttcctgatcgatgggccagagacagcggaatgcccgaacaccaatagggcttggaacagtctcgaggtcgaggactatggatttggcgtgttcacaactaatatatggctgaaattaaaggaacgtcaagatgtattttgtgactctaaactgatgagcgccgcaatcaaggacaaccgggccgtgcacgctgatatgggttactggattgagtccgcccttaacgacacctggaaaatcgaaaaggcatcattcattgaggtcaagagctgccactggcccaaatctcatacgttgtggtccaatggggtgctcgagagtgaaatgatcatacctaagaacttcgctggaccagttagccagcacaattatcgacccggctaccatacacagaccgccggtccttggcacctgggcagactagagatggattttgacttctgtgaagggactaccgtggtagtcacagaggattgcggaaacaggggcccatctctgcgcactaccacagcgtccgggaaactcattacggaatggtgctgtcggtcatgcaccctgcccccgcttagatacaggggagaggacggctgttggtatggtatggagatccgccctttgaaggaaaaagaggaaaatctggtgaacagtttagtgactgccgggcatggacagatcgataattttagcctcggcgtcctgggtatggctcttttcctggaggaaatgttgcgaacacgggttggcaccaagcacgcaattctcctggtggccgtatcgtttgtgactctaatcacagggaacatgtccttccgtgacctgggaagagtcatggtgatggttggcgctaccatgacggatgacattgggatgggagtgacttacctcgccctgcttgcagcgtttaaggtcaggccaaccttcgccgctggcttgctgttacgcaaactcacatctaaggagctgatgatgaccactataggtatcgtgcttctgagccaatcaacaattcccgagagtatcctagaactcaccgatgccctggcattggggatgatggttctgaaaattgtgcggaatatggagaagtatcagttagctgtcacaatcatggccatactctgcgtacctaacgcagtgatcctgcagaatgcctggaaagtttcctgtactacccttgctgtggtctctgtgagccccctgttgctcacgtcctcacaacagaaggcggactggattccactggccctaacaatcaagggactgaaccctaccgcaatttttcttactaccctcagcagaacaagtaaaaagaggtcttggcccctgaatgaagctatcatggccgtaggcatggtgtccatattggccagctcgctgctaaagaacgatattccaatgactggcccgctcgtcgctgggggactgcttaccgtttgctacgtgctgacgggtcgatcagcagacttggagctcgaacgcgccgcggacgtgcggtgggaggagcaggctgaaatctctggcagttcccctatcctgagcattacaatatctgaggatgggagcatgtccatcaagaatgaagaggaggaacagaccctaactattctgatcagaacaggacttctcgtcatttcaggcctgttccccgtgagtatcccaataaccgccgcagcctggtatttgtgggaggttaaaaagcaaagggctggtgtattatgggacgtgcccagccctccacccgtcgggaaagcagaactggaggatggagcctaccgtatcaagcagaagggcattctcggctattctcagatcggggcgggagtgtacaaagaaggtacttttcacacaatgtggcatgttacccgcggcgctgtgctgatgcacaaggggaaacggattgagccttcctgggccgacgtcaagaaagatcttatctcatacggaggcggttggaagctggagggggaatggaaggagggagaagaggtgcaggtattggcactagaaccgggcaaaaacccaagagccgtccaaacgaagcccggcctgttcaaaactaacaccgggacaataggagctgtgagtctcgactttagccctggtacctccggctctccaattgttgataagaaagggaaggtggtcggactgtatggcaatggtgtggttacaaggtcggggacttacgtgagcgccatcgcacagaccgagaagtcaatcgaggacaaccccgaaattgaggatgacatcttccggaaaaagagacttacgataatggatttacatcctggagctggcaaaacaaagcgctatctgccggccattgtcagagaagcgatcaaaaggggcctccggactttgattctggcccccacccgagtggtagcagctgagatggaagaggccctcagagggctgccaatccgctaccagacccctgctataagggcagagcacaccggacgtgaaattgtggaccttatgtgtcatgccactttcaccatgcggctgttgtcccccatcagagttccaaattataacctaatcattatggatgaggcccactttacagaccctgctagtatcgcggcaaggggttacatttctacgcgcgtcgaaatgggcgaggccgctgggatattcatgactgccacacccccaggaagccgagacccgtttcctcagtccaatgcacccatcatggatgaggaaagagagattccagaacggtcatggaactctggccacgagtgggtgacagacttcaagggtaagaccgtgtggtttgtccccagcatcaaagccgggaatgatatcgctgcgtgcctgaggaagaacggcaaaaaggtaattcaactcagtcgcaaaactttcgactccgaatatataaagacacgtaccaatgattgggactttgtggttacgactgatatcagcgagatgggcgccaacttcaaggcagagagagtgattgaccctcggaggtgtatgaaaccagtcatcttaacagatggcgaagaacgcgtgattctggctgggcccatgcctgttacccattcttcagccgcacagcgaagaggacgggtgggtaggaatccgaagaacgaaaatgaccagtacatctacatgggcgagccacttgaaaacgatgaggactgcgcccactggaaagaggctaagatgctgctcgacaatataaacacccccgaagggatcattccttccatgtttgagcccgaacgcgagaaagtcgatgccatcgacggagaatatagattgaggggcgaggcgcggaagactttcgtggatctgatgcgtcgcggtgacctcccagtatggctggcataccgagtggccgctgaggggattaactatgccgatagaaggtggtgttttgacggcgttaaaaataaccaaatccttgaagagaatgtcgaagtggagatatggacaaaggagggagaacggaagaaactaaagcctcgctggctggatgctagaatttacagtgaccccttggcattaaaagagttcaaggagttcgccgctggcaggaaaagcctgaccctcaacctgatcacagagatggggcggcttccaacttttatgacgcagaaggccaagaatgcactggataacctcgcggtgttgcataccgccgaagctggaggtcgagcctataatcacgcactgtcggagctacctgagacactggaaactctccttctgttaaccttgctggctacagtcaccggcgggattttcctctttctgatgtctggaaaaggcatcggtaagatgactcttgggatgtgctgcataatcacggcctccattctgctctggtacgcacagatccagccgcactggattgccgctagcatcatattggagttctttctgattgttttactaatccccgaaccagagaaacaaagaacccctcaggacaaccagctgacatatgtggtaatcgcgattctcactgtggtcgccgcaaccatggctaatgaaatgggcttccttgagaagaccaaaaaggattttggactgggctcaatcaccactcagcaacccgagagtaacatattggacattgatctgcgcccagcctctgcctggacactctacgcagtggctacgaccttcatcactcctatgctgaggcattccattgaaaatagctcagttaacgtgagtcttacagccatcgcgaatcaggctaccgtcctcatggggctgggaaagggttggcccttgagcaaaatggacataggcgtaccgctgttagccatcgggtgttactcccaggtgaacccaattaccctaacagcagccctgctccttctggttgctcactatgcaatcattggacctggcttgcaggccaaggcgactcgggaggctcaaaaacgtgccgcagccggtatcatgaagaatcccacggtggacgggatgaccgtcattgatctggacccaatcccctacgatcctaaatttgaaaagcagctcggccaggtgatgctgcttgtcttatgcgtgacacaggttctgatgatgagaactacctgggctctctgtgaggccttgacactggcaaccggaccgatatctactctatgggaaggcaaccccgggaggttctggaatacgacaattgctgtgagcatggccaacatctttcgcggatcctatctggcgggcgccggtctccttttctcaatcatgaagaacaccgcaaatactcggcgagggaccggaaacacaggcgagactctgggtgagaaatggaagaatagattgaacgctctgggcaaatctgaatttcaaatttacaagaaaagtgggatacaggaggtagacaggaccctcgccaaggaaggaatcaaacgcggcgagacagatcatcacgcagtgtcgcgggggagcgctaagctgagatggttcgtcgagcgtaatttagttacgccagaaggaaaggtggtcgaccttggctgcggtagagggggatggtcctattactgtggcggtctgaaaaacgtgaaggaggtaaaaggcctcaccaaagggggacctggccatgaagaacccattcctatgtctacttatgggtggaatctagtgcggctgcagtcaggagttgatgtgttctttacaccacccgaaaaatgcgacaccttgctgtgtgatatcggcgagagctcccctaacccaactgtcgaggccggtcgcacactccgagtgcttaatctggtcgaaaactggttgaataacaatacccaattctgcattaaggtgctgaacccctacatgccgagtgttatcgagaagatggaagccctccagagaaaatacgggggagcgttagtaaggaatcctctgtctcggaacagcacgcacgagatgtattgggtgtcaaacgcttccggcaatatagtcagtagcgtgaacatgatctctcgcatgcttattaatagatttaccatgaggcacaagaaagcaacatacgaaccagacgttgatctgggctccgggactcgaaacatcggaattgagtcagagacccccaatctagacatcataggtaagcggattgagaaaatcaagcaggagcatgaaacaagctggcactatgatcaggaccatccttacaagacttgggcctatcacggctcgtacgagaccaaacaaacagggtctgctagttccatggtgaacggagtcgtgcgtctcctgaccaagccatgggacgtaatccccatggtgactcagatggccatgacggatacaaccccgttcggccagcagagagtttttaaagaaaaggtcgacactcgcacccaagagcctaaagagggtacaaagaagttgatgaaaattacggcagaatggctgtggaaggagctcgggaaaaagaaaacccccaggatgtgtactcgggaagagttcacaagaaaggtgcgcagcaatgccgctcttggagcgatatttaccgatgagaacaaatggaagtcagccagggaagcagtggaggactccggcttctgggaactggtcgataaggagcgaaatttacacctggaaggcaaatgcgagacttgtgtttataacatgatggggaagcgggagaaaaagttgggagaatttggtaaagctaagggctctagagccatctggtacatgtggctcggggcaaggttcctggagtttgaagccctaggattccttaatgaggaccattggtttagccgcgaaaacagtctgtccggcgtggagggtgaggggctccacaagctgggatacattttgcgtgatgtaagcaaaaaggaaggcggcgctatgtatgccgacgatacagcggggtgggacacccggatcacactggaggatctcaaaaatgaagagatggtgactaaccatatggaaggagagcacaagaaacttgcagaggccattttcaagctgacctaccagaataaggtcgtgagagttcagaggccaacgcctcgcggtaccgtgatggacatcatatctcgacgggaccagagaggctcagggcaagtcgtgacatatggattaaacactttcaccaacatggaagctcagctgatcaggcagatggagggcgaaggtgtatttaaaagtattcaacagttgacagttaaggaggagatcgccgtgaaaaattggctcattcgcgtcgggagagaacggctgtccaggatggcaatcagcggagatgactgcgtggtgaagcccctagatgaccgtttcgcttctgcccttactgctctgaacgatatgggcaaagtccgaaaggacattcagcagtgggagccatcgcgcggctggaatgattggacccaagttcccttttgctcacatcacttccacgaactcataatgaaggacgggagagtgctggtagtgccttgtcggaaccaggatgagttgatcggaagggcccgcattagccagggtgcaggctggtccttaagagaaacggcgtgcctggggaaaagttacgcccagatgtggtctctcatgtattttcatcggagggaccttcgactggctgccaatgcaatctgtagcgctgtcccatcccactggatcccgacatcacgtaccacttggagtattcatgccacacacgagtggatgaccactgagaacatgctaaccgtgtggaatagagtttggatacaagaaaacccctggatggaggataagacacctgtggaatcttgggaggaaatcccatacctgggaaaacgcgaggaccagtggtgcggcagcctcattggtttgacgtcccgggcaacctgggccaagaatatccagactgcgattaaccaggtcaggtcactgatcgggaatgaggaatatacagattacatgcccagcatgaaaagattccgccgggaggaagaggaagctggagtgctttggtga

SEQ ID NO: 14346 - RNA, 9876 nt, synthetic construct
  misc_feature 1..9876: note = derived and/or modified CDS sequence (opt3) from DENV-2__KM279535__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcagcctcagaccccagcctacggagctgaagtactcctggaaagcctggggcaaggcaaagatgctttcaaccgaattgcacaatcatactttcctgatcgatgggccagagacagcggaatgcccgaacaccaatagggcttggaacagtctcgaggtcgaggactatggatttggcgtgttcacaactaatatatggctgaaattaaaggaacgtcaagatgttttttgtgactctaaactgatgagcgccgcaatcaaggacaaccgggccgtgcacgctgatatgggttactggattgagtccgcccttaacgacacctggaaaatcgaaaaggcatcattcattgaggtcaagagctgccactggcccaaatctcatacgttgtggtccaatggggtgctcgagagtgaaatgatcatacctaagaacttcgctggaccagttagccagcacaattatcgacccggctaccatacacagaccgccggtccttggcacctgggcagactagagatggattttgacttctgtgaagggactaccgtggtagtcacagaggattgcggaaacaggggcccatctctgcgcactaccacagcgtccgggaaactcattacggaatggtgctgtcggtcatgcaccctgcccccgcttagatacaggggagaggacggctgttggtatggtatggagatccgccctttgaaggaaaaagaggaaaatctggtgaacagtttagtgactgccgggcatggacagatcgataattttagcctcggcgtcctgggtatggctcttttcctggaggaaatgttgcgaacacgggttggcaccaagcacgcaattctcctggtggccgtatcgtttgtgactctaatcacagggaacatgtccttccgtgacctgggaagagtcatggtgatggttggcgctaccatgacggatgacattgggatgggagtgacttacctcgccctgcttgcagcgtttaaggtcaggccaaccttcgccgctggcttgctgttacgcaaactcacatctaaggagctgatgatgaccactataggtatcgtgcttctgagccaatcaacaattcccgagagtatcctagaactcaccgatgccctggcattggggatgatggttctgaaaattgtgcggaatatggagaagtatcagttagctgtcacaatcatggccatatcctgcgtacctaacgcagtgatcctccagaatgcctggaaagtttcttgtactaccctggctgtggtcagcgtgtccccccttctgttgacgtcaagccaacagaaggcggactggattccactcgccctgacaatcaagggactaaaccctaccgcaatttttctgactacccttagtagaacatctaaaaagaggtcctggcccctcaatgaagctatcatggccgtaggcatggtgagcatactggcctcgtcattgctgaaaaacgatattccaatgactggcccgttagtcgctgggggactcctgaccgtttgctacgtgcttacgggtcgatctgcagacctggagttggaacgcgccgcggacgtgcggtgggaggagcaggctgaaatcagtggctccagccctatcctctctattacaataagcgaggatgggtccatgtcaatcaagaatgaagaggaggaacagaccctgactattctaatcagaacaggactgcttgtcattagtggcctcttccccgtgagcatcccaataaccgccgcagcctggtatctgtgggaggttaaaaagcaaagggctggtgtattgtgggacgtgccctctcctccacccgtcgggaaagcagaattagaggatggagcctaccgtatcaagcagaagggcattctgggctattcccagatcggggcgggagtgtacaaagaaggtacttttcacacaatgtggcatgttacccgcggcgctgtgctcatgcacaaggggaaacggattgagccttcatgggccgacgtcaagaaagatctgatcagttacggaggcggttggaagcttgagggggaatggaaggagggagaagaggtgcaggtactggcattggaaccgggcaaaaacccaagagccgtccaaacgaagcccggcctattcaaaactaacaccgggacaataggagctgtgagcctggacttttcccctggtacctctggctcgccaattgttgataagaaagggaaggtggtcggactctatggcaatggtgtggttacaaggagcgggacttacgtgtcagccatcgcacagaccgagaagtccatcgaggacaaccccgaaattgaggatgacatcttccgaaaaaagcggctgacgataatggatcttcatcctggagctggcaaaacaaagcgctatttaccggccattgtcagagaagcgatcaaaaggggcctgcggactctcattttggcccccacccgagtggtagcagctgagatggaagaggccctgagagggctcccaatccgctaccagacacctgctataagggcagagcacaccggacgtgaaattgtggacctgatgtgtcatgccactttcaccatgcggcttctgagtcccatcagagttccaaattataacttgatcattatggatgaggcccactttacagaccctgcttctatcgcggcaaggggttacattagcacgcgcgtcgaaatgggcgaggccgctgggatattcatgactgccacccccccaggatcccgagacccgtttcctcagtcaaatgcacccatcatggatgaggaaagagagattccagaacggtcttggaacagcggccacgagtgggtgacagacttcaagggtaagaccgtgtggtttgtccccagtatcaaagccgggaatgatatcgctgcgtgcctaaggaagaacggaaaaaaggtaattcaactgtcccgcaaaactttcgacagcgaatatataaagacacgtaccaatgattgggactttgtggttacgactgatatctctgagatgggcgccaacttcaaggcagagagagtgattgaccctcggaggtgtatgaaaccagtcatcctcacagatggcgaagagcgcgtgattttagctgggcccatgcctgttacccattcatccgccgcacagcgaagaggacgggtgggtaggaatccgaagaacgaaaatgaccagtacatctacatgggcgagccactggaaaacgatgaggactgcgcccactggaaagaggctaagatgcttctggacaatataaacacccccgaagggatcattcctagtatgtttgagcccgaacgcgagaaagtcgatgccatcgacggagaatatagactcaggggcgaggcgcggaagactttcgtggatttgatgcgtcgcggtgacctgccagtatggctcgcataccgagtggccgctgaggggattaactatgccgatagaaggtggtgttttgacggcgttaaaaataaccaaatcctggaagagaatgtcgaagtggagatatggacaaaggagggagaacggaagaaacttaagcctcgctggctagatgctagaatttacagcgaccccctggcattgaaagagttcaaggaattcgccgctggcaggaaatcgttaaccctgaacctcatcacagagatggggcggctgccaacttttatgacgcagaaggccaagaatgcacttgataacctggcggtgctccataccgccgaagctggaggtcgagcctataatcacgcattgtctgagctgcctgagacactagaaactctgctccttctgaccttattggctacagtcaccggcgggattttcctgtttctcatgtccggaaaaggcatcggtaagatgactctggggatgtgctgcataatcacggccagcattcttctgtggtacgcacagatccagccgcactggattgccgcttcaatcatactcgagttctttttgattgttctgttaatccccgaaccagagaaacaaagaacccctcaggacaaccagctaacatatgtggtaatcgcgattctgactgtggtcgccgcaaccatggctaatgaaatgggcttcctcgagaagacaaaaaaggattttggacttggcagtatcaccactcagcaacccgagtctaacatactggacattgatttgcgcccagcctccgcctggacactgtacgcagtggctacgaccttcatcactcctatgctcaggcatagcattgaaaattcaagtgttaacgtgagcctgacagccatcgcgaatcaggctaccgtccttatggggctcggaaagggttggcccctgtccaaaatggacataggcgtaccgttgctggccatcgggtgttactctcaggtgaacccaattaccttaacagcagccctactgctccttgttgctcactatgcaatcattggacctggcctgcaggccaaggcgactcgggaggctcaaaaacgtgccgcagccggtatcatgaagaatcccacggtggacgggatgaccgtcattgatttggacccaatcccctacgatcctaaatttgaaaagcagctgggccaggtgatgctcctggtcctttgcgtgacacaggttttaatgatgagaactacctgggctctgtgtgaggccctcacattggcaaccggaccgataagcactctgtgggaaggcaaccccgggaggttctggaatacgacaattgctgtgtccatggccaacatctttcgcggatcatatctagcgggcgccggtctgctcttctctatcatgaagaacaccgcaaatactcggcgagggaccggaaacacaggcgagactcttggtgagaaatggaagaatagactgaacgctttgggcaaaagtgaatttcaaatttacaagaaatcggggatacaggaggtagacaggaccctggccaaggaaggaatcaaacgcggcgagacagatcatcacgcagtgagccgggggtccgctaagctcagatggttcgtcgagcgtaatctggttacgccagaaggaaaggtggtcgacttaggctgcggtagggggggatggtcttattactgtggcggtcttaaaaacgtgaaggaggtaaaaggcctgaccaaggggggacctggccatgaagagcccattcctatgtcaacttatgggtggaatctcgtgcggctacagagcggagttgatgtgttctttacaccacccgaaaaatgcgacaccctgttgtgtgatatcggcgagtccagtcctaacccaactgtcgaggccggtcgcacactgcgagtgctcaatcttgtcgaaaactggctgaataacaatacccaattctgcattaaggtgttgaacccctacatgccgtctgttatcgagaagatggaagccctgcagagaaaatacgggggagcgctcgtaaggaatcctttaagccggaactcaacgcacgagatgtattgggtgtccaacgctagtggcaatatagtcagctctgtgaacatgatctcccgcatgctgattaatagatttaccatgaggcacaagaaagcaacatacgaaccagacgttgatcttggctcagggactcgaaacatcggaattgagagcgagacccccaatctggacatcataggtaagcggattgaaaaaatcaagcaggagcatgaaacatcgtggcactatgatcaggaccatccttacaagacttgggcctatcacggctcttacgagaccaaacaaacagggagtgcttccagcatggtgaacggagtcgtgcgtctactcaccaagccatgggacgtaatccccatggtgactcagatggccatgacggatacaaccccgttcggccagcagagagtttttaaagaaaaggtcgacactcgcacccaagagcctaaagagggtacaaagaagctgatgaaaattacggcagaatggttgtggaaggagctggggaaaaagaaaacccccaggatgtgtactcgggaagagttcacaagaaaggtgcgctcaaatgccgctctcggagcgatatttaccgatgagaacaaatggaagtccgccagggaagcagtggaggactctggcttctgggaacttgtcgataaggagcgaaatctgcacttagaaggcaaatgcgagacttgtgtttataacatgatggggaagcgggagaaaaagctgggagaatttggtaaagctaagggcagcagagccatctggtacatgtggttgggggcaaggttcctcgagtttgaagccctgggattcctaaatgaggaccattggtttagtcgcgaaaactcccttagcggcgtggagggtgaggggctgcacaagctcggatacattctgcgtgatgtatctaaaaaggaaggcggcgctatgtatgccgacgatacagcggggtgggacacccggatcacattggaggatctgaaaaatgaagagatggtgactaaccatatggaaggagagcacaagaaactcgcagaggccattttcaagcttacctaccagaataaggtcgtgagagttcagaggccaacgcctcgcggtaccgtgatggacatcatatcacgacgggaccagagaggcagtgggcaagtcgtgacatatggactgaacactttcaccaacatggaagctcagttaatcaggcagatggagggcgaaggtgtatttaaatccattcaacagctgacagttaaggaggagatcgccgtgaaaaattggttgattcgcgtcgggagagaacggctcagcaggatggcaatctctggagatgactgcgtggtgaagcccctggatgaccgtttcgcttcggccctaactgctcttaacgatatgggcaaagtccgaaaggacattcagcagtgggagccatcacgcggctggaatgattggacccaagttcccttttgcagccatcacttccacgaactgataatgaaggacgggagagtgctcgtagtgccttgtcggaaccaggatgagctgatcggaagggcccgcatttcccagggtgcaggctggagtttgagagaaacggcgtgcttagggaaatcttacgcccagatgtggagcctgatgtattttcatcggagggacctccgacttgctgccaatgcaatctgttccgctgtcccatcacactggatcccgacaagtcgtaccacttggtctattcatgccacacacgagtggatgaccactgaggatatgctgaccgtgtggaacagagtttggatacaagaaaatccctggatggaggacaagacacctgtggaaagctgggaggaaatcccatacctaggaaaacgcgaggatcagtggtgcggctccctgattggtctcacgtcacgggcaacctgggccaagaacatccagactgcgattaatcaggtcaggagcttgatcgggaacgaggaatatacagactacatgccctctatgaaaagattccgccgggaggaagaggaagctggagtgctgtggtga

SEQ ID NO: 14347 - RNA, 9876 nt, synthetic construct
  misc_feature 1..9876: note = derived and/or modified CDS sequence (opt3) from DENV-2__KM279539__SS-prME
  source 1..9876: mol_type = other RNA
accgccggcatcattataatgatgatccccacagtgatggctttccacctgactacgaggaacggggaacctcatatgattgtcagcaggcaggaaaagggaaaatccctcctttttaagaccgaaaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgttgcgctcgtgccccatgtcggcatgggtctggagactaggaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcagcctcagaccccagcctacggagctgaagtactcctggaaagcctggggcaaggcaaagatgctttcaaccgaattgcacaatcatactttcctgatcgatgggccagagacagcggaatgcccgaacaccaatagggcttggaacagtctcgaggtcgaggactatggatttggcgtgttcacaactaatatatggctgaaattaaaggaacgtcaagatgtattttgtgactctaaactgatgagcgccgcaatcaaggacaaccgggccgtgcacgctgatatgggttactggattgagtccgcccttaacgacacctggaaaatcgaaaaggcatcattcattgaggtcaagagctgccactggcccaaatctcatacgttgtggtccaatggggtgctcgagagtgaaatgatcatacctaagaacttcgctggaccagttagccagcacaattatcgacccggctaccatacacagaccgccggtccttggcacctgggcagactagagatggattttgacttctgtgaagggactaccgtggtagtcacagaggattgcggaaacaggggcccatctctgcgcactaccacagcgtccgggaaactcattacggaatggtgctgtcggtcatgcaccctgcccccgcttagatacaggggagaggacggctgttggtatggtatggagatccgccctttgaaggaaaaagaggaaaatctggtgaacagtttagtgactgccgggcatggacagatcgataattttagcctcggcgtcctgggtatggctcttttcctggaggaaatgttgcgaacacgggttggcaccaagcacgcaattctcctggtggccgtatcgtttgtgactctaatcacagggaacatgtccttccgtgacctgggaagagtcatggtgatggttggcgctaccatgacggatgacattgggatgggagtgacttacctcgccctgcttgcagcgtttaaggtcaggccaaccttcgccgctggcttgctgttacgcaaactcacatctaaggagctgatgatgaccactataggtatcgtgcttctgagccaatcaacaattcccgagagtatcctagaactcaccgatgccctggcattggggatgatggttctgaaaattgtgcggaatatggagaagtatcagttagctgtcacaatcatggccatactctgcgtacctaacgcagtgatcctgcagaatgcctggaaagtttcctgtactacccttgctgtggtctctgtgagccccctgttgctcacgtcctcacaacagaaggcggactggattccactggccctaacaatcaagggactgaaccctaccgcaatttttcttactaccctcagcagaacaagtaaaaagaggtcttggcccctgaatgaagctatcatggccgtaggcatggtgtccatattggccagctcgctgctaaagaacgatattccaatgactggcccgctcgtcgctgggggactgcttaccgtttgctacgtgctgacgggtcgatcagcagacttggagctcgaacgcgccgcggacgtgcggtgggaggagcaggctgaaatctctggcagttcccctatcctgagcattacaatatctgaggatgggagcatgtccatcaagaatgaagaggaggaacagaccctaactattctgatcagaacaggacttctcgtcatttcaggcctgttccccgtgagtatcccaataaccgccgcagcctggtatttgtgggaggttaaaaagcaaagggctggtgtattatgggacgtgcccagccctccacccgtcgggaaagcagaactggaggatggagcctaccgtatcaagcagaagggcattctcggctattctcagatcggggcgggagtgtacaaagaaggtacttttcacacaatgtggcatgttacccgcggcgctgtgctgatgcacaaggggaaacggattgagccttcctgggccgacgtcaagaaagatcttatctcatacggaggcggttggaagctggagggggaatggaaggagggagaagaggtgcaggtattggcactagaaccgggcaaaaacccaagagccgtccaaacgaagcccggcctgttcaaaactaacaccgggacaataggagctgtgagtctcgactttagccctggtacctccggctctccaattgttgataagaaagggaaggtggtcggactgtatggcaatggtgtggttacaaggtcggggacttacgtgagcgccatcgcacagaccgaggagtcaatcgaagacaaccccgagattgaagatgacatcttccgaaagaaacggcttacgataatggatttacatcctggagctggcaagacaaaacgctatctgccggccattgtcagagaggcgatcaagaggggcctccggactttgattctggcccccacccgagtggtagcagctgaaatggaggaggccctcagagggctgccaatccgctaccagacccctgctataagggcagaacacaccggacgtgagattgtggaccttatgtgtcatgccactttcaccatgcggctgttgtcccccatcagagttccaaattataacctaatcattatggatgaagcccactttacagaccctgctagtatcgcggcaaggggttacatttctacgcgcgtcgagatgggcgaggccgctgggatattcatgactgccacacccccaggaagccgagacccgtttcctcagtccaatgcacccatcatggatgaagagagagaaattccagagcggtcatggaactctggccacgaatgggtgacagacttcaaaggtaagaccgtgtggtttgtccccagcatcaaggccgggaatgatatcgctgcgtgcctgaggaaaaacggaaagaaagtaattcaactcagtcgcaagactttcgactccgagtatataaaaacacgtaccaatgattgggactttgtggttacgactgatatcagcgagatgggcgccaacttcaaggcagaaagagtgattgaccctcggaggtgtatgaagccagtcatcttaacagatggcgaggaacgcgtgattctggctgggcccatgcctgttacccattcttcagccgcacagcgaagaggacgggtgggtaggaatccgaaaaacgagaatgaccagtacatctacatgggcgaaccacttgagaacgatgaggactgcgcccactggaaggaagctaaaatgctgctcgacaatataaacacccccgaggggatcattccttccatgtttgaacccgagcgcgaaaaggtcgatgccatcgacggagagtatagattgaggggcgaggcgcggaaaactttcgtggatctgatgcgtcgcggtgacctcccagtatggctggcataccgagtggccgctgaagggattaactatgccgatagaaggtggtgttttgacggcgttaagaataaccaaatccttgaggaaaatgtcgaggtggagatatggacaaaagaaggagagcggaagaagctaaaacctcgctggctggatgctagaatttacagtgaccccttggcattaaaggagttcaaagagttcgccgctggcagaaagagcctgaccctcaacctgatcacagaaatggggcggcttccaacttttatgacgcagaaagccaagaatgcactggataacctcgcggtgttgcataccgccgaggctggaggtcgagcctataatcacgcactgtcggagctacctgaaacactggagactctccttctgttaaccttgctggctacagtcaccggcgggattttcctctttctgatgtctggaaagggcatcggtaaaatgactcttgggatgtgctgcataatcacggcctccattctgctctggtacgcacagatccagccgcactggattgccgctagcatcatattggagttctttctgattgttttactaatccccgagccagaaaagcaaagaacccctcaggacaaccagctgacatatgtggtaatcgcgattctcactgtggtcgccgcaaccatggctaatgagatgggcttccttgagaaaacaaagaaagattttggactgggctcaatcaccactcagcaacccgaaagtaacatattggacattgatctgcgcccagcctctgcctggacactctacgcagtggctacgaccttcatcactcctatgctgaggcattccattgagaatagctcagttaacgtgagtcttacagccatcgcgaatcaggctaccgtcctcatggggctgggaaagggttggcccttgagcaagatggacataggcgtaccgctgttagccatcgggtgttactcccaggtgaacccaattaccctaacagcagccctgctccttctggttgctcactatgcaatcattggacctggcttgcaggccaaagcgactcgggaagctcaaaagcgtgccgcagccggtatcatgaaaaatcccacggtggacgggatgaccgtcattgatctggacccaatcccctacgatcctaagtttgagaaacagctcggccaggtgatgctgcttgtcttatgcgtgacacaggttctgatgatgagaactacctgggctctctgtgaagccttgacactggcaaccggaccgatatctactctatgggagggcaaccccgggaggttctggaatacgacaattgctgtgagcatggccaacatctttcgcggatcctatctggcgggcgccggtctccttttctcaatcatgaagaacaccgcaaatactcggcgagggaccggaaacacaggcgagactctgggtgaaaagtggaaaaatagattgaacgctctgggcaagtctgagtttcaaatttacaaaaagagtgggatacaggaagtagacaggaccctcgccaaagagggaatcaagcgcggcgagacagatcatcacgcagtgtcgcgggggagcgctaaactgagatggttcgtcgaacgtaatttagttacgccagagggaaaggtggtcgaccttggctgcggtagagggggatggtcctattactgtggcggtctgaagaacgtgaaagaagtaaagggcctcaccaaagggggacctggccatgaggaacccattcctatgtctacttatgggtggaatctagtgcggctgcagtcaggagttgatgtgttctttacaccacccgagaagtgcgacaccttgctgtgtgatatcggcgagagctcccctaacccaactgtcgaagccggtcgcacactccgagtgcttaatctggtcgagaactggttgaataacaatacccaattctgcattaaagtgctgaacccctacatgccgagtgttatcgaaaagatggaggccctccagagaaagtacgggggagcgttagtaaggaatcctctgtctcggaacagcacgcacgaaatgtattgggtgtcaaacgcttccggcaatatagtcagtagcgtgaacatgatctctcgcatgcttattaatagatttaccatgaggcacaaaaaggcaacatacgagccagacgttgatctgggctccgggactcgaaacatcggaattgagtcagaaacccccaatctagacatcataggtaaacggattgagaagatcaaacaggaacatgagacaagctggcactatgatcaggaccatccttacaagacttgggcctatcacggctcgtacgaaaccaagcaaacagggtctgctagttccatggtgaacggagtcgtgcgtctcctgaccaaaccatgggacgtaatccccatggtgactcagatggccatgacggatacaaccccgttcggccagcagagagtttttaaggagaaagtcgacactcgcacccaagagcctaaggaaggtaccaaaaagttgatgaagattacggcagagtggctgtggaaagaactcgggaagaaaaagacccccaggatgtgtactcgggaggagttcacaagaaaagtgcgcagcaatgccgctcttggagcgatatttaccgatgaaaacaagtggaaatcagccagggaggcagtggaagactccggcttctgggagctggtcgataaggaacgaaatttacacctggagggcaagtgcgagacttgtgtttataacatgatggggaaacgggaaaagaaattgggagagtttggtaaggctaaaggctctagagccatctggtacatgtggctcggggcaaggttcctggaatttgaggccctaggattccttaatgaagaccattggtttagccgcgagaacagtctgtccggcgtggagggtgaagggctccacaagctgggatacattttgcgtgatgtaagcaagaaagagggcggcgctatgtatgccgacgatacagcggggtgggacacccggatcacactggaagatctcaagaatgaggaaatggtgactaaccatatggagggagagcacaagaaacttgcagaagccattttcaaactgacctaccagaataaagtcgtgagagttcagaggccaacgcctcgcggtaccgtgatggacatcatatctcgacgggaccagagaggctcagggcaagtcgtgacatatggattaaacactttcaccaacatggaggctcagctgatcaggcagatggaaggcgagggtgtatttaagagtattcaacagttgacagttaaagaggaaatcgccgtgaagaattggctcattcgcgtcgggagagagcggctgtccaggatggcaatcagcggagatgactgcgtggtgaaacccctagatgaccgtttcgcttctgcccttactgctctgaacgatatgggcaaggtccgaaaagacattcagcagtgggaaccatcgcgcggctggaatgattggacccaagttcccttttgctcacatcacttccacgagctcataatgaaggacgggagagtgctggtagtgccttgtcggaaccaggatgaattgatcggaagggcccgcattagccagggtgcaggctggtccttaagagagacggcgtgcctggggaagagttacgcccagatgtggtctctcatgtattttcatcggagggaccttcgactggctgccaatgcaatctgtagcgctgtcccatcccactggatcccgacatcacgtaccacttggagtattcatgccacacacgagtggatgaccactgaagatatgctaaccgtgtggaacagagtttggatacaagagaatccctggatggaagacaaaacacctgtggagtcttgggaagagatcccatacctgggaaagcgcgaggatcagtggtgcggcagcctcattggtttgacgtcccgggcaacctgggccaaaaacatccagactgcgattaatcaggtcaggtcactgatcgggaacgaagagtatacagactacatgcccagcatgaagagattccgccgggaagaggaagaggctggagtgctttggtga

SEQ ID NO: 14348 - RNA, 9876 nt, synthetic construct
  misc_feature 1..9876: note = derived and/or modified CDS sequence (opt3) from DENV-2__KM279543__SS-prME
  source 1..9876: mol_type = other RNA
accgccggaatcattataatgatgatccccacagtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgtggcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgaggtgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcatgtttaccagcataggtaaagctctgcatcaagtcttcggggcgatctatggcgcagccttttccggagtgtcttggacaatgaagattcttatcggcgttgtgattacttggatcgggatgaatagcagatcaaccagtttgtccgtcagcctggtgctcgtaggagtggttacgctgtaccttggcgtcatggtgcaggctgactctggttgtgtggtctcatggaaaaacaaggagctgaaatgcgggagtggaatattcatcacagataatgttcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtgaaactaaccattatgacaggcgacatcaaggggattatgcaggctggaaaacgcagcctcagaccccagcctacggagctgaagtactcctggaaagcctggggcaaggcaaagatgctttcaaccgaattgcacaatcatactttcctgatcgatgggccagagacagcggaatgcccgaacaccaatagggcttggaacagtctcgaggtagaggactatggatttggcgtcttcacaactaatatatggctgaaattaaaggaacgtcaagatgtgttttgtgactctaaactgatgagcgccgcaatcaaggacaaccgggccgttcacgctgatatgggttactggattgagtccgcccttaacgacacctggaaaatcgaaaaggcatcattcattgaggtaaagagctgccactggcccaaatctcatacgttgtggtccaatggggtcctcgagagtgaaatgatcatacctaagaacttcgctggaccagtgagccagcacaattatcgacccggctaccatacacagaccgccggtccttggcacctgggcagactagagatggattttgacttctgtgaagggactaccgttgtggtaacagaggattgcggaaacaggggcccatctctgcgcactaccacagcgtccgggaaactcattacggaatggtgctgtcggtcatgcaccctgcccccgcttagatacaggggagaggacggctgttggtatggtatggagatccgccctttgaaggaaaaagaggaaaatctggtcaacagtttagtgactgccgggcatggacagatcgataattttagcctcggcgtgctgggtatggctcttttcctggaggaaatgttgcgaacacgggtcggcaccaagcacgcaattctcctggttgccgtgtcgtttgtaactctaatcacagggaacatgtccttccgtgacctgggaagagtgatggtcatggtgggcgctaccatgacggatgacattgggatgggagttacttacctcgccctgcttgcagcgtttaaggtgaggccaaccttcgccgctggcttgctgttacgcaaactcacatctaaggagctgatgatgaccactataggtatcgtccttctgagccaatcaacaattcccgagagtatcctagaactcaccgatgccctggcattggggatgatggtgctgaaaattgttcggaatatggagaagtatcagttagctgtgacaatcatggccatactctgcgtccctaacgcagtaatcctgcagaatgcctggaaagtgtcctgtactacccttgctgttgtgtctgtcagccccctgttgctcacgtcctcacaacagaaggcggactggattccactggccctaacaatcaagggactgaaccctaccgcaatttttcttactaccctcagcagaacaagtaaaaagaggtcttggcccctgaatgaagctatcatggccgtgggcatggtatccatattggccagctcgctgctaaagaacgatattccaatgactggcccgctcgtggctgggggactgcttaccgtctgctacgttctgacgggtcgatcagcagacttggagctcgaacgcgccgcggacgtgcggtgggaggagcaggctgaaatctctggcagttcccctatcctgagcattacaatatctgaggatgggagcatgtccatcaagaatgaagaggaggaacagaccctaactattctgatcagaacaggacttctcgtgatttcaggcctgttccccgtcagtatcccaataaccgccgcagcctggtatttgtgggaggtgaaaaagcaaagggctggtgttttatgggacgtacccagccctccacccgtggggaaagcagaactggaggatggagcctaccgtatcaagcagaagggcattctcggctattctcagatcggggcgggagtctacaaagaaggtacttttcacacaatgtggcatgtgacccgcggcgctgttctgatgcacaaggggaaacggattgagccttcctgggccgacgtgaagaaagatcttatctcatacggaggcggttggaagctggagggggaatggaaggagggagaagaggtccaggtgttggcactagaaccgggcaaaaacccaagagccgtacaaacgaagcccggcctgttcaaaactaacaccgggacaataggagctgtcagtctcgactttagccctggtacctccggctctccaattgtggataagaaagggaaggttgtgggactgtatggcaatggtgtcgtgacaaggtcggggacttacgttagcgccatcgcacagaccgagaagtcaatcgaggacaaccccgaaattgaggatgacatcttccggaaaaagagacttacgataatggatttacatcctggagctggcaaaacaaagcgctatctgccggccattgtgagagaagcgatcaaaaggggcctccggactttgattctggcccccacccgagtcgtggcagctgagatggaagaggccctcagagggctgccaatccgctaccagacccctgctataagggcagagcacaccggacgtgaaattgtagaccttatgtgtcatgccactttcaccatgcggctgttgtcccccatcagagtgccaaattataacctaatcattatggatgaggcccactttacagaccctgctagtatcgcggcaaggggttacatttctacgcgcgttgaaatgggcgaggccgctgggatattcatgactgccacacccccaggaagccgagacccgtttcctcagtccaatgcacccatcatggatgaggaaagagagattccagaacggtcatggaactctggccacgagtgggtcacagacttcaagggtaagaccgtgtggtttgtgcccagcatcaaagccgggaatgatatcgctgcgtgcctgaggaagaacggcaaaaaggtcattcaactcagtcgcaaaactttcgactccgaatatataaagacacgtaccaatgattgggactttgtagtgacgactgatatcagcgagatgggcgccaacttcaaggcagagagagttattgaccctcggaggtgtatgaaaccagtgatcttaacagatggcgaagaacgcgtcattctggctgggcccatgcctgtgacccattcttcagccgcacagcgaagaggacgggttggtaggaatccgaagaacgaaaatgaccagtacatctacatgggcgagccacttgaaaacgatgaggactgcgcccactggaaagaggctaagatgctgctcgacaatataaacacccccgaagggatcattccttccatgtttgagcccgaacgcgagaaagtggatgccatcgacggagaatatagattgaggggcgaggcgcggaagactttcgtcgatctgatgcgtcgcggtgacctcccagtgtggctggcataccgagtagccgctgaggggattaactatgccgatagaaggtggtgttttgacggcgtgaaaaataaccaaatccttgaagagaatgttgaagtcgagatatggacaaaggagggagaacggaagaaactaaagcctcgctggctggatgctagaatttacagtgaccccttggcattaaaagagttcaaggagttcgccgctggcaggaaaagcctgaccctcaacctgatcacagagatggggcggcttccaacttttatgacgcagaaggccaagaatgcactggataacctcgcggtgttgcataccgccgaagctggaggtcgagcctataatcacgcactgtcggagctacctgagacactggaaactctccttctgttaaccttgctggctacagtgaccggcgggattttcctctttctgatgtctggaaaaggcatcggtaagatgactcttgggatgtgctgcataatcacggcctccattctgctctggtacgcacagatccagccgcactggattgccgctagcatcatattggagttctttctgattgtcttactaatccccgaaccagagaaacaaagaacccctcaggacaaccagctgacatatgttgtgatcgcgattctcactgtagtggccgcaaccatggctaatgaaatgggcttccttgagaagaccaaaaaggattttggactgggctcaatcaccactcagcaacccgagagtaacatattggacattgatctgcgcccagcctctgcctggacactctacgcagtcgctacgaccttcatcactcctatgctgaggcattccattgaaaatagctcagtgaacgttagtcttacagccatcgcgaatcaggctaccgtgctcatggggctgggaaagggttggcccttgagcaaaatggacataggcgtcccgctgttagccatcgggtgttactcccaggtaaacccaattaccctaacagcagccctgctccttctggtggctcactatgcaatcattggacctggcttgcaggccaaggcgactcgggaggctcaaaaacgtgccgcagccggtatcatgaagaatcccacggttgacgggatgaccgtgattgatctggacccaatcccctacgatcctaaatttgaaaagcagctcggccaggtcatgctgcttgtgttatgcgtcacacaggtgctgatgatgagaactacctgggctctctgtgaggccttgacactggcaaccggaccgatatctactctatgggaaggcaaccccgggaggttctggaatacgacaattgctgttagcatggccaacatctttcgcggatcctatctggcgggcgccggtctccttttctcaatcatgaagaacaccgcaaatactcggcgagggaccggaaacacaggcgagactctgggtgagaaatggaagaatagattgaacgctctgggcaaatctgaatttcaaatttacaagaaaagtgggatacaggaggtggacaggaccctcgccaaggaaggaatcaaacgcggcgagacagatcatcacgcagtatcgcgggggagcgctaagctgagatggttcgtggagcgtaatttagtcacgccagaaggaaaggttgtggaccttggctgcggtagagggggatggtcctattactgtggcggtctgaaaaacgtcaaggaggtgaaaggcctcaccaaagggggacctggccatgaagaacccattcctatgtctacttatgggtggaatctagtacggctgcagtcaggagtggatgttttctttacaccacccgaaaaatgcgacaccttgctgtgtgatatcggcgagagctcccctaacccaactgtggaggccggtcgcacactccgagtccttaatctggtggaaaactggttgaataacaatacccaattctgcattaaggtcctgaacccctacatgccgagtgtgatcgagaagatggaagccctccagagaaaatacgggggagcgttagttaggaatcctctgtctcggaacagcacgcacgagatgtattgggtatcaaacgcttccggcaatatagtgagtagcgtcaacatgatctctcgcatgcttattaatagatttaccatgaggcacaagaaagcaacatacgaaccagacgtggatctgggctccgggactcgaaacatcggaattgagtcagagacccccaatctagacatcataggtaagcggattgagaaaatcaagcaggagcatgaaacaagctggcactatgatcaggaccatccttacaagacttgggcctatcacggctcgtacgagaccaaacaaacagggtctgctagttccatggttaacggagtggtccgtctcctgaccaagccatgggacgtgatccccatggtaactcagatggccatgacggatacaaccccgttcggccagcagagagtgtttaaagaaaaggttgacactcgcacccaagagcctaaagagggtacaaagaagttgatgaaaattacggcagaatggctgtggaaggagctcgggaaaaagaaaacccccaggatgtgtactcgggaagagttcacaagaaaggtccgcagcaatgccgctcttggagcgatatttaccgatgagaacaaatggaagtcagccagggaagcagtggaggactccggcttctgggaactggtggataaggagcgaaatttacacctggaaggcaaatgcgagacttgtgtctataacatgatggggaagcgggagaaaaagttgggagaatttggtaaagctaagggctctagagccatctggtacatgtggctcggggcaaggttcctggagtttgaagccctaggattccttaatgaggaccattggtttagccgcgaaaacagtctgtccggcgttgagggtgaggggctccacaagctgggatacattttgcgtgatgtgagcaaaaaggaaggcggcgctatgtatgccgacgatacagcggggtgggacacccggatcacactggaggatctcaaaaatgaagagatggtaactaaccatatggaaggagagcacaagaaacttgcagaggccattttcaagctgacctaccagaataaggtggtcagagtgcagaggccaacgcctcgcggtaccgttatggacatcatatctcgacgggaccagagaggctcagggcaagtggtcacatatggattaaacactttcaccaacatggaagctcagctgatcaggcagatggagggcgaaggtgtgtttaaaagtattcaacagttgacagtaaaggaggagatcgccgttaaaaattggctcattcgcgtggggagagaacggctgtccaggatggcaatcagcggagatgactgcgtcgtgaagcccctagatgaccgtttcgcttctgcccttactgctctgaacgatatgggcaaagtgcgaaaggacattcagcagtgggagccatcgcgcggctggaatgattggacccaagtccccttttgctcacatcacttccacgaactcataatgaaggacgggagagttctggtggtaccttgtcggaaccaggatgagttgatcggaagggcccgcattagccagggtgcaggctggtccttaagagaaacggcgtgcctggggaaaagttacgcccagatgtggtctctcatgtattttcatcggagggaccttcgactggctgccaatgcaatctgtagcgctgtgccatcccactggatcccgacatcacgtaccacttggagtattcatgccacacacgagtggatgaccactgaggatatgctaaccgtctggaacagagtgtggatacaagaaaatccctggatggaggacaagacacctgttgaatcttgggaggaaatcccatacctgggaaaacgcgaggatcagtggtgcggcagcctcattggtttgacgtcccgggcaacctgggccaagaacatccagactgcgattaatcaggtgaggtcactgatcgggaacgaggaatatacagactacatgcccagcatgaaaagattccgccgggaggaagaggaagctggagtcctttggtga

SEQ ID NO: 14349 - RNA, 9876 nt, synthetic construct
  misc_feature 1..9876: note = derived and/or modified CDS sequence (opt3) from DENV-2__KM279571__SS-prME
  source 1..9876: mol_type = other RNA
accgccggcatcattataatgatgatccccacagtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcacgctcagaccccagcctaccgagctgaagtacagctggaaagcctggggcaaggcaaagatgctttccactgaattgcacaatcatacattcctgatcgatgggccagagaccgcggaatgcccgaacacaaatagggcttggaactcactcgaggtcgaggactatggatttggcgtgttcactaccaatatatggctgaaattaaaggaacgtcaagatgtattttgtgacagtaaactgatgtctgccgcaatcaaggacaaccgggccgtgcacgctgatatgggttactggattgagagcgcccttaacgacacgtggaaaatcgaaaaggcatccttcattgaggtcaagtcatgccactggcccaaaagccatacattgtggtctaatggggtgctcgagtccgaaatgatcatacctaagaacttcgctggaccagttagtcagcacaattatcgacccggctaccatacccagactgccggtccttggcacctgggcagactagagatggattttgacttctgtgaagggaccacagtggtagtcactgaggattgcggaaacaggggcccaagcctgcgcaccacaacggcgtctgggaaactcattaccgaatggtgctgtcggtcctgcactctgcccccgcttagatacaggggagaggacggctgttggtatggtatggagatccgccctttgaaggaaaaagaggaaaatctggtgaactcattagtgacagccgggcatggacagatcgataattttagtctcggcgtcctgggtatggctcttttcctggaggaaatgttgcgaacccgggttggcactaagcacgcaattctcctggtggccgttagctttgtgacactaatcaccgggaacatgtcgttccgtgacctgggaagagtcatggtgatggttggcgctacgatgactgatgacattgggatgggagtgacctacctcgccctgcttgcagcgtttaagataaggccaacattcgccgctggcttgctgttacgcaaactcacctccaaggagctgatgatgactacaatcggtattgtccttctgtctcaaagcaccatccccgagtcaattctagaactcacagatgccctggcattggggatgatggtgctgaaaatcgttcggaatatggagaagtatcagttagctgtgactataatggccatcctctgcgtccctaacgcagtaattctgcagaatgcctggaaagtgagttgtaccacgcttgctgttgtgtccgtctctcccctgttgctcacaagctcccaacagaaggcggactggatcccactggccctaaccattaagggactgaaccctactgcaatctttcttaccacactctcaagaactagcaaaaagaggagttggcccctgaatgaagctataatggccgtgggcatggtatctattttggcctccagcctgctaaagaacgatatcccaatgaccggcccgctcgtggctgggggactgcttacggtctgctacgttctgacaggtcgatcggcagacttggagctcgaacgcgccgcggacgtgcggtgggaggagcaggctgaaatctcaggctctagtcctattctgtccataaccatcagcgaggatgggtctatgagcattaagaatgaagaggaggaacagactctaacaatcctgattagaaccggacttctcgtgatctccggcctgttccccgtctcaataccaatcactgccgcagcctggtatttgtgggaggtgaaaaagcaaagggctggtgttttatgggacgtacccagtcctccacccgtggggaaagcagaactggaggatggagcctaccgtattaagcagaagggcatcctcggctatagccagattggggcgggagtctacaaagaaggtacatttcacaccatgtggcatgtgacgcgcggcgctgttctgatgcacaaggggaaacggatcgagccttcttgggccgacgtgaagaaagatcttatatcctacggaggcggttggaagctggagggggaatggaaggagggagaagaggtccaggtgttggcactagaaccgggcaaaaacccaagagccgtacaaactaagcccggcctgttcaaaaccaacacagggaccattggagctgtctcactcgactttagtcctggtacaagcggctccccaatcgtggataagaaagggaaggttgtgggactgtatggcaatggtgtcgtgactaggtctgggacctacgtttcggccatcgcacagacggaaaagagcattgaggacaaccccgaaatcgaggatgacatattcagaaagaagcggcttacaattatggatttacatcctggagctggcaaaactaagcgctatctgccggccatcgtgagagaagcgattaaaaggggcctccggaccttgatcctggcccccacacgagtcgtggcagctgagatggaagaggccctcagagggctgccaatacgctaccagacccctgctattagggcagagcacactggacgtgaaatcgtagaccttatgtgtcatgccaccttcacaatgcggctgttgtcacccatcagagtgccaaattataacctaattatcatggatgaggcccactttacggaccctgcttccattgcggcaaggggttacataagtactcgcgttgaaatgggcgaggccgctgggatcttcatgaccgccacacccccaggatctcgagacccgtttcctcagagcaatgcacccattatggatgaggaaaaggagatcccagaaagatcctggaactcaggccacgagtgggtcaccgacttcaagggtaaaactgtgtggtttgtgccctctatcaaggccgggaatgatattgctgcgtgcctgcggaaaaacggaaagaaagtcatacaactcagcaggaagacattcgacagtgaatatatcaagacccgcacgaatgattgggactttgtagtgactacagatatttccgagatgggcgccaacttcaaagcagagcgtgttatcgaccctagacggtgtatgaagccagtgattttaaccgatggcgaagagagggtcatcctggctgggcccatgcctgtgacccatagctctgccgcacagcgccgaggaagagttggtcggaatccgaaaaacgaaaatgaccagtacatatacatgggcgagccacttgaaaacgatgaggactgcgcccactggaaggaggctaaaatgctgctcgacaatatcaacactcccgaagggattatcccttcaatgtttgagcccgaaagggagaaggtggatgccattgacggagaatatcgcttgagaggcgaggcgaggaaaacattcgtcgatctgatgcggcgtggtgacctcccagtgtggctggcataccgcgtagccgctgaggggatcaactatgccgatcgaagatggtgttttgacggcgtgaagaataaccaaatacttgaagagaatgttgaagtcgagatttggaccaaggagggagaaaggaaaaagctaaaacctcggtggctggatgctcgcatctactccgaccccttggcattaaaggagttcaaagagttcgccgctggcagaaagagtctgacactcaacctgattactgagatggggaggcttccaacgtttatgacccagaaggccaaaaatgcactggataacctcgcggtgttgcatacagccgaagctggaggtcgggcctataatcacgcactgagcgagctacctgagactctggaaaccctccttctgttaacattgctggctaccgtgactggcgggatcttcctctttctgatgtcgggaaagggcataggtaaaatgacgcttgggatgtgctgcatcattaccgcctctatcctgctctggtacgcacagattcagccgcactggatcgccgcttccataattttggagttctttctgatcgtcttactaatccccgaaccagagaagcaacgaacacctcaggacaaccagctgacttatgttgtgattgcgatcctcaccgtagtggccgcaacaatggctaatgaaatgggcttccttgagaaaaccaagaaggattttggactgggcagcataactacacagcaacccgagtcaaacattttggacatcgatctgagaccagccagtgcctggacgctctacgcagtcgctaccactttcattacacctatgctgcgccattctatcgaaaattccagcgtgaacgtttcacttaccgccatagcgaatcaggctaccgtgctcatggggctgggaaaaggttggcccttgagtaagatggacatcggcgtcccgctgttagccattgggtgttacagccaggtaaacccaatcacactaactgcagccctgctccttctggtggctcactatgcaattatcggacctggcttgcaggccaaagcgacgagggaggctcaaaagcgggccgcagccggtattatgaaaaatcccaccgttgacgggatgacagtgatcgatctggacccaataccctacgatcctaagtttgaaaagcagctcggccaggtcatgctgcttgtgttatgcgtcactcaggtgctgatgatgcgtaccacatgggctctctgtgaggccttgaccctggcaactggaccgatttccacgctatgggaaggcaaccccgggagattctggaatacaaccatcgctgtttctatggccaacatctttaggggaagctatctggcgggcgccggtctccttttctccattatgaaaaacactgcaaatacccgccgggggacaggaaacactggcgagaccctgggtgagaagtggaaaaatcgattgaacgctctgggcaagtcagaatttcaaatatacaaaaagtctgggatccaggaggtggacagaacactcgccaaagaaggaattaagaggggcgagacggatcatcacgcagtaagtcgcgggtcggctaagctgcggtggttcgtggagagaaatttagtcaccccagaaggaaaagttgtggaccttggctgcggtcgtgggggatggagctattactgtggcggtctgaagaacgtcaaagaggtgaagggcctcactaaagggggacctggccatgaggaacccatccctatgtccacatatgggtggaatctagtaaggctgcagtctggagtggatgttttctttaccccacccgaaaagtgcgacactttgctgtgtgatattggcgagtcaagccctaacccaacagtggaggccggtcggaccctccgcgtccttaatctggtggaaaactggttgaataacaatacgcaattctgcatcaaggtcctgaacccctacatgccgtccgtgatagagaaaatggaagccctccagcgaaagtacgggggagcgttagttagaaatcctctgagtaggaactctacccacgagatgtattgggtaagcaacgcttcaggcaatatcgtgtccagtgtcaacatgattagccggatgcttatcaatcgctttacaatgagacacaaaaaggcaacttacgaaccagacgtggatctgggctctgggaccaggaacattggaatcgagtccgagacacccaatctagacataattggtaaacgaatcgaaaagatcaagcaggagcatgaaacttcatggcactatgatcaggaccatccttacaaaacctgggcctatcacggcagctacgagacaaagcaaaccgggtcggcttctagtatggttaacggagtggtccggctcctgactaaaccatgggacgtgattcccatggtaacgcagatggccatgacagataccactccgttcggccagcagcgtgtgtttaaggaaaaagttgacaccagaacacaagagcctaaggagggtacgaagaaattgatgaagataaccgcagaatggctgtggaaagagctcgggaagaaaaagactccccgcatgtgtacaagggaagagttcacccggaaagtcagatccaatgccgctcttggagcgatctttactgatgagaacaagtggaaaagcgcccgcgaagcagtggaggactcaggcttctgggaactggtggataaagagaggaatttacacctggaaggcaagtgcgagacatgtgtctataacatgatggggaaacgagagaagaaattgggagaatttggtaaggctaagggctcccgggccatttggtacatgtggctcggggcaagattcctggagtttgaagccctaggattccttaatgaggaccattggttttctagggaaaacagcctgagtggcgttgagggtgaggggctccacaaactgggatacatcttgcgcgatgtgtccaagaaagaaggcggcgctatgtatgccgacgataccgcggggtgggacacacgtattactctggaggatctcaagaatgaagagatggtaaccaaccatatggaaggagagcacaagaaacttgcagaggccatcttcaaactgacgtaccagaataaagtggtccgggtgcagagaccaacccctaggggtacagttatggacataatcagccgccgagaccagcggggctctgggcaagtggtcacttatggattaaacaccttcacaaacatggaagctcagctgattagacagatggagggcgaaggtgtgtttaagtcaatccaacagttgactgtaaaagaggagattgccgttaagaattggctcatcagggtggggcgcgaaagactgagtcggatggcaatttccggagatgactgcgtcgtgaaacccctagatgacaggttcgctagcgcccttaccgctctgaacgatatgggcaaggtgcgtaaggacatacagcagtgggagccatctcgaggctggaatgattggacgcaagtccccttttgctcgcatcacttccacgaactcatcatgaaagacgggcgcgttctggtggtaccttgtagaaaccaggatgagttgattggacgggccaggatctcacagggtgcaggctggagcttacgcgaaacagcgtgcctggggaagtcctacgcccagatgtggagtctcatgtattttcatagacgggaccttaggctggctgccaatgcaatctgttctgctgtgccaagccactggattccgacctcccgaactacatggtcaatacatgccacccacgagtggatgactaccgaggatatgctaacagtctggaaccgtgtgtggatccaagaaaatccctggatggaggacaaaacgcctgttgaaagttgggaggaaattccatacctgggaaagagagaggatcagtggtgcggctctctcatcggtttgaccagccgcgcaacttgggccaaaaacattcagacagcgatcaatcaggtgcggtccctgatagggaacgaggaatataccgactacatgccctcaatgaagaggttcagacgcgaggaagaggaagctggagtcctttggtga

SEQ ID NO: 14350 - RNA, 9876 nt, synthetic construct
  misc_feature 1..9876: note = derived and/or modified CDS sequence (opt3) from DENV-2__KM279544__SS-prME
  source 1..9876: mol_type = other RNA
accgccggaatcattataatgatgatccccactgtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgtggcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgaggtgcataggcacctcgaacagggactttgtggaaggggtctcaggaggtagctgggtggatattgtactggagcacggcagttgtgttactacaatggctaaaaataagcccaccctcgacttcgaattaatcaagacggaggccaaacacctggcgacccttcggaagtactgcgtggaagcaaaattgacaaacactaccacagcctcccgctgtcctactcagggggagccatctctgaatgaggaacaagataagcgatttgtctgcaaacatagcatggtggacagaggatggggcaacggttgtgggctattcggaaagggcggcattgtgacctgcgctatgtttacatgcaagaaaaatatggaggggaaggtcgttcagcccgaaaacctcgagtataccatcgtgatcactcctcactccggagaagagaatgccgtaggtaacgatacgggcaaacatgggaaggagattaaagtgacaccacagtcaagtataaccgaagcagagctgactggatacggcaccgtcacaatggaatgtagcccgaggaccggtcttgacttcaatgagatggtgctgttgcagatggaaaacaaggcttggctcgttcaccggcaatggtttctggatttacccctgccttggctcccaggggccgacactcagggctctaactggatccagaaagagacacttgtgacgttcaagaatccccacgcgaagaaacaggatgtcgtggtactgggatcccaagagggcgccatgcataccgcattgactggggctacagaaattcagatgtcaagcggaaacctactgtttaccggtcacctcaagtgccgtctgcgcatggacaaacttcagctgaagggcatgagttattctatgtgtacagggaaattcaaggttgtgaaggagatcgccgaaactcaacatggaaccatagtcattagagtgcagtacgagggcgacggttccccttgcaaaatcccattcgagatcatggatttggaaaagaggcacgtcctcgggcggctgattacggtgaatcccatcgttaccgagaaagacagcccggtgaacattgaagctgagcctccctttggcgattcgtacataatcattggagtagaaccaggccagttaaagctgtcttggttcaaaaaggggtcctcaatcggacagatgtttgagacaactatgcgaggtgccaagcgcatggcaatcctaggcgacaccgcctgggatttcgggagtctcggaggcatgtttacaagcattggtaaagctctgcatcaagtcttcggggcgatatatggcgcagccttttccggagtgtcttggactatgaagatccttattggcgttgtgatcacctggattgggatgaatagcagatcaacgagtttgtccgtcagcctggtgctcgtaggagtggttacactgtaccttggcgtcatggtgcaggctgactctggttgtgtggtctcatggaaaaacaaggagctgaaatgcgggagtggaatcttcataaccgataatgttcacacttggacagaacagtataagtttcagcctgagagcccctccaagttggcctctgcaatccaaaaagcccacgaagagggcatttgtggtatcaggtcggtgacccggctcgaaaacctgatgtggaagcagattactccagagttaaatcatatcctgaccgagaacgaagtgaaactaacaataatgacgggcgacattaaggggatcatgcaggctggaaaacgcagcctcagaccccagcctaccgagctgaagtactcctggaaagcctggggcaaggcaaagatgctttcaactgaattgcacaatcatacattcctgattgatgggccagagaccgcggaatgcccgaacacaaatagggcttggaacagtctcgaggtagaggactatggatttggcgtcttcactaccaatatctggctgaaattaaaggaacgtcaagatgtgttttgtgactctaaactgatgagcgccgcaataaaggacaaccgggccgttcacgctgatatgggttactggatcgagtccgcccttaacgacacgtggaaaattgaaaaggcatcattcatcgaggtaaagagctgccactggcccaaatctcatacattgtggtccaatggggtcctcgagagtgaaatgattatccctaagaacttcgctggaccagtgagccagcacaattatcgacccggctaccatacccagactgccggtccttggcacctgggcagactagagatggattttgacttctgtgaagggaccacagttgtggtaactgaggattgcggaaacaggggcccatctctgcgcaccacaacggcgtccgggaaactcataaccgaatggtgctgtcggtcatgcactctgcccccgcttagatacaggggagaggacggctgttggtatggtatggagattcgccctttgaaggaaaaagaggaaaatctggtcaacagtttagtgacagccgggcatggacagatcgataattttagcctcggcgtgctgggtatggctcttttcctggaggaaatgttgcgaacccgggtcggcactaagcacgcaatcctcctggttgccgtgtcgtttgtaacactaattaccgggaacatgtccttccgtgacctgggaagagtgatggtcatggtgggcgctacgatgactgatgacatcgggatgggagttacctacctcgccctgcttgcagcgtttaaggtgaggccaacattcgccgctggcttgctgttacgcaaactcacctctaaggagctgatgatgactacaattggtatagtccttctgagccaatcaaccatccccgagagtattctagaactcacagatgccctggcattggggatgatggtgctgaaaatcgttcggaatatggagaagtatcagttagctgtgactattatggccatcctctgcgtccctaacgcagtaatactgcagaatgcctggaaagtgtcctgtaccacgcttgctgttgtgtctgtcagccccctgttgctcacatcctcacaacagaaggcggactggatcccactggccctaaccattaagggactgaaccctactgcaatctttcttaccacactcagcagaacaagtaaaaagaggtcttggcccctgaatgaagctattatggccgtgggcatggtatccatcttggccagctcgctgctaaagaacgatataccaatgaccggcccgctcgtggctgggggactgcttacggtctgctacgttctgacaggtcgatcagcagacttggagctcgaacgcgccgcggacgtgcggtgggaggagcaggctgaaatttctggcagttcccctatcctgagcatcaccatttctgaggatgggagcatgtccataaagaatgaagaggaggaacagactctaacaatcctgattagaaccggacttctcgtgatctcaggcctgttccccgtcagtattccaatcactgccgcagcctggtatttgtgggaggtgaaaaagcaaagggctggtgttttatgggacgtacccagccctccacccgtggggaaagcagaactggaggatggagcctaccgtataaagcagaagggcatcctcggctattctcagattggggcgggagtctacaaagaaggtacatttcacaccatgtggcatgtgacgcgcggcgctgttctgatgcacaaggggaaacggatcgagccttcctgggccgacgtgaagaaagatcttatttcatacggaggcggttggaagctggagggggaatggaaggagggagaagaggtccaggtgttggcactagaaccgggcaaaaacccaagagccgtacaaactaagcccggcctgttcaaaaccaacacagggaccatcggagctgtcagtctcgactttagccctggtacatccggctctccaatagtggataagaaagggaaggttgtgggactgtatggcaatggtgtcgtgactaggtcggggacctacgttagcgccattgcacagacggagaagtcaatcgaggacaaccccgaaatcgaggatgacattttccggaaaaagagacttacaatcatggatttacatcctggagctggcaaaactaagcgctatctgccggccatagtgagagaagcgattaaaaggggcctccggaccttgatcctggcccccacacgagtcgtggcagctgagatggaagaggccctcagagggctgccaattcgctaccagacccctgctatcagggcagagcacactggacgtgaaatagtagaccttatgtgtcatgccaccttcacaatgcggctgttgtcccccattagagtgccaaattataacctaatcatcatggatgaggcccactttacggaccctgctagtattgcggcaaggggttacatctctactcgcgttgaaatgggcgaggccgctgggattttcatgaccgccacacccccaggaagccgagacccgtttcctcagtccaatgcacccataatggatgaggaaagagagatcccagaacggtcatggaactctggccacgagtgggtcaccgacttcaagggtaagactgtgtggtttgtgcccagcattaaagccgggaatgatatcgctgcgtgcctgaggaagaacggcaaaaaggtcatccaactcagtcgcaaaacattcgactccgaatatattaagacccgtacgaatgattgggactttgtagtgactacagatataagcgagatgggcgccaacttcaaggcagagagagttatcgaccctcggaggtgtatgaaaccagtgattttaaccgatggcgaagaacgcgtcatcctggctgggcccatgcctgtgacccattcttcagccgcacagcgaagaggacgggttggtaggaatccgaagaacgaaaatgaccagtacatttacatgggcgagccacttgaaaacgatgaggactgcgcccactggaaagaggctaagatgctgctcgacaatatcaacactcccgaagggataatcccttccatgtttgagcccgaacgcgagaaagtggatgccattgacggagaatatagattgaggggcgaggcgcggaagacattcgtcgatctgatgcgtcgcggtgacctcccagtgtggctggcataccgagtagccgctgaggggatcaactatgccgatagaaggtggtgttttgacggcgtgaaaaataaccaaattcttgaagagaatgttgaagtcgagatctggaccaaggagggagaacggaagaaactaaagcctcgctggctggatgctagaatatacagtgaccccttggcattaaaagagttcaaggagttcgccgctggcaggaaaagcctgacactcaacctgattactgagatggggcggcttccaacgtttatgacccagaaggccaagaatgcactggataacctcgcggtgttgcatacagccgaagctggaggtcgagcctataatcacgcactgtcggagctacctgagactctggaaaccctccttctgttaacattgctggctaccgtgactggcgggatcttcctctttctgatgtctggaaaaggcattggtaagatgacgcttgggatgtgctgcatcataaccgcctccatcctgctctggtacgcacagattcagccgcactggatcgccgctagcattatcttggagttctttctgatagtcttactaattcccgaaccagagaaacaaagaacacctcaggacaaccagctgacttatgttgtgatcgcgatcctcaccgtagtggccgcaacaatggctaatgaaatgggcttccttgagaagaccaaaaaggattttggactgggctcaattactacacagcaacccgagagtaacatcttggacatagatctgcgcccagcctctgcctggacgctctacgcagtcgctaccactttcattacacctatgctgaggcattccatcgaaaatagctcagtgaacgttagtcttaccgccattgcgaatcaggctaccgtgctcatggggctgggaaagggttggcccttgagcaaaatggacatcggcgtcccgctgttagccatagggtgttactcccaggtaaacccaatcacactaactgcagccctgctccttctggtggctcactatgcaattatcggacctggcttgcaggccaaggcgacgcgggaggctcaaaaacgtgccgcagccggtattatgaagaatcccaccgttgacgggatgacagtgatcgatctggacccaattccctacgatcctaaatttgaaaagcagctcggccaggtcatgctgcttgtgttatgcgtcactcaggtgctgatgatgagaaccacatgggctctctgtgaggccttgaccctggcaactggaccgatctctacgctatgggaaggcaaccccgggaggttctggaatacaaccatagctgttagcatggccaacatttttcgcggatcctatctggcgggcgccggtctccttttctcaatcatgaagaacactgcaaatacccggcgagggacaggaaacactggcgagaccctgggtgagaaatggaagaatagattgaacgctctgggcaaatctgaatttcaaatctacaagaaaagtgggattcaggaggtggacaggacactcgccaaggaaggaataaaacgcggcgagacggatcatcacgcagtatcgcgggggagcgctaagctgagatggttcgtggagcgtaatttagtcaccccagaaggaaaggttgtggaccttggctgcggtagagggggatggtcctattactgtggcggtctgaaaaacgtcaaggaggtgaaaggcctcactaaagggggacctggccatgaagaacccatccctatgtctacatatgggtggaatctagtacggctgcagtcaggagtggatgttttctttaccccacccgaaaaatgcgacactttgctgtgtgatattggcgagagctcccctaacccaacagtggaggccggtcgcaccctccgagtccttaatctggtggaaaactggttgaataacaatacgcaattctgcatcaaggtcctgaacccctacatgccgagtgtgattgagaagatggaagccctccagagaaaatacgggggagcgttagttaggaatcctctgtctcggaacagcacccacgagatgtattgggtatcaaacgcttccggcaatatcgtgagtagcgtcaacatgatatctcgcatgcttatcaatagatttacaatgaggcacaagaaagcaacttacgaaccagacgtggatctgggctccgggacccgaaacattggaatcgagtcagagacacccaatctagacattatcggtaagcggatagagaaaattaagcaggagcatgaaactagctggcactatgatcaggaccatccttacaagacctgggcctatcacggctcgtacgagacaaaacaaaccgggtctgctagttccatggttaacggagtggtccgtctcctgactaagccatgggacgtgatccccatggtaacgcagatggccatgacagataccactccgttcggccagcagagagtgtttaaagaaaaggttgacacccgcacacaagagcctaaagagggtacgaagaagttgatgaaaatcaccgcagaatggctgtggaaggagctcgggaaaaagaaaactcccaggatgtgtacacgggaagagttcaccagaaaggtccgcagcaatgccgctcttggagcgatttttactgatgagaacaaatggaagtcagccagggaagcagtggaggactccggcttctgggaactggtggataaggagcgaaatttacacctggaaggcaaatgcgagacatgtgtctataacatgatggggaagcgggagaaaaagttgggagaatttggtaaagctaagggctctagagccatatggtacatgtggctcggggcaaggttcctggagtttgaagccctaggattccttaatgaggaccattggtttagccgcgaaaacagtctgtccggcgttgagggtgaggggctccacaagctgggatacatcttgcgtgatgtgagcaaaaaggaaggcggcgctatgtatgccgacgataccgcggggtgggacacacggattactctggaggatctcaaaaatgaagagatggtaaccaaccatatggaaggagagcacaagaaacttgcagaggccatcttcaagctgacgtaccagaataaggtggtcagagtgcagaggccaacccctcgcggtacagttatggacattatctctcgacgggaccagagaggctcagggcaagtggtcacttatggattaaacaccttcacaaacatggaagctcagctgataaggcagatggagggcgaaggtgtgtttaaaagtatccaacagttgactgtaaaggaggagattgccgttaaaaattggctcatccgcgtggggagagaacggctgtccaggatggcaattagcggagatgactgcgtcgtgaagcccctagatgaccgtttcgcttctgcccttaccgctctgaacgatatgggcaaagtgcgaaaggacatccagcagtgggagccatcgcgcggctggaatgattggacgcaagtccccttttgctcacatcacttccacgaactcattatgaaggacgggagagttctggtggtaccttgtcggaaccaggatgagttgataggaagggcccgcatcagccagggtgcaggctggtccttaagagaaacagcgtgcctggggaaaagttacgcccagatgtggtctctcatgtattttcatcggagggaccttcgactggctgccaatgcaatttgtagcgctgtgccatcccactggatcccgacctcacgtactacatggagtatccatgccacccacgagtggatgactaccgaggatatgctaacagtctggaacagagtgtggattcaagaaaatccctggatggaggacaagacgctggttgaatcttgggaggaaataccttacctcggaaaacgcgaggatcagtggtgcggcagcttgatcggtctgacctcccgggcaacttgggccaagaacattcagacagcgatcaatcaggtgaggtcacttattgggaacgaggaatataccgactacatgccaagcatgaaaagattccgccgggaggaagaggaagctggagtcctgtggtga

SEQ ID NO: 14351 - RNA, 9876 nt, synthetic construct
  misc_feature 1..9876: note = derived and/or modified CDS sequence (opt3) from DENV-2__KM279549__SS-prME
  source 1..9876: mol_type = other RNA
accgccggaatcattataatgatgatccccacagtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgttgcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgaggtgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcagcctcagaccccagcctacggagctgaagtactcctggaaagcctggggcaaggcaaagatgctttcaaccgaattgcacaatcatactttcctgatcgatgggccagagacagcggaatgcccgaacaccaatagggcttggaacagtctcgaggtcgaggactatggatttggcgtgttcacaactaatatatggctgaaattaaaggaacgtcaagatgtattttgtgactctaaactgatgagcgccgcaatcaaggacaaccgggccgtgcacgctgatatgggttactggattgagtccgcccttaacgacacctggaaaatcgaaaaggcatcattcattgaggtcaagagctgccactggcccaaatctcatacgttgtggtccaatggggtgctcgagagtgaaatgatcatacctaagaacttcgctggaccagttagccagcacaattatcgacccggctaccatacacagaccgccggtccttggcacctgggcagactagagatggattttgacttctgtgaagggactaccgtggtagtcacagaggattgcggaaacaggggcccatctctgcgcactaccacagcgtccgggaaactcattacggaatggtgctgtcggtcatgcaccctgcccccgcttagatacaggggagaggacggctgttggtatggtatggagatccgccctttgaaggaaaaagaggaaaatctggtgaacagtttagtgactgccgggcatggacagatcgataattttagcctcggcgtcctgggtatggctcttttcctggaggaaatgttgcgaacacgggttggcaccaagcacgcaattctcctggtggccgtatcgtttgtgactctaatcacagggaacatgtccttccgtgacctgggaagagtcatggtgatggttggcgctaccatgacggatgacattgggatgggagtgacttacctcgccctgcttgcagcgtttaaggtcaggccaaccttcgccgctggcttgctgttacgcaaactcacatctaaggagctgatgatgaccactataggtatcgtgcttctgagccaatcaacaattcccgagagtatcctagaactcaccgatgccctggcattggggatgatggttctgaaaattgtgcggaatatggagaagtatcagttagctgtcacaatcatggccatactctgcgtacctaacgcagtgatcctgcagaatgcctggaaagtttcctgtactacccttgctgtggtctctgtgagccccctgttgctcacgtcctcacaacagaaggcggactggattccactggccctaacaatcaagggactgaaccctaccgcaatttttcttactaccctcagcagaacaagtaaaaagaggtcttggcccctgaatgaagctatcatggccgtaggcatggtgtccatattggccagctcgctgctaaagaacgatattccaatgactggcccgctcgtcgctgggggactgcttaccgtttgctacgtgctgacgggtcgatcagcagacttggagctcgaacgcgccgcggacgtgcggtgggaggagcaggctgaaatctctggcagttcccctatcctgagcattacaatatctgaggatgggagcatgtccatcaagaatgaagaggaggaacagaccctaactattctgatcagaacaggacttctcgtcatttcaggcctgttccccgtgagtatcccaataaccgccgcagcctggtatttgtgggaggttaaaaagcaaagggctggtgtattatgggacgtgcccagccctccacccgtcgggaaagcagaactggaggatggagcctaccgtatcaagcagaagggcattctcggctattctcagatcggggcgggagtgtacaaagaaggtacttttcacacaatgtggcatgttacccgcggcgctgtgctgatgcacaaggggaaacggattgagccttcctgggccgacgtcaagaaagatcttatctcatacggaggcggttggaagctggagggggaatggaaggagggagaagaggtgcaggtattggcactagaaccgggcaaaaacccaagagccgtccaaacgaagcccggcctgttcaaaactaacaccgggacaataggagctgtgagtctcgactttagccctggtacctccggctctccaattgttgataagaaagggaaggtggtcggactgtatggcaatggtgtggttacaaggtcggggacttacgtgagcgccatcgcacagaccgagaagtcaatcgaggacaaccccgaaattgaggatgacatcttccggaaaaagagacttacgataatggatttacatcctggagctggcaaaacaaagcgctatctgccggccattgtcagagaagcgatcaaaaggggcctccggactttgattctggcccccacccgagtggtagcagctgagatggaagaggccctcagagggctgccaatccgctaccagacccctgctataagggcagagcacaccggacgtgaaattgtggaccttatgtgtcatgccactttcaccatgcggctgttgtcccccatcagagttccaaattataacctaatcattatggatgaggcccactttacagaccctgctagtatcgcggcaaggggttacatttctacgcgcgtcgaaatgggcgaggccgctgggatattcatgactgccacacccccaggaagccgagacccgtttcctcagtccaatgcacccatcatggatgaggaaagagagattccagaacggtcatggaactctggccacgagtgggtgacagacttcaagggtaagaccgtgtggtttgtccccagcatcaaagccgggaatgatatcgctgcgtgcctgaggaagaacggcaaaaaggtaattcaactcagtcgcaaaactttcgactccgaatatataaagacacgtaccaatgattgggactttgtggttacgactgatatcagcgagatgggcgccaacttcaaggcagagagagtgattgaccctcggaggtgtatgaaaccagtcatcttaacagatggcgaagaacgcgtgattctggctgggcccatgcctgttacccattcttcagccgcacagcgaagaggacgggtgggtaggaatccgaagaacgaaaatgaccagtacatctacatgggcgagccacttgaaaacgatgaggactgcgcccactggaaagaggctaagatgctgctcgacaatataaacacccccgaagggatcattccttccatgtttgagcccgaacgcgagaaagtcgatgccatcgacggagaatatagattgaggggcgaggcgcggaagactttcgtggatctgatgcgtcgcggtgacctcccagtatggctggcataccgagtggccgctgaggggattaactatgttgatagaaggtggtgttttgacggcgtcaaaaataaccaaatccttgaagagaatgtggaagtggagatatggacaaaggagggagaacggaagaaactaaagcctcgctggctggatgccagaatttacagtgaccccttggctttaaaagagttcaaggagttcgcagccggcaggaaaagcctgaccctcaacctgatcacagagatggggcggcttccaacttttatgacgcagaaggctaagaatgccctggataacctcgcagtcttgcataccgcggaagccggaggtcgagcttataatcacgccctgtcggagctacctgagacactggaaactctccttctgttaaccttgctggcaacagttaccggcgggattttcctctttctgatgtctggaaaaggcatcggtaagatgactcttgggatgtgctgcataatcacggcttccattctgctctggtacgcccagatccagccgcactggattgcagccagcatcatattggagttctttctgattgtgttactaatccccgaaccagagaaacaaagaacccctcaggacaaccagctgacatatgtagtgatcgctattctcactgtcgtggcggccaccatggcaaatgaaatgggcttccttgagaagaccaaaaaggattttggactgggctcaatcaccactcagcaacccgagagtaacatattggacattgatctgcgcccagcttctgcctggacactctacgccgttgcaacgaccttcatcactcctatgctgaggcattccattgaaaatagctcagtgaacgtcagtcttacagctatcgccaatcaggcgaccgtactcatggggctgggaaagggttggcccttgagcaaaatggacataggcgtgccgctgttagctatcgggtgttactcccaggttaacccaattaccctaacagccgcactgctccttctggtggcccactatgctatcattggacctggcttgcaggcaaaggccactcgggaggcgcaaaaacgtgctgccgcaggtatcatgaagaatcccacggtcgacgggatgaccgtgattgatctggacccaatcccctacgatcctaaatttgaaaagcagctcggccaggtcatgctgcttgtgttatgcgttacacaggtgctgatgatgagaactacctgggccctctgtgaggctttgacactggccaccggaccgatatctactctatgggaaggcaaccccgggaggttctggaatacgacaattgcagtaagcatggctaacatctttcgcggatcctatctggccggcgcgggtctccttttctcaatcatgaagaacaccgccaatactcggcgagggaccggaaacacaggcgagactctgggtgagaaatggaagaatagattgaacgcactgggcaaatctgaatttcaaatttacaagaaaagtgggatacaggaggtggacaggaccctcgctaaggaaggaatcaaacgcggcgagacagatcatcacgccgtctcgcgggggagcgcaaagctgagatggttcgttgagcgtaatttagtgacgccagaaggaaaggtcgtggaccttggctgcggtagagggggatggtcctattactgtggcggtctgaaaaacgtaaaggaggtgaaaggcctcaccaaagggggacctggccatgaagaacccattcctatgtctacttatgggtggaatctagttcggctgcagtcaggagtggatgtcttctttacaccacccgaaaaatgcgacaccttgctgtgtgatatcggcgagagctcccctaacccaactgtggaggctggtcgcacactccgagtccttaatctggtggaaaactggttgaataacaatacccaattctgcattaaggttctgaacccctacatgccgagtgtaatcgagaagatggaagccctccagagaaaatacgggggagccttagtgaggaatcctctgtctcggaacagcacgcacgagatgtattgggtctcaaacgcgtccggcaatatagtgagtagcgttaacatgatctctcgcatgcttattaatagatttaccatgaggcacaagaaagctacatacgaaccagacgtggatctgggctccgggactcgaaacatcggaattgagtcagagacccccaatctagacatcataggtaagcggattgagaaaatcaagcaggagcatgaaacaagctggcactatgatcaggaccatccttacaagacttgggcatatcacggctcgtacgagaccaaacaaacagggtctgccagttccatggtcaacggagtggtacgtctcctgaccaagccatgggacgtgatccccatggttactcagatggctatgacggatacaaccccgttcggccagcagagagtctttaaagaaaaggtggacactcgcacccaagagcctaaagagggtacaaagaagttgatgaaaattacggccgaatggctgtggaaggagctcgggaaaaagaaaacccccaggatgtgtactcgggaagagttcacaagaaaggtgcgcagcaatgcagcccttggagctatatttaccgatgagaacaaatggaagtcagcgagggaagccgtcgaggactccggcttctgggaactggttgataaggagcgaaatttacacctggaaggcaaatgcgagacttgtgtgtataacatgatggggaagcgggagaaaaagttgggagaatttggtaaagcaaagggctctagagctatctggtacatgtggctcggggccaggttcctggagtttgaagcactaggattccttaatgaggaccattggtttagccgcgaaaacagtctgtccggcgtagagggtgaggggctccacaagctgggatacattttgcgtgatgtgagcaaaaaggaaggcggcgccatgtatgctgacgatacagccgggtgggacacccggatcacactggaggatctcaaaaatgaagagatggtcactaaccatatggaaggagagcacaagaaacttgcggaggcaattttcaagctgacctaccagaataaggtggttagagtgcagaggccaacgcctcgcggtaccgtcatggacatcatatctcgacgggaccagagaggctcagggcaagtggtaacatatggattaaacactttcaccaacatggaagcccagctgatcaggcagatggagggcgaaggtgtttttaaaagtattcaacagttgacagtgaaggaggagatcgctgtcaaaaattggctcattcgcgtggggagagaacggctgtccaggatggccatcagcggagatgactgcgtggtcaagcccctagatgaccgtttcgcatctgctcttactgccctgaacgatatgggcaaagttcgaaaggacattcagcagtgggagccatcgcgcggctggaatgattggacccaagtgcccttttgctcacatcacttccacgaactcataatgaaggacgggagagtactggtggtcccttgtcggaaccaggatgagttgatcggaagggctcgcattagccagggtgccggctggtccttaagagaaacggcatgcctggggaaaagttacgcgcagatgtggtctctcatgtattttcatcggagggaccttcgactggccgctaatgccatctgtagcgcagtgccatcccactggatcccgacatcacgtaccacttggagtattcatgctacacacgagtggatgaccactgaggatatgctaaccgtttggaacagagtgtggatacaagaaaatccctggatggaggacaagacacctgtcgaatcttgggaggaaatcccatacctgggaaaacgcgaggatcagtggtgcggcagcctcattggtttgacgtcccgggccacctgggcaaagaacatccagactgccattaatcaggtgaggtcactgatcgggaacgaggaatatacagactacatgcccagcatgaaaagattccgccgggaggaagaggaagcgggagtactttggtga

SEQ ID NO: 14352 - RNA, 9876 nt, synthetic construct
  misc_feature 1..9876: note = derived and/or modified CDS sequence (opt3) from DENV-2__KM279552__SS-prME
  source 1..9876: mol_type = other RNA
accgccggaatcattataatgatgatccccacagtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgttgcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgaggtgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcagcctcagaccccagcctacggagctgaagtactcctggaaagcctggggcaaggcaaagatgctttcaaccgaattgcacaatcatactttcctgatcgatgggccagagacagcggaatgcccgaacaccaatagggcttggaacagtctcgaggtcgaggactatggatttggcgtgttcacaactaatatatggctgaaattaaaggaacgtcaagatgtattttgtgactctaaactgatgagcgccgcaatcaaggacaaccgggccgtgcacgctgatatgggttactggattgagtccgcccttaacgacacctggaaaatcgaaaaggcatcattcattgaggtcaagagctgccactggcccaaatctcatacgttgtggtccaatggggtgctcgagagtgaaatgatcatacctaagaacttcgctggaccagttagccagcacaattatcgacccggctaccatacacagaccgccggtccttggcacctgggcagactagagatggattttgacttctgtgaagggactaccgtggtagtcacagaggattgcggaaacaggggcccatctctgcgcactaccacagcgtccgggaaactcattacggaatggtgctgtcggtcatgcaccctgcccccgcttagatacaggggagaggacggctgttggtatggtatggagatccgccctttgaaggaaaaagaggaaaatctggtgaacagtttagtgactgccgggcatggacagatcgataattttagcctcggcgtcctgggtatggctcttttcctggaggaaatgttgcgaacacgggttggcaccaagcacgcaattctcctggtggccgtatcgtttgtgactctaatcacagggaacatgtccttccgtgacctgggaagagtcatggtgatggttggcgctaccatgacggatgacattgggatgggagtgacttacctcgccctgcttgcagcgtttaaggtcaggccaaccttcgccgctggcttgctgttacgcaaactcacatctaaggagctgatgatgaccactataggtatcgtgcttctgagccactcaacaattcccgagagtatcctagaactcaccgatgccctggcattggggatgatggttctgaaaattgtgcggaatatggagaagtatcaattagctgtcacaatcatggccatactctgcgtacctaacgcagtgatcctgcagaatgcctggaaagtttcctgtactacccttgctgtggtctctgtgagccccctgttgctcacgtcctcacagcaaaaggcggactggattccactggccctaacaatcaagggactgaaccctaccgcaatttttcttactaccctcagcagaacaagtaaaaagaggtcttggcccctgaatgaagctatcatggccgtaggcatggtgtccatattggccagctcgctgctaaagaacgatattccaatgactggcccgctcgtcgctgggggactgcttaccgtttgctacgtgctgacgggtcgatcagcagacttggagctcgaacgcgccgcggacgtgcggtgggaggagcaggctgaaatctctggcagttcccctatcctgagcattacaatatctgaggatgggagcatgtccatcaagaatgaagaggaggaacagaccctaactattctgatcagaacaggacttctcgtcatttcaggcctgttccccgtgagtatcccaataaccgccgcagcctggtatttgtgggaggttaaaaagcagagggctggtgtattatgggacgtgcccagccctccacccgtcgggaaagcagaactggaggatggagcctaccgtatcaagcaaaagggcattctcggctattctcagatcggggcgggagtgtacaaagaaggtacttttcatacaatgtggcacgttacccgcggcgctgtgctgatgcataaggggaaacggattgagccttcctgggccgacgtcaagaaagatcttatctcatacggaggcggttggaagctggagggggaatggaaggagggagaagaggtgcaggtattggcactagaaccgggcaaaaacccaagagccgtccagacgaagcccggcctgttcaaaactaacaccgggacaataggagctgtgagtctcgactttagccctggtacctccggctctccaattgttgataagaaagggaaggtggtcggactgtatggcaatggtgtggttacaaggtcggggacttacgtgagcgccatcgcacaaaccgagaagtcaatcgaggacaaccccgaaattgaggatgacatcttccggaaaaagagacttacgataatggatttacaccctggagctggcaaaacaaagcgctatctgccggccattgtcagagaagcgatcaaaaggggcctccggactttgattctggcccccacccgagtggtagcagctgagatggaagaggccctcagagggctgccaatccgctaccagacccctgctataagggcagagcataccggacgtgaaattgtggaccttatgtgtcacgccactttcaccatgcggctgttgtcccccatcagagttccaaattataacctaatcattatggatgaggcccactttacagaccctgctagtatcgcggcaaggggttacatttctacgcgcgtcgaaatgggcgaggccgctgggatattcatgactgccacacccccaggaagccgagacccgtttcctcagtccaatgcacccatcatggatgaggaaagagagattccagaacggtcatggaactctggccatgagtgggtgacagacttcaagggtaagaccgtgtggtttgtccccagcatcaaagccgggaatgatatcgctgcgtgcctgaggaagaacggcaaaaaggtaattcagctcagtcgcaaaactttcgactccgaatatataaagacacgtaccaatgattgggactttgtggttacgactgatatcagcgagatgggcgccaacttcaaggcagagagagtgattgaccctcggaggtgtatgaaaccagtcatcttaacagatggcgaagaacgcgtgattctggctgggcccatgcctgttacccactcttcagccgcacaacgaagaggacgggtgggtaggaatccgaagaacgaaaatgaccagtacatctacatgggcgagccacttgaaaacgatgaggactgcgcccattggaaagaggctaagatgctgctcgacaatataaacacccccgaagggatcattccttccatgtttgagcccgaacgcgagaaagtcgatgccatcgacggagaatatagattgaggggcgaggcgcggaagactttcgtggatctgatgcgtcgcggtgacctcccagtatggctggcataccgagtggccgctgaggggattaactatgccgatagaaggtggtgttttgacggcgttaaaaataaccagatccttgaagagaatgtcgaagtggagatatggacaaaggagggagaacggaagaaactaaagcctcgctggctggatgctagaatttacagtgaccccttggcattaaaagagttcaaggagttcgccgctggcaggaaaagcctgaccctcaacctgatcacagagatggggcggcttccaacttttatgacgcaaaaggccaagaatgcactggataacctcgcggtgttgcacaccgccgaagctggaggtcgagcctataatcacgcactgtcggagctacctgagacactggaaactctccttctgttaaccttgctggctacagtcaccggcgggattttcctctttctgatgtctggaaaaggcatcggtaagatgactcttgggatgtgctgcataatcacggcctccattctgctctggtacgcacagatccagccgcattggattgccgctagcatcatattggagttctttctgattgttttactaatccccgaaccagagaaacagagaacccctcaagacaaccagctgacatatgtggtaatcgcgattctcactgtggtcgccgcaaccatggctaatgaaatgggcttccttgagaagaccaaaaaggattttggactgggctcaatcaccactcagcagcccgagagtaacatattggacattgatctgcgcccagcctctgcctggacactctacgcagtggctacgaccttcatcactcctatgctgaggcactccattgaaaatagctcagttaacgtgagtcttacagccatcgcgaatcaagctaccgtcctcatggggctgggaaagggttggcccttgagcaaaatggacataggcgtaccgctgttagccatcgggtgttactcccaggtgaacccaattaccctaacagcagccctgctccttctggttgctcattatgcaatcattggacctggcttgcaggccaaggcgactcgggaggctcagaaacgtgccgcagccggtatcatgaagaatcccacggtggacgggatgaccgtcattgatctggacccaatcccctacgatcctaaatttgaaaagcaactcggccaggtgatgctgcttgtcttatgcgtgacacaggttctgatgatgagaactacctgggctctctgtgaggccttgacactggcaaccggaccgatatctactctatgggaaggcaaccccgggaggttctggaatacgacaattgctgtgagcatggccaacatctttcgcggatcctatctggcgggcgccggtctccttttctcaatcatgaagaacaccgcaaatactcggcgagggaccggaaacacaggcgagactctgggtgagaaatggaagaatagattgaacgctctgggcaaatctgaatttcagatttacaagaaaagtgggatacaagaggtagacaggaccctcgccaaggaaggaatcaaacgcggcgagacagatcaccatgcagtgtcgcgggggagcgctaagctgagatggttcgtcgagcgtaatttagttacgccagaaggaaaggtggtcgaccttggctgcggtagagggggatggtcctattactgtggcggtctgaaaaacgtgaaggaggtaaaaggcctcaccaaagggggacctggccacgaagaacccattcctatgtctacttatgggtggaatctagtgcggctgcagtcaggagttgatgtgttctttacaccacccgaaaaatgcgacaccttgctgtgtgatatcggcgagagctcccctaacccaactgtcgaggccggtcgcacactccgagtgcttaatctggtcgaaaactggttgaataacaatacccagttctgcattaaggtgctgaacccctacatgccgagtgttatcgagaagatggaagccctccaaagaaaatacgggggagcgttagtaaggaatcctctgtctcggaacagcacgcacgagatgtattgggtgtcaaacgcttccggcaatatagtcagtagcgtgaacatgatctctcgcatgcttattaatagatttaccatgaggcataagaaagcaacatacgaaccagacgttgatctgggctccgggactcgaaacatcggaattgagtcagagacccccaatctagacatcataggtaagcggattgagaaaatcaagcaggagcacgaaacaagctggcattatgatcaggaccacccttacaagacttgggcctatcacggctcgtacgagaccaaacagacagggtctgctagttccatggtgaacggagtcgtgcgtctcctgaccaagccatgggacgtaatccccatggtgactcaaatggccatgacggatacaaccccgttcggccagcagagagtttttaaagaaaaggtcgacactcgcacccaggagcctaaagagggtacaaagaagttgatgaaaattacggcagaatggctgtggaaggagctcgggaaaaagaaaacccccaggatgtgtactcgggaagagttcacaagaaaggtgcgcagcaatgccgctcttggagcgatatttaccgatgagaacaaatggaagtcagccagggaagcagtggaggactccggcttctgggaactggtcgataaggagcgaaatttacatctggaaggcaaatgcgagacttgtgtttataacatgatggggaagcgggagaaaaagttgggagaatttggtaaagctaagggctctagagccatctggtacatgtggctcggggcaaggttcctggagtttgaagccctaggattccttaatgaggaccactggtttagccgcgaaaacagtctgtccggcgtggagggtgaggggctccataagctgggatacattttgcgtgatgtaagcaaaaaggaaggcggcgctatgtatgccgacgatacagcggggtgggacacccggatcacactggaggatctcaaaaatgaagagatggtgactaaccacatggaaggagagcataagaaacttgcagaggccattttcaagctgacctaccaaaataaggtcgtgagagttcagaggccaacgcctcgcggtaccgtgatggacatcatatctcgacgggaccagagaggctcagggcaggtcgtgacatatggattaaacactttcaccaacatggaagctcaactgatcaggcagatggagggcgaaggtgtatttaaaagtattcagcaattgacagttaaggaggagatcgccgtgaaaaattggctcattcgcgtcgggagagaacggctgtccaggatggcaatcagcggagatgactgcgtggtgaagcccctagatgaccgtttcgcttctgcccttactgctctgaacgatatgggcaaagtccgaaaggacattcagcagtgggagccatcgcgcggctggaatgattggacccaggttcccttttgctcacaccacttccatgaactcataatgaaggacgggagagtgctggtagtgccttgtcggaaccaagatgagttgatcggaagggcccgcattagccagggtgcaggctggtccttaagagaaacggcgtgcctggggaaaagttacgcccagatgtggtctctcatgtattttcaccggagggaccttcgactggctgccaatgcaatctgtagcgctgtcccatcccattggatcccgacatcacgtaccacttggagtattcacgccacacacgagtggatgaccactgaggatatgctaaccgtgtggaacagagtttggatacaggaaaatccctggatggaggacaagacacctgtggaatcttgggaggaaatcccatacctgggaaaacgcgaggatcaatggtgcggcagcctcattggtttgacgtcccgggcaacctgggccaagaacatccagactgcgattaatcaggtcaggtcactgatcgggaacgaggaatatacagactacatgcccagcatgaaaagattccgccgggaggaagaggaagctggagtgctttggtga

SEQ ID NO: 14353 - RNA, 9876 nt, synthetic construct
  misc_feature 1..9876: note = derived and/or modified CDS sequence (opt3) from DENV-2__KM279557__SS-prME
  source 1..9876: mol_type = other RNA
accgccggaatcattataatgatgatccccacagtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgttgcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgaggtgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcagcctcagaccccagcctacggagctgaagtactcctggaaagcctggggcaaggcaaagatgctttcaaccgaattgcacaatcatactttcctgatcgatgggccagagacagcggaatgcccgaacaccaatagggcttggaacagtctcgaggtcgaggactatggatttggcgtgttcacaactaatatatggctgaaattaaaggaacgtcaagatgtattttgtgactctaaactgatgagcgccgcaatcaaggacaaccgggccgtgcacgctgatatgggttactggattgagtccgcccttaacgacacctggaaaatcgaaaaggcatcattcattgaggtcaagagctgccactggcccaaatctcatacgttgtggtccaatggggtgctcgagagtgaaatgatcatacctaagaacttcgctggaccagttagccagcacaattatcgacccggctaccatacacagaccgccggtccttggcacctgggcagactagagatggattttgacttctgtgaagggactaccgtggtagtcacagaggattgcggaaacaggggcccatctctgcgcactaccacagcgtccgggaaactcattacggaatggtgctgtcggtcatgcaccctgcccccgcttagatacaggggagaggacggctgttggtatggtatggagatccgccctttgaaggaaaaagaggaaaatctggtgaacagtttagtgactgccgggcatggacagatcgataattttagcctcggcgtcctgggtatggctcttttcctggaggaaatgttgcgaacacgggttggcaccaagcacgcaattctcctggtggccgtatcgtttgtgactctaatcacagggaacatgtccttccgtgacctgggaagagtcatggtgatggttggcgctaccatgacggatgacattgggatgggagtgacttacctcgccctgcttgcagcgtttaaggtcaggccaaccttcgccgctggcttgctgttacgcaaactcacatctaaggagctgatgatgaccactataggtatcgtgcttctgagccaatcaacaattcccgagagtatcctagaactcaccgatgccctggcattggggatgatggttctgaaaattgtgcggaatatggagaagtatcagttagctgtcacaatcatggccatactctgcgtacctaacgcagtgatcctgcagaatgcctggaaagtttcctgtactacccttgctgtggtctctgtgagccccctgttgctcacgtcctcacaacagaaggcggactggattccactggccctaacaatcaagggactgaaccctaccgcaatttttcttactaccctcagcagaacaagtaaaaagaggtcttggcccctgaatgaagctatcatggccgtaggcatggtgtccatattggccagctcgctgctaaagaacgatattccaatgactggcccgctcgtcgctgggggactgcttaccgtttgctacgtgctgacgggtcgatcagcagacttggagctcgaacgcgccgcggacgtgcggtgggaggagcaggctgaaatctctggcagttcccctatcctgagcattacaatatctgaggatgggagcatgtccatcaagaatgaagaggaggaacagaccctaactattctgatcagaacaggacttctcgtcatttcaggcctgttccccgtgagtatcccaataaccgccgcagcctggtatttgtgggaggttaaaaagcaaagggctggtgtattatgggacgtgcccagccctccacccgtcgggaaagcagaactggaggatggagcctaccgtatcaagcagaagggcattctcggctattctcagatcggggcgggagtgtacaaagaaggtacttttcacacaatgtggcatgttacccgcggcgctgtgctgatgcacaaggggaaacggattgagccttcctgggccgacgtcaagaaagatcttatctcatacggaggcggttggaagctggagggggaatggaaggagggagaagaggtgcaggtattggcactagaaccgggcaaaaacccaagagccgtccaaacgaagcccggcctgttcaaaactaacaccgggacaataggagctgtgagtctcgactttagccctggtacctccggctctccaattgttgataagaaagggaaggtggtcggactgtatggcaatggtgtggttacaaggtcggggacttacgtgagcgccatcgcacagaccgagaagtcaatcgaggacaaccccgaaattgaggatgacatcttccggaaaaagagacttacgataatggatttacatcctggagctggcaaaacaaagcgctatctgccggccattgtcagagaagcgatcaaaaggggcctccggactttgattctggcccccacccgagtggtagcagctgagatggaagaggccctcagagggctgccaatccgctaccagacccctgctataagggcagagcacaccggacgtgaaattgtggaccttatgtgtcatgccactttcaccatgcggctgttgtcccccatcagagttccaaattataacctaatcattatggatgaggcccactttacagaccctgctagtatcgcggcaaggggttacatttctacgcgcgtcgaaatgggcgaggccgctgggatattcatgactgccacacccccaggaagccgagacccgtttcctcagtccaatgcacccatcatggatgaggaaagagagattccagaacggtcatggaactctggccacgagtgggtgacagacttcaagggtaagaccgtgtggtttgtccccagcatcaaagccgggaatgatatcgctgcgtgcctgaggaagaacggcaaaaaggtaattcaactcagtcgcaaaactttcgactccgaatatataaagacacgtaccaatgattgggactttgtggttacgactgatatcagcgagatgggcgccaacttcaaggcagagagagtgattgaccctcggaggtgtatgaaaccagtcatcttaacagatggcgaagaacgcgtgattctggctgggcccatgcctgttacccattcttcagccgcacagcgaagaggacgggtgggtaggaatccgaagaacgaaaatgaccagtacatctacatgggcgagccacttgaaaacgatgaggactgcgcccactggaaagaggctaagatgctgctcgacaatataaacacccccgaagggatcattccttccatgtttgagcccgaacgcgagaaagtcgatgccatcgacggagaatatagattgaggggcgaggcgcggaagactttcgtggatctgatgcgtcgcggtgacctcccagtatggctggcataccgagtggccgctgaggggattaactatgccgatagaaggtggtgttttgacggcgttaaaaataaccaaatccttgaagagaatgtcgaagtggagatatggacaaaggagggagaacggaagaaactaaagcctcgctggctggatgctagaatttacagtgaccccttggcattaaaagagttcaaggagttcgccgctggcaggaaaagcctgaccctcaacctgatcacagagatggggcggcttccaacttttatgacgcagaaggccaagaatgcactggataacctcgcggtgttgcataccgccgaagctggaggtcgagcctataatcacgcactgtcggagctacctgagacactggaaactctccttctgttaaccttgctggctacagtcaccggcgggattttcctctttctgatgtctggaaaaggcatcggtaagatgactcttgggatgtgctgcataatcacggcctccattctgctctggtacgcacagatccagccgcactggattgccgctagcatcatattggagttctttctgattgttttactaatccccgaaccagagaaacaaagaacccctcaggacaaccagctgacatatgtggtaatcgcgattctcactgtggtcgccgcaaccatggctaatgaaatgggcttccttgagaagaccaaaaaggattttggactgggctcaatcaccactcagcaacccgagagtaacatattggacattgatctgcgcccagcctctgcctggacactctacgcagtggctacgaccttcatcactcctatgctgaggcattccattgaaaatagctcagttaacgtgagtcttacagccatcgcgaatcaggctaccgtcctcatggggctgggaaagggttggcccttgagcaaaatggacataggcgtaccgctgttagccatcgggtgttactcccaggtgaacccaattaccctaacagcagccctgctccttctggttgctcactatgcaatcattggacctggcttgcaggccaaggcgactcgggaggctcaaaaacgtgccgcagccggtatcatgaagaatcccacggtggacgggatgaccgtcattgatctggacccaatcccctacgatcctaaatttgaaaagcagctcggccaggtgatgctgcttgtcttatgcgtgacacaggttctgatgatgagaactacctgggctctctgtgaggccttgacactggcaaccggaccgatatctactctatgggaaggcaaccccgggaggttctggaatacgacaattgctgtgagcatggccaacatctttcgcggatcctatctggcgggcgccggtctccttttctcaatcatgaagaacaccgcaaatactcggcgagggaccggaaacacaggcgagactctgggtgagaaatggaagaatagattgaacgctctgggcaaatctgaatttcaaatttacaagaaaagtgggatacaggaggtagacaggaccctcgccaaggaaggaatcaaacgcggcgagacagatcatcacgcagtgtcgcgggggagcgctaagctgagatggttcgtcgagcgtaatttagttacgccagaaggaaaggtggtcgaccttggctgcggtagagggggatggtcctattactgtggcggtctgaaaaacgtgaaggaggtaaaaggcctcaccaaagggggacctggccatgaagaacccattcctatgtctacttatgggtggaatctagtgcggctgcagtcaggagttgatgtgttctttacaccacccgaaaaatgcgacaccttgctgtgtgatatcggcgagagctcccctaacccaactgtcgaggccggtcgcacactccgagtgcttaatctggtcgaaaactggttgaataacaatacccaattctgcattaaggtgctgaacccctacatgccgagtgttatcgagaagatggaagccctccagagaaaatacgggggagcgttagtaaggaatcctctgtctcggaacagcacgcacgagatgtattgggtgtcaaacgcttccggcaatatagtcagtagcgtgaacatgatctctcgcatgcttattaatagatttaccatgaggcacaagaaagcaacatacgaaccagacgttgatctgggctccgggactcgaaacatcggaattgagtcagagacccccaatctagacatcataggtaagcggattgagaaaatcaagcaggagcatgaaacaagctggcactatgatcaggaccatccttacaagacttgggcctatcacggctcgtacgagaccaaacaaacagggtctgctagttccatggtgaacggagtcgtgcgtctcctgaccaagccatgggacgtaatccccatggtgactcagatggccatgacggatacaaccccgttcggccagcagagagtttttaaagaaaaggtcgacactcgcacccaagagcctaaagagggtacaaagaagttgatgaaaattacggcagaatggctgtggaaggagctcgggaaaaagaaaacccccaggatgtgtactcgggaagagttcacaagaaaggtgcgcagcaatgccgctcttggagcgatatttaccgatgagaacaaatggaagtcagccagggaagcagtggaggactccggcttctgggaactggtcgataaggagcgaaatttacacctggaaggcaaatgcgagacttgtgtttataacatgatggggaagcgggagaaaaagttgggagaatttggtaaagctaagggctctagagccatctggtacatgtggctcggggcaaggttcctggagtttgaagccctaggattccttaatgaggaccattggtttagccgcgaaaacagtctgtccggcgtggagggtgaggggctccacaagctgggatacattttgcgtgatgtaagcaaaaaggaaggcggcgctatgtatgccgacgatacagcggggtgggacacccggatcacactggaggatctcaaaaatgaagagatggtgactaaccatatggaaggagagcacaagaaacttgcagaggccattttcaagctgacctaccagaataaggtcgtgagagttcagaggccaacgcctcgcggtaccgtgatggacatcatatctcgacgggaccagagaggctcagggcaagtcgtgacatatggattaaacactttcaccaacatggaagctcagctgatcaggcagatggagggcgaaggtgtatttaaaagtattcaacagttgacagttaaggaggagatcgccgtgaaaaattggctcattcgcgtcgggagagaacggctgtccaggatggcaatcagcggagatgactgcgtggtgaagcccctagatgaccgtttcgcttctgcccttactgctctgaacgatatgggcaaagtccgaaaggacattcagcagtgggagccatcgcgcggctggaatgattggacccaagttcccttttgctcacatcacttccacgaactcataatgaaggacgggagagtgctggtagtgccttgtcggaaccaggatgagttgatcggaagggcccgcattagccagggtgcaggctggtccttaagagaaacggcgtgcctggggaaaagttacgcccagatgtggtctctcatgtattttcatcggagggaccttcgactggctgccaatagcatctgttccgcagtcccatcacactggatcccgacaagtcgtaccacttggtctattcatgctacacacgagtggatgaccactgaggatatgctaaccgtgtggaacagagtttggatacaagaaaatccctggatggaggacaagacacctgtggaaagctgggaggaaatcccatacctgggaaaacgcgaggatcagtggtgcggctccctcattggtttgacgtcacgggccacctgggcaaagaacatccagactgccattaatcaggtcaggagcctgatcgggaacgaggaatatacagactacatgccctctatgaaaagattccgccgggaggaagaggaagcgggagtgctttggtga

SEQ ID NO: 14354 - RNA, 9876 nt, synthetic construct
  misc_feature 1..9876: note = derived and/or modified CDS sequence (opt3) from DENV-2__KM279591__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcacgctcagaccccagcctaccgagctgaagtacagctggaaagcctggggcaaggcaaagatgctttccactgaattgcacaatcatacattcctgatcgatgggccagagaccgcggaatgcccgaacacaaatagggcttggaactcactcgaggtcgaggactatggatttggcgtgttcactaccaatatatggctgaaattaaaggaacgtcaagatgttttttgtgacagtaaactgatgtctgccgcaatcaaggacaaccgggccgtgcacgctgatatgggttactggattgagagcgcccttaacgacacgtggaaaatcgaaaaggcatccttcattgaggtcaagtcatgccactggcccaaaagccatacattgtggtctaatggggtgctcgagtccgaaatgatcatacctaagaacttcgctggaccagttagtcagcacaattatcgacccggctaccatacccagactgccggtccttggcacctgggcagactagagatggattttgacttctgtgaagggaccacagtggtagtcactgaggattgcggaaacaggggcccaagcctgcgcaccacaacggcgtctgggaaactcattaccgaatggtgctgtcggtcctgcactctgcccccgcttagatacaggggagaggacggctgttggtatggtatggagatccgccctttgaaggaaaaagaggaaaatctggtgaactcattagtgacagccgggcatggacagatcgataattttagtctcggcgtcctgggtatggctcttttcctggaggaaatgttgcgaacccgggttggcactaagcacgcaattctcctggtggccgtaagctttgtgacactaatcaccgggaacatgtcgttccgtgacctgggaagagtcatggtgatggttggcgctacgatgactgatgacattgggatgggagtgacctacctcgccctgcttgcagcgtttaaggtcaggccaacattcgccgctggcttgctgttacgcaaactcacctccaaggagctgatgatgactacaataggtatcgtgcttctgtctcaaagcaccattcccgagtcaatcctagaactcacagatgccctggcattggggatgatggttctgaaaattgtgcggaatatggagaagtatcagttagctgtcactatcatggccatactctgcgtacctaacgcagtgatcctgcagaatgcctggaaagttagttgtaccacgcttgctgtggtctccgtgtctcccctgttgctcacaagctcccaacagaaggcggactggattccactggccctaaccatcaagggactgaaccctactgcaatttttcttaccacactctcaagaactagcaaaaagaggagttggcccctgaatgaagctatcatggccgtaggcatggtgtctatattggcctccagcctgttaaaaaacgatattccaatgaccggcccgctcgtcgctgggggactgcttacggtttgctacgtgctgacaggtcgatcggcagacttggagctcgaacgcgccgcggacgtgcggtgggaggagcaggctgaaatctcaggctctagtcctatcctgtccattaccataagcgaggatgggtctatgagcatcaagaatgaagaggaggaacagactctaacaattctgatcagaaccggacttctcgtcatttccggcctgttccccgtgtcaatcccaataactgccgcagcctggtatttgtgggaggttaaaaagcaaagggctggtgtattatgggacgtgcccagtcctccacccgtcgggaaagcagaactggaggatggagcctaccgtatcaagcagaagggcattctcggctatagccagatcggggcgggagtgtacaaagaaggtacatttcacaccatgtggcatgttacgcgcggcgctgtgctgatgcacaaggggaaacggattgagccttcttgggccgacgtcaagaaagatcttatctcctacggaggcggttggaagctggagggggaatggaaggagggagaagaggtgcaggtattggcactagaaccgggcaaaaacccaagagccgtccaaactaagcccggcctgttcaaaaccaacacagggaccataggagctgtgtcactcgactttagtcctggtacaagcggctccccaattgttgataagaaagggaaggtggtcggactgtatggcaatggtgtggttactaggtctgggacctacgtgtcggccatcgcacagacggagaagagcatcgaggacaaccccgaaattgaggatgacatcttccgaaaaaagcggcttacaataatggatttacatcctggagctggcaaaactaagcgctatctgccggccattgtcagagaagcgatcaaaaggggcctccggaccttgattctggcccccacacgagtggtagcagctgagatggaagaggccctcagagggctgccaatccgctaccagacccctgctataagggcagagcacactggacgtgaaattgtggaccttatgtgtcatgccaccttcacaatgcggctgttgtcacccatcagagttccaaattataacctaatcattatggatgaggcccactttacggaccctgcttccatcgcggcaaggggttacattagtactcgcgtcgaaatgggcgaggccgctgggatattcatgaccgccacacccccaggatctcgagacccgtttcctcagagcaatgcacccatcatggatgaggaaagagagattccagaacggtcctggaactcaggccacgagtgggtgaccgacttcaagggtaagactgtgtggtttgtcccctctatcaaagccgggaatgatatcgctgcgtgcctgaggaagaacggaaaaaaggtaattcaactcagccgcaaaacattcgacagtgaatatataaagacccgtacgaatgattgggactttgtggttactacagatatctccgagatgggcgccaacttcaaggcagagagagtgattgaccctcggaggtgtatgaaaccagtcatcttaaccgatggcgaagagcgcgtgattctggctgggcccatgcctgttacccatagctctgccgcacagcgaagaggacgggtgggtaggaatccgaagaacgaaaatgaccagtacatctacatgggcgagccacttgaaaacgatgaggactgcgcccactggaaagaggctaagatgctgctcgacaatataaacactcccgaagggatcattccttcaatgtttgagcccgaacgcgagaaagtcgatgccatcgacggagaatatagattgaggggcgaggcgcggaagacattcgtggatctgatgcgtcgcggtgacctcccagtatggctggcataccgagtggccgctgaggggattaactatgttgatagaaggtggtgttttgacggcgtcaaaaataaccaaatccttgaagagaatgtggaagtggagatatggaccaaggagggagaacggaagaaactaaagcctcgctggctggatgccagaatttactccgaccccttggctttaaaagagttcaaggaattcgcagccggcaggaaaagtctgacactcaacctgatcactgagatggggcggcttccaacgtttatgacccagaaggctaagaatgccctggataacctcgcagtcttgcatacagcggaagccggaggtcgagcttataatcacgccctgagcgagctacctgagactctggaaaccctccttctgttaacattgctggcaaccgttactggcgggattttcctctttctgatgtcgggaaaaggcatcggtaagatgacgcttgggatgtgctgcataatcaccgcttctattctgctctggtacgcccagatccagccgcactggattgcagcctccatcatattggagttctttctgattgtgttactaatccccgaaccagagaaacaaagaacacctcaggacaaccagctgacttatgtagtgatcgctattctcaccgtcgtggcggccacaatggcaaatgaaatgggcttccttgagaagaccaaaaaggattttggactgggcagcatcactacacagcaacccgagtcaaacatattggacattgatctgcgcccagctagtgcctggacgctctacgccgttgcaaccactttcatcacacctatgctgaggcattctattgaaaattccagcgtgaacgtctcacttaccgctatcgccaatcaggcgaccgtactcatggggctgggaaagggttggcccttgagtaaaatggacataggcgtgccgctgttagctatcgggtgttacagccaggttaacccaattacactaactgccgcactgctccttctggtggcccactatgctatcattggacctggcttgcaggcaaaggccacgcgggaggcgcaaaaacgtgctgccgcaggtatcatgaagaatcccaccgtcgacgggatgacagtgattgatctggacccaatcccctacgatcctaaatttgaaaagcagctcggccaggtcatgctgcttgtgttatgcgttactcaggtgctgatgatgagaaccacatgggccctctgtgaggctttgaccctggccactggaccgatatccacgctatgggaaggcaaccccgggaggttctggaatacaaccattgcagtatctatggctaacatctttcgcggaagctatctggccggcgcgggtctccttttctccatcatgaagaacactgccaatacccggcgagggacaggaaacactggcgagaccctgggtgagaaatggaagaatagattgaacgcactgggcaaatcagaatttcaaatttacaagaaatctgggatacaggaggtggacaggacactcgctaaggaaggaatcaaacgcggcgagacggatcatcacgccgtcagtcgggggtcggcaaagctgagatggttcgttgagcgtaatttagtgaccccagaaggaaaggtcgtggaccttggctgcggtagggggggatggagctattactgtggcggtctgaaaaacgtaaaggaggtgaaaggcctcactaaggggggacctggccatgaagagcccattcctatgtccacatatgggtggaatctagttcggctgcagtctggagtggatgtcttctttaccccacccgaaaaatgcgacactttgctgtgtgatatcggcgagtcaagccctaacccaacagtggaggctggtcgcaccctccgagtccttaatctggtggaaaactggttgaataacaatacgcaattctgcattaaggttctgaacccctacatgccgtccgtaatcgagaagatggaagccctccagagaaaatacgggggagccttagtgaggaatcctctgagtcggaactctacccacgagatgtattgggtcagcaacgcgtcaggcaatatagtgtccagtgttaacatgatcagccgcatgcttattaatagatttacaatgaggcacaagaaagctacttacgaaccagacgtggatctgggctctgggacccgaaacatcggaattgagtccgagacacccaatctagacatcataggtaagcggattgaaaaaatcaagcaggagcatgaaacttcatggcactatgatcaggaccatccttacaagacctgggcatatcacggcagctacgagacaaaacaaaccgggtcggcctctagtatggtcaacggagtggtacgtctcctgactaagccatgggacgtgatccccatggttacgcagatggctatgacagataccactccgttcggccagcagagagtctttaaagaaaaggtggacacccgcacacaagagcctaaagagggtacgaagaagttgatgaaaattaccgccgaatggctgtggaaggagctcgggaaaaagaaaactcccaggatgtgtacacgggaagagttcaccagaaaggtgcgctccaatgcagcccttggagctatatttactgatgagaacaaatggaagagcgcgagggaagccgtcgaggactcaggcttctgggaactggttgataaggagcgaaatttacacctggaaggcaaatgcgagacatgtgtgtataacatgatggggaagcgggagaaaaagttgggagaatttggtaaagcaaagggctccagagctatctggtacatgtggctcggggccaggttcctggagtttgaagcactaggattccttaatgaggaccattggttttctcgcgaaaacagcctgagtggcgtagagggtgaggggctccacaagctgggatacattttgcgtgatgtgtccaaaaaggaaggcggcgccatgtatgctgacgataccgccgggtgggacacacggatcactctggaggatctcaaaaatgaagagatggtcaccaaccatatggaaggagagcacaagaaacttgcggaggcaattttcaagctgacgtaccagaataaggtggttagagtgcagaggccaacccctcgcggtacagtcatggacatcataagccgacgggaccagagaggctctgggcaagtggtaacttatggattaaacaccttcacaaacatggaagcccagctgatcaggcagatggagggcgaaggtgtttttaaatcaattcaacagttgactgtgaaggaggagatcgctgtcaaaaattggctcattcgcgtggggagagaacggctgagtaggatggccatctccggagatgactgcgtggtcaagcccctagatgaccgtttcgcaagcgctcttaccgccctgaacgatatgggcaaagttcgaaaggacattcagcagtgggagccatctcgcggctggaatgattggacgcaagtgcccttttgctcgcatcacttccacgaactcataatgaaggacgggagagtactggtggtcccttgtcggaaccaggatgagttgatcggaagggctcgcatttcacagggtgccggctggagcttaagagaaacagcatgcctggggaaatcctacgcgcagatgtggagtctcatgtattttcatcggagggaccttcgactggccgctaatgccatctgttctgcagtgccaagccactggatcccgacctcccgtactacatggtcaattcatgctacccacgagtggatgactaccgaggatatgctaacagtttggaacagagtgtggatacaagaaaatccctggatggaggacaagacgcctgtcgaaagttgggaggaaatcccatacctgggaaaacgcgaggatcagtggtgcggctctctcattggtttgaccagccgggccacttgggcaaagaacatccagacagccattaatcaggtgaggtccctgatcgggaacgaggaatataccgactacatgccctcaatgaaaagattccgccgggaggaagaggaagcgggagtactttggtga

SEQ ID NO: 14355 - RNA, 9876 nt, synthetic construct
  misc_feature 1..9876: note = derived and/or modified CDS sequence (opt3) from DENV-2__KM279558__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaaatcacgccacagtcaagtattacagaagcagagctgaccggatacggcactgtgaccatggaatgtagcccgaggacaggtcttgacttcaatgagatggtcctgttgcagatggaaaacaaggcttggctcgtgcaccggcaatggtttctggatttacccctgccttggctcccaggggccgacacccagggctctaactggatccagaaagagactcttgttacattcaagaatccccacgcgaagaaacaggatgtggtcgtgctgggatcccaagagggcgccatgcatacggcattgaccggggctactgaaatacagatgtcaagcggaaacctactgtttacaggtcacctcaagtgccgtctgcgcatggacaaacttcagctgaagggcatgagttattctatgtgtaccgggaaattcaaggtagttaaggagattgccgaaacacaacatggaactatcgtgatcagagtccagtacgagggcgacggttccccttgcaaaattccattcgagatcatggatttggaaaagaggcacgtgctcgggcggctgattaccgtcaatcccatagtgacggagaaagacagcccggttaacatcgaagctgagcctccctttggcgattcgtacattatcatcggagtggaaccaggccagttaaagctgtcttggttcaaaaaggggtcctcaattggacagatgtttgagaccacaatgcgaggtgccaagcgcatggcaatactaggcgacactgcctgggatttcgggagtctcggaggcgtatttaccagcatcggtaaagctctgcatcaagtcttcggggcgatttatggcgcagccttttccggagtgtcttggacaatgaagatccttattggcgttgtgatcacttggatagggatgaatagcagatcaaccagtttgtccgtcagcctggtgctcgtaggagtggttacgctgtaccttggcgtcatggtgcaggctgactctggttgtgtggtctcatggaaaaacaaggagctgaaatgcgggagtggaatcttcattacagataatgttcacacctggactgaacagtataagtttcagcctgagagcccctccaagttggcctctgcaatccaaaaagcccacgaagagggcatttgtggtatcaggtcggtgacacggctcgaaaacctgatgtggaagcagataaccccagagttaaatcatattctgactgagaacgaagtgaaactaaccatcatgacaggcgacattaaggggatcatgcaggctggaaaacgcagcctcagaccccagcctacggagctgaagtactcctggaaagcctggggcaaggcaaagatgctttcaaccgaattgcacaatcatactttcctgatagatgggccagagacagcggaatgcccgaacaccaatagggcttggaacagtctcgaggtagaggactatggatttggcgtcttcacaactaatatctggctgaaattaaaggaacgtcaagatgtgttttgtgactctaaactgatgagcgccgcaattaaggacaaccgggccgttcacgctgatatgggttactggatcgagtccgcccttaacgacacctggaaaattgaaaaggcatcattcatcgaggtgaagagctgccactggcccaaatctcatacgttgtggtccaatggggtcctcgagagtgaaatgataattcctaagaacttcgctggaccagtgagccagcacaattatcgacccggctaccatacacagaccgccggtccttggcacctgggcagactagagatggattttgacttctgtgaagggactaccgttgtggtaacagaggattgcggaaacaggggcccatctctgcgcactaccacagcgtccgggaaactcatcacggaatggtgctgtcggtcatgcaccctgcccccgcttagatacaggggagaggacggctgttggtatggtatggagatccgccctttgaaggaaaaagaggaaaatctggtcaacagtttagtgactgccgggcatggacagattgataattttagcctcggcgtgctgggtatggctcttttcctggaggaaatgttgcgaacacgggtcggcaccaagcacgcaatcctcctggttgccgtgtcgtttgtaactctaattacagggaacatgtccttccgtgacctgggaagagtgatggtcatggtgggcgctaccatgacggatgacatagggatgggagttacttacctcgccctgcttgcagcgtttaaggtgaggccaaccttcgccgctggcttgctgttacgcaaactcacatctaaggagctgatgatgaccactatcggtattgtccttctgagccaatcaacaatccccgagagtattctagaactcaccgatgccctggcattggggatgatggtgctgaaaatcgttcggaatatggagaagtatcagttagctgtgacaataatggccatctcctgcgtccctaacgcagtaattctccagaatgcctggaaagtgtcttgtactaccctggctgttgtgagcgtctccccccttctgttgacgtcaagccaacagaaggcggactggatcccactcgccctgacaattaagggactaaaccctaccgcaatctttctgactacccttagtagaacatctaaaaagaggtcctggcccctcaatgaagctataatggccgtgggcatggtaagcattctggcctcgtcattgctgaaaaacgatatcccaatgactggcccgttagtggctgggggactcctgaccgtctgctacgttcttacgggtcgatctgcagacctggagttggaacgcgccgcggacgtgcggtgggaggagcaggctgaaatcagtggctccagccctattctctctataacaatcagcgaggatgggtccatgtcaattaagaatgaagaggaggaacagaccctgactatcctaattagaacaggactgcttgtgatcagtggcctcttccccgtcagcataccaatcaccgccgcagcctggtatctgtgggaggtgaaaaagcaaagggctggtgttttgtgggacgtaccctctcctccacccgtggggaaagcagaattagaggatggagcctaccgtattaagcagaagggcatcctgggctattcccagattggggcgggagtctacaaagaaggtacttttcacacaatgtggcatgtgacccgcggcgctgttctcatgcacaaggggaaacggatcgagccttcatgggccgacgtgaagaaagatctgataagttacggaggcggttggaagcttgagggggaatggaaggagggagaagaggtccaggtgctggcattggaaccgggcaaaaacccaagagccgtacaaacgaagcccggcctattcaaaactaacaccgggacaattggagctgtcagcctggacttttcccctggtacctctggctcgccaatcgtggataagaaagggaaggttgtgggactctatggcaatggtgtcgtgacaaggagcgggacttacgtttcagccatcgcacagaccgagaagtccattgaggacaaccccgaaatcgaggatgacatattccgaaaaaagcggctgacgattatggatcttcatcctggagctggcaaaacaaagcgctatttaccggccatcgtgagagaagcgattaaaaggggcctgcggactctcatcttggcccccacccgagtcgtggcagctgagatggaagaggccctgagagggctcccaatacgctaccagacacctgctattagggcagagcacaccggacgtgaaatcgtagacctgatgtgtcatgccactttcaccatgcggcttctgagtcccatcagagtgccaaattataacttgattatcatggatgaggcccactttacagaccctgcttctattgcggcaaggggttacataagcacgcgcgttgaaatgggcgaggccgctgggatcttcatgactgccacccccccaggatcccgagacccgtttcctcagtcaaatgcacccattatggatgaggaaagagagatcccagaacggtcttggaacagcggccacgagtgggtcacagacttcaagggtaagaccgtgtggtttgtgcccagtatcaaagccgggaatgatattgctgcgtgcctaaggaagaacggaaaaaaggtcatacaactgtcccgcaaaactttcgacagcgaatatatcaagacacgtaccaatgattgggactttgtagtgacgactgatatttctgagatgggcgccaacttcaaggcagagagagttatcgaccctcggaggtgtatgaaaccagtgattctcacagatggcgaagagcgcgtcatcttagctgggcccatgcctgtgacccattcatccgccgcacagcgaagaggacgggttggtaggaatccgaagaacgaaaatgaccagtacatatacatgggcgagccactggaaaacgatgaggactgcgcccactggaaagaggctaagatgcttctggacaatatcaacacccccgaagggattatccctagtatgtttgagcccgaacgcgagaaagtggatgccattgacggagaatatagactcaggggcgaggcgcggaagactttcgtcgatttgatgcgtcgcggtgacctgccagtgtggctcgcataccgagtagccgctgaggggatcaactatgccgatagaaggtggtgttttgacggcgtgaaaaataaccaaatactggaagagaatgttgaagtcgagatttggacaaaggagggagaacggaagaaacttaagcctcgctggctagatgctagaatctacagcgaccccctggcattgaaagagttcaaggaattcgccgctggcaggaaatcgttaaccctgaacctcattacagagatggggcggctgccaacttttatgacgcagaaggccaagaatgcacttgataacctggcggtgctccataccgccgaagctggaggtcgagcctataatcacgcattgtctgagctgcctgagacactagaaactctgctccttctgaccttattggctacagtgaccggcgggatcttcctgtttctcatgtccggaaaaggcataggtaagatgactctggggatgtgctgcatcattacggccagcatccttctgtggtacgcacagattcagccgcactggatcgccgcttcaataattctcgagttctttttgatcgtcctgttaatccccgaaccagagaaacaaagaacccctcaggacaaccagctaacatatgttgtgattgcgatcctgactgtagtggccgcaaccatggctaatgaaatgggcttcctcgagaagacaaaaaaggattttggacttggcagtataaccactcagcaacccgagtctaacattctggacatcgatttgcgcccagcctccgcctggacactgtacgcagtcgctacgaccttcattactcctatgctcaggcatagcatcgaaaattcaagtgtgaacgttagcctgacagccatagcgaatcaggctaccgtgcttatggggctcggaaagggttggcccctgtccaaaatggacatcggcgtcccgttgctggccattgggtgttactctcaggtaaacccaatcaccttaacagcagccctactgctccttgtggctcactatgcaattatcggacctggcctgcaggccaaggcgactcgggaggctcaaaaacgtgccgcagccggtattatgaagaatcccacggttgacgggatgaccgtgatcgatttggacccaataccctacgatcctaaatttgaaaagcagctgggccaggtcatgctcctggtgctttgcgtcacacaggtgttaatgatgagaactacctgggctctgtgtgaggccctcacattggcaaccggaccgattagcactctgtgggaaggcaaccccgggaggttctggaatacgacaatcgctgtttccatggccaacatctttcgcggatcatatctagcgggcgccggtctgctcttctctattatgaagaacaccgcaaatactcggcgagggaccggaaacacaggcgagactcttggtgagaaatggaagaatagactgaacgctttgggcaaaagtgaatttcaaatatacaagaaatcggggatccaggaggtggacaggaccctggccaaggaaggaattaaacgcggcgagacagatcatcacgcagtaagccgggggtccgctaagctcagatggttcgtggagcgtaatctggtcacgccagaaggaaaggttgtggacttaggctgcggtagggggggatggtcttattactgtggcggtcttaaaaacgtcaaggaggtgaaaggcctgaccaaggggggacctggccatgaagagcccatccctatgtcaacttatgggtggaatctcgtacggctacagagcggagtggatgttttctttacaccacccgaaaaatgcgacaccctgttgtgtgatattggcgagtccagtcctaacccaactgtggaggccggtcgcacactgcgagtcctcaatcttgtggaaaactggctgaataacaatacccaattctgcatcaaggtcttgaacccctacatgccgtctgtgatagagaagatggaagccctgcagagaaaatacgggggagcgctcgttaggaatcctttaagccggaactcaacgcacgagatgtattgggtatccaacgctagtggcaatatcgtgagctctgtcaacatgatttcccgcatgctgatcaatagatttaccatgaggcacaagaaagcaacatacgaaccagacgtggatcttggctcagggactcgaaacattggaatcgagagcgagacccccaatctggacataattggtaagcggatcgaaaaaatcaagcaggagcatgaaacatcgtggcactatgatcaggaccatccttacaagacttgggcctatcacggctcttacgagaccaaacaaacagggagtgcttccagcatggttaacggagtggtccgtctactcaccaagccatgggacgtgattcccatggtaactcagatggccatgacggatacaaccccgttcggccagcagagagtgtttaaagaaaaggttgacactcgcacccaagagcctaaagagggtacaaagaagctgatgaaaataacggcagaatggttgtggaaggagctggggaaaaagaaaacccccaggatgtgtactcgggaagagttcacaagaaaggtccgctcaaatgccgctctcggagcgatctttaccgatgagaacaaatggaagtccgccagggaagcagtggaggactctggcttctgggaacttgtggataaggagcgaaatctgcacttagaaggcaaatgcgagacttgtgtctataacatgatggggaagcgggagaaaaagctgggagaatttggtaaagctaagggcagcagagccatttggtacatgtggttgggggcaaggttcctcgagtttgaagccctgggattcctaaatgaggaccattggtttagtcgcgaaaactcccttagcggcgttgagggtgaggggctgcacaagctcggatacatcctgcgtgatgtgtctaaaaaggaaggcggcgctatgtatgccgacgatacagcggggtgggacacccggattacattggaggatctgaaaaatgaagagatggtaactaaccatatggaaggagagcacaagaaactcgcagaggccatcttcaagcttacctaccagaataaggtggtcagagtgcagaggccaacgcctcgcggtaccgttatggacataatctcacgacgggaccagagaggcagtgggcaagtggtcacatatggactgaacactttcaccaacatggaagctcagttaattaggcagatggagggcgaaggtgtgtttaaatccatccaacagctgacagtaaaggaggagattgccgttaaaaattggttgatccgcgtggggagagaacggctcagcaggatggcaatttctggagatgactgcgtcgtgaagcccctggatgaccgtttcgcttcggccctaactgctcttaacgatatgggcaaagtgcgaaaggacatacagcagtgggagccatcacgcggctggaatgattggacccaagtccccttttgcagccatcacttccacgaactgatcatgaaggacgggagagttctcgtggtaccttgtcggaaccaggatgagctgattggaagggcccgcatctcccagggtgcaggctggagtttgagagaaacggcgtgcttagggaaatcttacgcccagatgtggagcctgatgtattttcatcggagggacctccgacttgctgccaatgcaatctgttccgctgtgccatcacactggattccgacaagtcgtaccacttggtctatacatgccacacacgagtggatgaccactgaggatatgctgaccgtctggaacagagtgtggatccaagaaaatccctggatggaggacaagacacctgttgaaagctgggaggaaattccatacctaggaaaacgcgaggatcagtggtgcggctccctgatcggtctcacgtcacgggcaacctgggccaagaacattcagactgcgatcaatcaggtgaggagcttgatagggaacgaggaatatacagactacatgccctctatgaaaagattccgccgggaggaagaggaagctggagtcctgtggtga

SEQ ID NO: 14356 - RNA, 9876 nt, synthetic construct
  misc_feature 1..9876: note = derived and/or modified CDS sequence (opt3) from DENV-2__KM279564__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaaatcacgccacagtcaagtattacagaagcagagctgaccggatacggcactgtgaccatggaatgtagcccgaggacaggtcttgacttcaatgagatggtcctgttgcagatggaaaacaaggcttggctcgtgcaccggcaatggtttctggatttacccctgccttggctcccaggggccgacacccagggctctaactggatccagaaagagactcttgttacattcaagaatccccacgcgaagaaacaggatgtggtcgtgctgggatcccaagagggcgccatgcatacggcattgaccggggctactgaaatacagatgtcaagcggaaacctactgtttacaggtcacctcaagtgccgtctgcgcatggacaaacttcagctgaagggcatgagttattctatgtgtaccgggaaattcaaggtagttaaggagattgccgaaacacaacatggaactatcgtgatcagagtccagtacgagggcgacggttccccttgcaaaattccattcgagatcatggatttggaaaagaggcacgtgctcgggcggctgattaccgtcaatcccatagtgacggagaaagacagcccggttaacatcgaagctgagcctccctttggcgattcgtacattatcatcggagtggaaccaggccagttaaagctgtcttggttcaaaaaggggtcctcaattggacagatgtttgagaccacaatgcgaggtgccaagcgcatggcaatactaggcgacactgcctgggatttcgggagtctcggaggcgtatttaccagcatcggtaaagctctgcatcaagtcttcggggcgatttatggcgcagccttttccggagtgtcttggacaatgaagatccttattggcgttgtgatcacttggatagggatgaatagcagatcaaccagtttgtccgtcagcctggtgctcgtaggagtggttacgctgtaccttggcgtcatggtgcaggctgactctggttgtgtggtctcatggaaaaacaaggagctgaaatgcgggagtggaatcttcattacagataatgttcacacctggactgaacagtataagtttcagcctgagagcccctccaagttggcctctgcaatccaaaaagcccacgaagagggcatttgtggtatcaggtcggtgacacggctcgaaaacctgatgtggaagcagataaccccagagttaaatcatattctgactgagaacgaagtgaaactaaccatcatgacaggcgacattaaggggatcatgcaggctggaaaacgcagcctcagaccccagcctacggagctgaagtactcctggaaagcctggggcaaggcaaagatgctttcaaccgaattgcacaatcatactttcctgatagatgggccagagacagcggaatgcccgaacaccaatagggcttggaacagtctcgaggtagaggactatggatttggcgtcttcacaactaatatctggctgaaattaaaggaacgtcaagatgtgttttgtgactctaaactgatgagcgccgcaattaaggacaaccgggccgttcacgctgatatgggttactggatcgagtccgcccttaacgacacctggaaaattgaaaaggcatcattcatcgaggtgaagagctgccactggcccaaatctcatacgttgtggtccaatggggtcctcgagagtgaaatgataattcctaagaacttcgctggaccagtgagccagcacaattatcgacccggctaccatacacagaccgccggtccttggcacctgggcagactagagatggattttgacttctgtgaagggactaccgttgtggtaacagaggattgcggaaacaggggcccatctctgcgcactaccacagcgtccgggaaactcatcacggaatggtgctgtcggtcatgcaccctgcccccgcttagatacaggggagaggacggctgttggtatggtatggagatccgccctttgaaggaaaaagaggaaaatctggtcaacagtttagtgactgccgggcatggacagattgataattttagcctcggcgtgctgggtatggctcttttcctggaggaaatgttgcgaacacgggtcggcaccaagcacgcaatcctcctggttgccgtgtcgtttgtaactctaattacagggaacatgtccttccgtgacctgggaagagtgatggtcatggtgggcgctaccatgacggatgacatagggatgggagttacttacctcgccctgcttgcagcgtttaaggtgaggccaaccttcgccgctggcttgctgttacgcaaactcacatctaaggagctgatgatgaccactatcggtattgtccttctgagccaatcaacaatccccgagagtattctagaactcaccgatgccctggcattggggatgatggtgctgaaaatcgttcggaatatggagaagtatcagttagctgtgacaataatggccatctcctgcgtccctaacgcagtaattctccagaatgcctggaaagtgtcttgtactaccctggctgttgtgagcgtctccccccttctgttgacgtcaagccaacagaaggcggactggatcccactcgccctgacaattaagggactaaaccctaccgcaatctttctgactacccttagtagaacatctaaaaagaggtcctggcccctcaatgaagctataatggccgtgggcatggtaagcattctggcctcgtcattgctgaaaaacgatatcccaatgactggcccgttagtggctgggggactcctgaccgtctgctacgttcttacgggtcgatctgcagacctggagttggaacgcgccgcggacgtgcggtgggaggagcaggctgaaatcagtggctccagccctattctctctataacaatcagcgaggatgggtccatgtcaattaagaatgaagaggaggaacagaccctgactatcctaattagaacaggactgcttgtgatcagtggcctcttccccgtcagcataccaatcaccgccgcagcctggtatctgtgggaggtgaaaaagcaaagggctggtgttttgtgggacgtaccctctcctccacccgtggggaaagcagaattagaggatggagcctaccgtattaagcagaagggcatcctgggctattcccagattggggcgggagtctacaaagaaggtacttttcacacaatgtggcatgtgacccgcggcgctgttctcatgcacaaggggaaacggatcgagccttcatgggccgacgtgaagaaagatctgataagttacggaggcggttggaagcttgagggggaatggaaggagggagaagaggtccaggtgctggcattggaaccgggcaaaaacccaagagccgtacaaacgaagcccggcctattcaaaactaacaccgggacaattggagctgtcagcctggacttttcccctggtacctctggctcgccaatcgtggataagaaagggaaggttgtgggactctatggcaatggtgtcgtgacaaggagcgggacttacgtttcagccatcgcacagaccgagaagtccattgaggacaaccccgaaatcgaggatgacatattccgaaaaaagcggctgacgattatggatcttcatcctggagctggcaaaacaaagcgctatttaccggccatcgtgagagaagcgattaaaaggggcctgcggactctcatcttggcccccacccgagtcgtggcagctgagatggaagaggccctgagagggctcccaatacgctaccagacacctgctattagggcagagcacaccggacgtgaaatcgtagacctgatgtgtcatgccactttcaccatgcggcttctgagtcccatcagagtgccaaattataacttgattatcatggatgaggcccactttacagaccctgcttctattgcggcaaggggttacataagcacgcgcgttgaaatgggcgaggccgctgggatcttcatgactgccacccccccaggatcccgagacccgtttcctcagtcaaatgcacccattatggatgaggaaagagagatcccagaacggtcttggaacagcggccacgagtgggtcacagacttcaagggtaagaccgtgtggtttgtgcccagtatcaaagccgggaatgatattgctgcgtgcctaaggaagaacggaaaaaaggtcatacaactgtcccgcaaaactttcgacagcgaatatatcaagacacgtaccaatgattgggactttgtagtgacgactgatatttctgagatgggcgccaacttcaaggcagagagagttatcgaccctcggaggtgtatgaaaccagtgattctcacagatggcgaagagcgcgtcatcttagctgggcccatgcctgtgacccattcatccgccgcacagcgaagaggacgggttggtaggaatccgaagaacgaaaatgaccagtacatatacatgggcgagccactggaaaacgatgaggactgcgcccactggaaagaggctaagatgcttctggacaatatcaacacccccgaagggattatccctagtatgtttgagcccgaacgcgagaaagtggatgccattgacggagaatatagactcaggggcgaggcgcggaagactttcgtcgatttgatgcgtcgcggtgacctgccagtgtggctcgcataccgagtagccgctgaggggatcaactatgccgatagaaggtggtgttttgacggcgtgaaaaataaccaaatactggaagagaatgttgaagtcgagatttggacaaaggagggagaacggaagaaacttaagcctcgctggctagatgctagaatctacagcgaccccctggcattgaaagagttcaaggaattcgccgctggcaggaaatcgttaaccctgaacctcattacagagatggggcggctgccaacttttatgacgcagaaggccaagaatgcacttgataacctggcggtgctccataccgccgaagctggaggtcgagcctataatcacgcattgtctgagctgcctgagacactagaaactctgctccttctgaccttattggctacagtgaccggcgggatcttcctgtttctcatgtccggaaaaggcataggtaagatgactctggggatgtgctgcatcattacggccagcatccttctgtggtacgcacagattcagccgcactggatcgccgcttcaataattctcgagttctttttgatcgtcctgttaatccccgaaccagagaaacaaagaacccctcaggacaaccagctaacatatgttgtgattgcgatcctgactgtagtggccgcaaccatggctaatgaaatgggcttcctcgagaagacaaaaaaggattttggacttggcagtataaccactcagcaacccgagtctaacattctggacatcgatttgcgcccagcctccgcctggacactgtacgcagtcgctacgaccttcattactcctatgctcaggcatagcatcgaaaattcaagtgtgaacgttagcctgacagccatagcgaatcaggctaccgtgcttatggggctcggaaagggttggcccctgtccaaaatggacatcggcgtcccgttgctggccattgggtgttactctcaggtaaacccaatcaccttaacagcagccctactgctccttgtggctcactatgcaattatcggacctggcctgcaggccaaggcgactcgggaggctcaaaaacgtgccgcagccggtattatgaagaatcccacggttgacgggatgaccgtgatcgatttggacccaataccctacgatcctaaatttgaaaagcagctgggccaggtcatgctcctggtgctttgcgtcacacaggtgttaatgatgagaactacctgggctctgtgtgaggccctcacattggcaaccggaccgattagcactctgtgggaaggcaaccccgggaggttctggaatacgacaatcgctgtttccatggccaacatctttcgcggatcatatctagcgggcgccggtctgctcttctctattatgaagaacaccgcaaatactcggcgagggaccggaaacacaggcgagactcttggtgagaaatggaagaatagactgaacgctttgggcaaaagtgaatttcaaatatacaagaaatcggggatccaggaggtggacaggaccctggccaaggaaggaattaaacgcggcgagacagatcatcacgcagtaagccgggggtccgctaagctcagatggttcgtggagcgtaatctggtcacgccagaaggaaaggttgtggacttaggctgcggtagggggggatggtcttattactgtggcggtcttaaaaacgtcaaggaggtgaaaggcctgaccaaggggggacctggccatgaagagcccatccctatgtcaacttatgggtggaatctcgtacggctacagagcggagtggatgttttctttacaccacccgaaaaatgcgacaccctgttgtgtgatattggcgagtccagtcctaacccaactgtggaggccggtcgcacactgcgagtcctcaatcttgtggaaaactggctgaataacaatacccaattctgcatcaaggtcttgaacccctacatgccgtctgtgatagagaagatggaagccctgcagagaaaatacgggggagcgctcgttaggaatcctttaagccggaactcaacgcacgagatgtattgggtatccaacgctagtggcaatatcgtgagctctgtcaacatgatttcccgcatgctgatcaatagatttaccatgaggcacaagaaagcaacatacgaaccagacgtggatcttggctcagggactcgaaacattggaatcgagagcgagacccccaatctggacataattggtaagcggatcgaaaaaatcaagcaggagcatgaaacatcgtggcactatgatcaggaccatccttacaagacttgggcctatcacggctcttacgagaccaaacaaacagggagtgcttccagcatggttaacggagtggtccgtctactcaccaagccatgggacgtgattcccatggtaactcagatggccatgacggatacaaccccgttcggccagcagagagtgtttaaagaaaaggttgacactcgcacccaagagcctaaagagggtacaaagaagctgatgaaaataacggcagaatggttgtggaaggagctggggaaaaagaaaacccccaggatgtgtactcgggaagagttcacaagaaaggtccgctcaaatgccgctctcggagcgatctttaccgatgagaacaaatggaagtccgccagggaagcagtggaggactctggcttctgggaacttgtggataaggagcgaaatctgcacttagaaggcaaatgcgagacttgtgtctataacatgatggggaagcgggagaaaaagctgggagaatttggtaaagctaagggcagcagagccatttggtacatgtggttgggggcaaggttcctcgagtttgaagccctgggattcctaaatgaggaccattggtttagtcgcgaaaactcccttagcggcgttgagggtgaggggctgcacaagctcggatacatcctgcgtgatgtgtctaaaaaggaaggcggcgctatgtatgccgacgatacagcggggtgggacacccggattacattggaggatctgaaaaatgaagagatggtaactaaccatatggaaggagagcacaagaaactcgcagaggccatcttcaagcttacctaccagaataaggtggtcagagtgcagaggccaacgcctcgcggtaccgttatggacataatctcacgacgggaccagagaggcagtgggcaagtggtcacatatggactgaacactttcaccaacatggaagctcagttaattaggcagatggagggcgaaggtgtgtttaaatccatccaacagctgacagtaaaggaggagattgccgttaaaaattggttgatccgcgtggggagagaacggctcagcaggatggcaatttctggagatgactgcgtcgtgaagcccctggatgaccgtttcgcttcggccctaactgctcttaacgatatgggcaaagtgcgaaaggacatacagcagtgggagccatcacgcggctggaatgattggacccaagtccccttttgcagccatcacttccacgaactgatcatgaaggacgggagagttctcgtggtaccttgtcggaaccaggatgagctgattggaagggcccgcatctcccagggtgcaggctggagtttgagagaaacggcgtgcttagggaaatcttacgcccagatgtggagcctgatgtattttcatcggagggacctccgacttgctgccaatgcaatctgttccgctgtgccatcacactggattccgacaagtcgtaccacttggtctatacatgccacacacgagtggatgaccactgaggatatgctgaccgtctggaacagagtgtggatccaagaaaatccctggatggaggacaagacacctgttgaaagctgggaggaaattccatacctaggaaaacgcgaggatcagtggtgcggctccctgatcggtctcacgtcacgggcaacctgggccaagaacattcagactgcgatcaatcaggtgaggagcttgatagggaacgaggaatatacagactacatgccctctatgaaaagattccgcatcgaggaagaggaagctggagtcctgtggtga

SEQ ID NO: 14357 - RNA, 9876 nt, synthetic construct
  misc_feature 1..9876: note = derived and/or modified CDS sequence (opt3) from DENV-2__KM279595__SS-prME
  source 1..9876: mol_type = other RNA
accgccggcatcattataatgatgatccccacagtgatggctttccacctgactacgcgaaacggggagcctcatatgattgtcagcaggcaggaaaaggggaaatccctcctttttaagaccgagaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcacgctcagaccccagcctaccgagctgaagtacagctggaaagcctggggcaaggcaaagatgctttccactgaattgcacaatcatacattcctgatcgatgggccagagaccgcggaatgcccgaacacaaatagggcttggaactcactcgaggtcgaggactatggatttggcgtgttcactaccaatatatggctgaaattaaaggaacgtcaagatgtattttgtgacagtaaactgatgtctgccgcaatcaaggacaaccgggccgtgcacgctgatatgggttactggattgagagcgcccttaacgacacgtggaaaatcgaaaaggcatccttcattgaggtcaagtcatgccactggcccaaaagccatacattgtggtctaatggggtgctcgagtccgaaatgatcatacctaagaacttcgctggaccagttagtcagcacaattatcgacccggctaccatacccagactgccggtccttggcacctgggcagactagagatggattttgacttctgtgaagggaccacagtggtagtcactgaggattgcggaaacaggggcccaagcctgcgcaccacaacggcgtctgggaaactcattaccgaatggtgctgtcggtcctgcactctgcccccgcttagatacaggggagaggacggctgttggtatggtatggagatccgccctttgaaggaaaaagaggaaaatctggtgaactcattagtgacagccgggcatggacagatcgataattttagtctcggcgtcctgggtatggctcttttcctggaggaaatgttgcgaacccgggttggcactaagcacgcaattctcctggtggccgttagctttgtgacactaatcaccgggaacatgtcgttccgtgacctgggaagagtcatggtgatggttggcgctacgatgactgatgacattgggatgggagtgacctacctcgccctgcttgcagcgtttaaggtcaggccaacattcgccgctggcttgctgttacgcaaactcacctccaaggagctgatgatgactacaataggtatcgtgcttctgtctcaaagcaccattcccgagtcaatcctagaactcacagatgccctggcattggggatgatggttctgaaaattgtgcggaatatggagaagtatcagttagctgtcactatcatggccatactctgcgtacctaacgcagtgatcctgcagaatgcctggaaagttagttgtaccacgcttgctgtggtctccgtgtctcccctgttgctcacaagctcccaacagaaggcggactggattccactggccctaaccatcaagggactgaaccctactgcaatttttcttaccacactctcaagaactagcaaaaagaggagttggcccctgaatgaagctatcatggccgtaggcatggtgtctatattggcctccagcctgctaaagaatgatattccaatgaccggcccgctcgtcgctgggggactgcttacggtttgctacgtgctgacaggtcgatcggcagacttggagctcgaacgcgccgcggacgtgcggtgggaggagcaggctgaaatctcaggctctagtcctatcctgtccattaccataagcgaggatgggtctatgagcatcaagaatgaagaggaggaacagactctaacaattctgatcagaaccggacttctcgtcatttccggcctgttccccgtgtcaatcccaataactgccgcagcctggtatttgtgggaggttaaaaagcaaagggctggtgtattatgggacgtgcccagtcctccacccgtcgggaaagcagaactggaggatggagcctaccgtatcaagcagaagggcattctcggctatagccagatcggggcgggagtgtacaaagaaggtacatttcacaccatgtggcatgttacgcgcggcgctgtgctgatgcacaaggggaaacggattgagccttcttgggccgacgtcaagaaagatcttatctcctacggaggcggttggaagctggagggggaatggaaggagggagaagaggtgcaggtattggcactagaaccgggcaaaaacccaagagccgtccaaactaagcccggcctgttcaaaaccaacacagggaccataggagctgtgtcactcgactttagtcctggtacaagcggctccccaattgttgataagaaagggaaggtggtcggactgtatggcaatggtgtggttactaggtctgggacctacgtgtcggccatcgcacagacggagaagaacatcgaggacaatcccgaaattgaggatgacatcttccggaaaaagagacttacaataatggatttacatcctggagctggcaaaactaagcgctatctgccggccattgtcagagaagcgatcaaaaggggcctccggaccttgattctggcccccacacgagtggtagcagctgagatggaagaggccctcagagggctgccaatccgctaccagacccctgctataagggcagagcacactggacgtgaaattgtggaccttatgtgtcatgccaccttcacaatgcggctgttgagccccatcagagttccaaactataatctaatcattatggatgaggcccactttacggaccctgcttcaatcgcggcaaggggttacatttccactcgcgtcgaaatgggcgaggccgctgggatattcatgaccgccacacccccaggaagtcgagacccgtttcctcagtctaacgcacccatcatggatgaggaaaaggagattccagaaagaagctggaactccggccacgagtgggtgaccgacttcaagggtaaaactgtgtggtttgtcccctcaatcaaggccgggaacgatatcgctgcgtgcctgcggaaaaatggaaagaaagtaattcaactctctaggaagacattcgacagcgaatatataaagacccgcacgaacgattgggactttgtggttactacagatatcagtgagatgggcgccaatttcaaagcagagcgtgtgattgaccctagacggtgtatgaagccagtcatcttaaccgatggcgaagagagggtgattctggctgggcccatgcctgttacccattccagcgccgcacagcgccgaggaagagtgggtcggaacccgaaaaatgaaaacgaccagtacatctacatgggcgagccacttgaaaatgatgaggactgcgcccactggaaggaggctaaaatgctgctcgacaacataaacactcccgaagggatcattccttctatgtttgagcccgaaagggagaaggtcgatgccatcgacggagaatatcgcttgagaggcgaggcgaggaaaacattcgtggatctgatgcggcgtggtgacctcccagtatggctggcataccgcgtggccgctgaggggattaattatgccgatcgaagatggtgttttgacggcgttaagaacaatcaaatccttgaagagaacgtcgaagtggagatatggaccaaggagggagaaaggaaaaagctaaaacctcggtggctggatgctcgcatttactcagaccccttggcattaaaggagttcaaagagttcgccgctggcagaaagtccctgacactcaatctgatcactgagatggggaggcttccaacgtttatgacccagaaggccaaaaacgcactggataatctcgcggtgttgcatacagccgaagctggaggtcgggcctataaccacgcactgagtgagctacctgagactctggaaaccctccttctgttaacattgctggctaccgtcactggcgggattttcctctttctgatgagcggaaagggcatcggtaaaatgacgcttgggatgtgctgcataatcaccgcctcgattctgctctggtacgcacagatccagccgcactggattgccgcttctatcatattggagttctttctgattgttttactaatccccgaaccagagaagcaacgaacacctcaggacaatcagctgacttatgtggtaatcgcgattctcaccgtggtcgccgcaacaatggctaacgaaatgggcttccttgagaaaaccaagaaggattttggactgggctccatcactacacagcaacccgagagcaatatattggacattgatctgagaccagcctcagcctggacgctctacgcagtggctaccactttcatcacacctatgctgcgccatagtattgaaaactcttccgttaatgtgagccttaccgccatcgcgaaccaggctaccgtcctcatggggctgggaaaaggttggcccttgtcaaagatggacataggcgtaccgctgttagccatcgggtgttacagtcaggtgaatccaattacactaactgcagccctgctccttctggttgctcactatgcaatcattggacctggcttgcaggccaaagcgacgagggaggctcaaaagcgggccgcagccggtatcatgaaaaaccccaccgtggacgggatgacagtcattgatctggacccaatcccctacgatcctaagtttgaaaagcagctcggccaggtgatgctgcttgtcttatgcgtgactcaggttctgatgatgcgtaccacatgggctctctgtgaggccttgaccctggcaactggaccgataagcacgctatgggaaggcaatcccgggagattctggaacacaaccattgctgtgtccatggccaacatctttaggggatcttatctggcgggcgccggtctccttttcagcatcatgaaaaatactgcaaacacccgccgggggacaggaaatactggcgagaccctgggtgagaagtggaaaaaccgattgaatgctctgggcaagtccgaatttcaaatttacaaaaagtcagggatacaggaggtagacagaacactcgccaaagaaggaatcaagaggggcgagacggatcatcacgcagtgtctcgcgggagtgctaagctgcggtggttcgtcgagagaaacttagttaccccagaaggaaaagtggtcgaccttggctgcggtcgtgggggatggtcgtattactgtggcggtctgaagaatgtgaaagaggtaaagggcctcactaaagggggacctggccatgaagaacccattcctatgagcacatatgggtggaacctagtgaggctgcagtccggagttgatgtgttctttaccccacccgaaaagtgcgacactttgctgtgtgatatcggcgagtcttcacctaatccaacagtcgaggccggtcggaccctccgcgtgcttaacctggtcgaaaattggttgaacaataacacgcaattctgcattaaggtgctgaatccctacatgccgagcgttatcgagaaaatggaagccctccagcgaaagtacgggggagcgttagtaagaaaccctctgtccaggaacagtacccacgagatgtattgggtgtctaatgctagcggcaacatagtctcatccgtgaatatgatcagtcggatgcttattaaccgctttacaatgagacacaaaaaggcaacttacgaaccagacgttgatctgggcagcgggaccaggaatatcggaattgagtctgagacacccaacctagacatcataggtaaacgaattgaaaagatcaagcaggagcatgaaacttcctggcactatgatcaggaccatccttacaaaacctgggcctatcacggctcatacgagacaaagcaaaccgggagcgcttcgtctatggtgaatggagtcgtgcggctcctgactaaaccatgggacgtaatccccatggtgacgcagatggccatgacagataccactccgttcggccagcagcgtgtttttaaggaaaaagtcgacaccagaacacaagagcctaaggagggtacgaagaaattgatgaagattaccgcagaatggctgtggaaagagctcgggaagaaaaagactccccgcatgtgtacaagggaagagttcacccggaaagtgagaagtaacgccgctcttggagcgatatttactgatgagaataagtggaagtccgcccgcgaagcagtggaggacagcggcttctgggaactggtcgataaagagaggaacttacacctggaaggcaagtgcgagacatgtgtttataatatgatggggaaacgagagaagaaattgggagaatttggtaaggctaagggctcacgggccatctggtacatgtggctcggggcaagattcctggagtttgaagccctaggattccttaacgaggaccattggttttccagggaaaattctctgagcggcgtggagggtgaggggctccacaaactgggatacattttgcgcgatgtaagtaagaaagaaggcggcgctatgtatgccgacgataccgcggggtgggacacacgtatcactctggaggatctcaagaacgaagagatggtgaccaatcatatggaaggagagcacaagaaacttgcagaggccattttcaaactgacgtaccagaacaaagtcgtgcgggttcagagaccaacccctaggggtacagtgatggacatcatatcccgccgagaccagcggggcagcgggcaagtcgtgacttatggattaaacaccttcacaaatatggaagctcagctgatcagacagatggagggcgaaggtgtatttaagtctattcaacagttgactgttaaagaggagatcgccgtgaaggattggctcattagggtcgggcgcgaaagactgtcacggatggcaatcagtggagacgattgcgtggtgaaacccctagacgataggttcgcttccgcccttaccgctctgaacgacatgggcaaggtccgtaaggatattcagcagtgggagccaagccgaggctggaatgactggacgcaagttcccttttgctctcatcacttccacgaactcataatgaaagatgggcgcgtgctggtagtgccttgtagaaaccaggacgagttgatcggacgggccaggatttcgcagggtgcaggctggtcattacgcgaaacagcgtgcctgggaaagagctacgcccagatgtggtccctcatgtattttcatagacgggatcttaggctggctgccaatgcaatctgtagtgctgtcccatctcactggatcccgaccagccgaactacatggtccattcatgccacccacgagtggatgactaccgaggacatgctaacagtgtggaaccgtgtttggatacaagaaaatccctggatggaggataaaacgcctgtggaatcatgggaggaaatcccatacctgggaaagagagaggaccagtggtgcggcagtctcattggtttgacctctcgcgcaacttgggccaaaaacatccagacagcgattaatcaggtccggagcctgatcgggaacgaggaatataccgactacatgccctccatgaagaggttcagacgcgaggaagaggaagctggagtgctttggtga

SEQ ID NO: 14358 - RNA, 9876 nt, synthetic construct
  misc_feature 1..9876: note = derived and/or modified CDS sequence (opt3) from DENV-2__KM279566__SS-prME
  source 1..9876: mol_type = other RNA
accgccggcatcattataatgatgatccccacagtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcacgctcagaccccagcctaccgagctgaagtacagctggaaagcctggggcaaggcaaagatgctttccactgaattgcacaatcatacattcctgatcgatgggccagagaccgcggaatgcccgaacacaaatagggcttggaactcactcgaggtcgaggactatggatttggcgtgttcactaccaatatatggctgaaattaaaggaacgtcaagatgtattttgtgacagtaaactgatgtctgccgcaatcaaggacaaccgggccgtgcacgctgatatgggttactggattgagagcgcccttaacgacacgtggaaaatcgaaaaggcatccttcattgaggtcaagtcatgccactggcccaaaagccatacattgtggtctaatggggtgctcgagtccgaaatgatcatacctaagaacttcgctggaccagttagtcagcacaattatcgacccggctaccatacccagactgccggtccttggcacctgggcagactagagatggattttgacttctgtgaagggaccacagtggtagtcactgaggattgcggaaacaggggcccaagcctgcgcaccacaacggcgtctgggaaactcattaccgaatggtgctgtcggtcctgcactctgcccccgcttagatacaggggagaggacggctgttggtatggtatggagatccgccctttgaaggaaaaagaggaaaatctggtgaactcattagtgacagccgggcatggacagatcgataattttagtctcggcgtcctgggtatggctcttttcctggaggaaatgttgcgaacccgggttggcactaagcacgcaattctcctggtggccgttagctttgtgacactaatcaccgggaacatgtcgttccgtgacctgggaagagtcatggtgatggttggcgctacgatgactgatgacattgggatgggagtgacctacctcgccctgcttgcagcgtttaaggtcaggccaacattcgccgctggcttgctgttacgcaaactcacctccaaggagctgatgatgactacaataggtatcgtgcttctgtctcaaagcaccattcccgagtcaatcctagaactcacagatgccctggcattggggatgatggttctgaaaattgtgcggaatatggagaagtatcagttagctgtcactatcatggccatactctgcgtacctaacgcagtgatcctgcagaatgcctggaaagttagttgtaccacgcttgctgtggtctccgtgtctcccctgttgctcacaagctcccaacagaaggcggactggattccactggccctaaccatcaagggactgaaccctactgcaatttttcttaccacactctcaagaactagcaaaaagaggagttggcccctgaatgaagctatcatggccgtaggcatggtgtctatattggcctccagcctgctaaagaacgatattccaatgaccggcccgctcgtcgctgggggactgcttacggtttgctacgtgctgacaggtcgatcggcagacttggagctcgaacgcgccgcggacgtgcggtgggaggagcaggctgaaatctcaggctctagtcctatcctgtccattaccataagcgaggatgggtctatgagcatcaagaatgaagaggaggaacagactctaacaattctgatcagaaccggacttctcgtcatttccggcctgttccccgtgtcaatcccaataactgccgcagcctggtatttgtgggaggttaaaaagcaaagggctggtgtattatgggacgtgcccagtcctccacccgtcgggaaagcagaactggaggatggagcctaccgtatcaagcagaagggcattctcggctatagccagatcggggcgggagtgtacaaagaaggtacatttcacaccatgtggcatgttacgcgcggcgctgtgctgatgcacaaggggaaacggattgagccttcttgggccgacgtcaagaaagatcttatctcctacggaggcggttggaagctggagggggaatggaaggagggagaagaggtgcaggtattggcactagaaccgggcaaaaacccaagagccgtccaaactaagcccggcctgttcaaaaccaacacagggaccataggagctgtgtcactcgactttagtcctggtacaagcggctccccaattgttgataagaaagggaaggtggtcggactgtatggcaatggtgtggttactaggtctgggacctacgtgtcggccatcgcacagacggaaaagagcatcgaggacaaccccgaaattgaggatgacatcttcagaaagaagcggcttacaataatggatttacatcctggagctggcaaaactaagcgctatctgccggccattgtcagagaagcgatcaaaaggggcctccggaccttgattctggcccccacacgagtggtagcagctgagatggaagaggccctcagagggctgccaatccgctaccagacccctgctataagggcagagcacactggacgtgaaattgtggaccttatgtgtcatgccaccttcacaatgcggctgttgtcacccatcagagttccaaattataacctaatcattatggatgaggcccactttacggaccctgcttccatcgcggcaaggggttacattagtactcgcgtcgaaatgggcgaggccgctgggatattcatgaccgccacacccccaggatctcgagacccgtttcctcagagcaatgcacccatcatggatgaggaaaaggagattccagaaagatcctggaactcaggccacgagtgggtgaccgacttcaagggtaaaactgtgtggtttgtcccctctatcaaggccgggaatgatatcgctgcgtgcctgcggaaaaacggaaagaaagtaattcaactcagcaggaagacattcgacagtgaatatataaagacccgcacgaatgattgggactttgtggttactacagatatctccgagatgggcgccaacttcaaagcagagcgtgtgattgaccctagacggtgtatgaagccagtcatcttaaccgatggcgaagagagggtgattctggctgggcccatgcctgttacccatagctctgccgcacagcgccgaggaagagtgggtcggaatccgaaaaacgaaaatgaccagtacatctacatgggcgagccacttgaaaacgatgaggactgcgcccactggaaggaggctaaaatgctgctcgacaatataaacactcccgaagggatcattccttcaatgtttgagcccgaaagggagaaggtcgatgccatcgacggagaatatcgcttgagaggcgaggcgaggaaaacattcgtggatctgatgcggcgtggtgacctcccagtatggctggcataccgcgtggccgctgaggggattaactatgccgatcgaagatggtgttttgacggcgttaagaataaccaaatccttgaagagaatgtcgaagtggagatatggaccaaggagggagaaaggaaaaagctaaaacctcggtggctggatgctcgcatttactccgaccccttggcattaaaggagttcaaagagttcgccgctggcagaaagagtctgacactcaacctgatcactgagatggggaggcttccaacgtttatgacccagaaggccaaaaatgcactggataacctcgcggtgttgcatacagccgaagctggaggtcgggcctataatcacgcactgagcgagctacctgagactctggaaaccctccttctgttaacattgctggctaccgtcactggcgggattttcctctttctgatgtcgggaaagggcatcggtaaaatgacgcttgggatgtgctgcataatcaccgcctctattctgctctggtacgcacagatccagccgcactggattgccgcttccatcatattggagttctttctgattgttttactaatccccgaaccagagaagcaacgaacacctcaggacaaccagctgacttatgtggtaatcgcgattctcaccgtggtcgccgcaacaatggctaatgaaatgggcttccttgagaaaaccaagaaggattttggactgggcagcatcactacacagcaacccgagtcaaacatattggacattgatctgagaccagccagtgcctggacgctctacgcagtggctaccactttcatcacacctatgctgcgccattctattgaaaattccagcgttaacgtgtcacttaccgccatcgcgaatcaggctaccgtcctcatggggctgggaaaaggttggcccttgagtaagatggacataggcgtaccgctgttagccatcgggtgttacagccaggtgaacccaattacactaactgcagccctgctccttctggttgctcactatgcaatcattggacctggcttgcaggccaaagcgacgagggaggctcaaaagcgggccgcagccggtatcatgaaaaatcccaccgtggacgggatgacagtcattgatctggacccaatcccctacgatcctaagtttgaaaagcagctcggccaggtgatgctgcttgtcttatgcgtgactcaggttctgatgatgcgtaccacatgggctctctgtgaggccttgaccctggcaactggaccgatatccacgctatgggaaggcaaccccgggagattctggaatacaaccattgctgtgtctatggccaacatctttaggggaagctatctggcgggcgccggtctccttttctccatcatgaaaaacactgcaaatacccgccgggggacaggaaacactggcgagaccctgggtgagaagtggaaaaatcgattgaacgctctgggcaagtcagaatttcaaatttacaaaaagtctgggatacaggaggtagacagaacactcgccaaagaaggaatcaagaggggcgagacggatcatcacgcagtgagtcgcgggtcggctaagctgcggtggttcgtcgagagaaatttagttaccccagaaggaaaagtggtcgaccttggctgcggtcgtgggggatggagctattactgtggcggtctgaagaacgtgaaagaggtaaagggcctcactaaagggggacctggccatgaggaacccattcctatgtccacatatgggtggaatctagtgaggctgcagtctggagttgatgtgttctttaccccacccgaaaagtgcgacactttgctgtgtgatatcggcgagtcaagccctaacccaacagtcgaggccggtcggaccctccgcgtgcttaatctggtcgaaaactggttgaataacaatacgcaattctgcattaaggtgctgaacccctacatgccgtccgttatcgagaaaatggaagccctccagcgaaagtacgggggagcgttagtaagaaatcctctgagtaggaactctacccacgagatgtattgggtgagcaacgcttcaggcaatatagtctccagtgtgaacatgatcagccggatgcttattaatcgctttacaatgagacacaaaaaggcaacttacgaaccagacgttgatctgggctctgggaccaggaacatcggaattgagtccgagacacccaatctagacatcataggtaaacgaattgaaaagatcaagcaggagcatgaaacttcatggcactatgatcaggaccatccttacaaaacctgggcctatcacggcagctacgagacaaagcaaaccgggtcggcttctagtatggtgaacggagtcgtgcggctcctgactaaaccatgggacgtaatccccatggtgacgcagatggccatgacagataccactccgttcggccagcagcgtgtttttaaggaaaaagtcgacaccagaacacaagagcctaaggagggtacgaagaaattgatgaagattaccgcagaatggctgtggaaagagctcgggaagaaaaagactccccgcatgtgtacaagggaagagttcacccggaaagtgagatccaatgccgctcttggagcgatatttactgatgagaacaagtggaaaagcgcccgcgaagcagtggaggactcaggcttctgggaactggtcgataaagagaggaatttacacctggaaggcaagtgcgagacatgtgtttataacatgatggggaaacgagagaagaaattgggagaatttggtaaggctaagggctcccgggccatctggtacatgtggctcggggcaagattcctggagtttgaagccctaggattccttaatgaggaccattggttttctagggaaaacagcctgagtggcgtggagggtgaggggctccacaaactgggatacattttgcgcgatgtatccaagaaagaaggcggcgctatgtatgccgacgataccgcggggtgggacacacgtatcactctggaggatctcaagaatgaagagatggtgaccaaccatatggaaggagagcacaagaaacttgcagaggccattttcaaactgacgtaccagaataaagtcgtgcgggttcagagaccaacccctaggggtacagtgatggacatcataagccgccgagaccagcggggctctgggcaagtcgtgacttatggattaaacaccttcacaaacatggaagctcagctgatcagacagatggagggcgaaggtgtatttaagtcaattcaacagttgactgttaaagaggagatcgccgtgaagaattggctcattagggtcgggcgcgaaagactgagtcggatggcaatctccggagatgactgcgtggtgaaacccctagatgacaggttcgctagcgcccttaccgctctgaacgatatgggcaaggtccgtaaggacattcagcagtgggagccatctcgaggctggaatgattggacgcaagttcccttttgctcgcatcacttccacgaactcataatgaaagacgggcgcgtgctggtagtgccttgtagaaaccaggatgagttgatcggacgggccaggatttcacagggtgcaggctggagcttacgcgaaacagcgtgcctggggaagtcctacgcccagatgtggagtctcatgtattttcatagacgggaccttaggctggctgccaatgcaatctgttctgctgtcccaagccactggatcccgacctcccgaactacatggtcaattcatgccacccacgagtggatgactaccgaggatatgctaacagtgtggaaccgtgtttggatacaagaaaatccctggatggaggacaaaacgcctgtggaaagttgggaggaaatcccatacctgggaaagagagaggatcagtggtgcggctctctcattggtttgaccagccgcgcaacttgggccaaaaacatccagacagcgattaatcaggtccggtccctgatcgggaacgaggaatataccgactacatgccctcaatgaagaggttcagacgcgaggaagaggaagctggagtgctttggtga

SEQ ID NO: 14359 - RNA, 9876 nt, synthetic construct
  misc_feature 1..9876: note = derived and/or modified CDS sequence (opt3) from DENV-2__KM279574__SS-prME
  source 1..9876: mol_type = other RNA
accgccggcatcattataatgatgatccccacagtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcacgctcagaccccagcctaccgagctgaagtacagctggaaagcctggggcaaggcaaagatgctttccactgaattgcacaatcatacattcctgatcgatgggccagagaccgcggaatgcccgaacacaaatagggcttggaactcactcgaggtcgaggactatggatttggcgtgttcactaccaatatatggctgaaattaaaggaacgtcaagatgtattttgtgacagtaaactgatgtctgccgcaatcaaggacaaccgggccgtgcacgctgatatgggttactggattgagagcgcccttaacgacacgtggaaaatcgaaaaggcatccttcattgaggtcaagtcatgccactggcccaaaagccatacattgtggtctaatggggtgctcgagtccgaaatgatcatacctaagaacttcgctggaccagttagtcagcacaattatcgacccggctaccatacccagactgccggtccttggcacctgggcagactagagatggattttgacttctgtgaagggaccacagtggtagtcactgaggattgcggaaacaggggcccaagcctgcgcaccacaacggcgtctgggaaactcattaccgaatggtgctgtcggtcctgcactctgcccccgcttagatacaggggagaggacggctgttggtatggtatggagatccgccctttgaaggaaaaagaggaaaatctggtgaactcattagtgacagccgggcatggacagatcgataattttagtctcggcgtcctgggtatggctcttttcctggaggaaatgttgcgaacccgggttggcactaagcacgcaattctcctggtggccgttagctttgtgacactaatcaccgggaacatgtcgttccgtgacctgggaagagtcatggtgatggttggcgctacgatgactgatgacattgggatgggagtgacctacctcgccctgcttgcagcgtttaagataaggccaacattcgccgctggcttgctgttacgcaaactcacctccaaggagctgatgatgactacaatcggtattgtccttctgtctcaaagcaccatccccgagtcaattctagaactcacagatgccctggcattggggatgatggtgctgaaaatcgttcggaatatggagaagtatcagttagctgtgactataatggccatcctctgcgtccctaacgcagtaattctgcagaatgcctggaaagtgagttgtaccacgcttgctgttgtgtccgtctctcccctgttgctcacaagctcccaacagaaggcggactggatcccactggccctaaccattaagggactgaaccctactgcaatctttcttaccacactctcaagaactagcaaaaagaggagttggcccctgaatgaagctataatggccgtgggcatggtatctattttggcctccagcctgctcaaaaacgatatcccaatgaccggcccgctagtggctgggggactgcttacggtctgctacgttctgacaggtcgatcggcagacttggagctcgaacgcgccgcggacgtgcggtgggaggagcaggctgaaatctcaggctctagtcctattctgtccataaccatcagcgaggatgggtctatgagcattaagaatgaagaggaggaacagactctaacaatcctgattagaaccggacttctcgtgatctccggcctgttccccgtctcaataccaatcactgccgcagcctggtatttgtgggaggtgaaaaagcaaagggctggtgttttatgggacgtacccagtcctccacccgtggggaaagcagaactggaggatggagcctaccgtattaagcagaagggcatcctcggctatagccagattggggcgggagtctacaaagaaggtacatttcacaccatgtggcatgtgacgcgcggcgctgttctgatgcacaaggggaaacggatcgagccttcttgggccgacgtgaagaaagatcttatatcctacggaggcggttggaagctggagggggaatggaaggagggagaagaggtccaggtgttggcactagaaccgggcaaaaacccaagagccgtacaaactaagcccggcctgttcaaaaccaacacagggaccattggagctgtctcactcgactttagtcctggtacaagcggctccccaatcgtggataagaaagggaaggttgtgggactgtatggcaatggtgtcgtgactaggtctgggacctacgtttcggccatcgcacagacggaaaagagcattgaggacaaccccgaaatcgaggatgacatattccggaaaaagagacttacaattatggatttacatcctggagctggcaaaactaagcgctatctgccggccatcgtgagagaagcgattaaaaggggcctccggaccttgatcctggcccccacacgagtcgtggcagctgagatggaagaggccctcagagggctgccaatacgctaccagacccctgctattagggcagagcacactggacgtgaaatcgtagaccttatgtgtcatgccaccttcacaatgcggctgttgtcacccatcagagtgccaaattataacctaattatcatggatgaggcccactttacggaccctgcttccattgcggcaaggggttacataagtactcgcgttgaaatgggcgaggccgctgggatcttcatgaccgccacacccccaggatctcgagacccgtttcctcagagcaatgcacccattatggatgaggaaaaggagatcccagaaagatcctggaactcaggccacgagtgggtcaccgacttcaagggtaaaactgtgtggtttgtgccctctatcaaggccgggaatgatattgctgcgtgcctgcggaaaaacggaaagaaagtcatacaactcagcaggaagacattcgacagtgaatatatcaagacccgcacgaatgattgggactttgtagtgactacagatatttccgagatgggcgccaacttcaaagcagagcgtgttatcgaccctagacggtgtatgaagccagtgattttaaccgatggcgaagagagggtcatcctggctgggcccatgcctgtgacccatagctctgccgcacagcgccgaggaagagttggtcggaatccgaaaaacgaaaatgaccagtacatatacatgggcgagccacttgaaaacgatgaggactgcgcccactggaaggaggctaaaatgctgctcgacaatatcaacactcccgaagggattatcccttcaatgtttgagcccgaaagggagaaggtggatgccattgacggagaatatcgcttgagaggcgaggcgaggaaaacattcgtcgatctgatgcggcgtggtgacctcccagtgtggctggcataccgcgtagccgctgaggggatcaactatgccgatcgaagatggtgttttgacggcgtgaagaataaccaaatacttgaagagaatgttgaagtcgagatttggaccaaggagggagaaaggaaaaagctaaaacctcggtggctggatgctcgcatctactccgaccccttggcattaaaggagttcaaagagttcgccgctggcagaaagagtctgacactcaacctgattactgagatggggaggcttccaacgtttatgacccagaaggccaaaaatgcactggataacctcgcggtgttgcatacagccgaagctggaggtcgggcctataatcacgcactgagcgagctacctgagactctggaaaccctccttctgttaacattgctggctaccgtgactggcgggatcttcctctttctgatgtcgggaaagggcataggtaaaatgacgcttgggatgtgctgcatcattaccgcctctatcctgctctggtacgcacagattcagccgcactggatcgccgcttccataattttggagttctttctgatcgtcttactaatccccgaaccagagaagcaacgaacacctcaggacaaccagctgacttatgttgtgattgcgatcctcaccgtagtggccgcaacaatggctaatgaaatgggcttccttgagaaaaccaagaaggattttggactgggcagcataactacacagcaacccgagtcaaacattttggacatcgatctgagaccagccagtgcctggacgctctacgcagtcgctaccactttcattacacctatgctgcgccattctatcgaaaattccagcgtgaacgtttcacttaccgccatagcgaatcaggctaccgtgctcatggggctgggaaaaggttggcccttgagtaagatggacatcggcgtcccgctgttagccattgggtgttacagccaggtaaacccaatcacactaactgcagccctgctccttctggtggctcactatgcaattatcggacctggcttgcaggccaaagcgacgagggaggctcaaaagcgggccgcagccggtattatgaaaaatcccaccgttgacgggatgacagtgatcgatctggacccaataccctacgatcctaagtttgaaaagcagctcggccaggtcatgctgcttgtgttatgcgtcactcaggtgctgatgatgcgtaccacatgggctctctgtgaggccttgaccctggcaactggaccgatttccacgctatgggaaggcaaccccgggagattctggaatacaaccatcgctgtttctatggccaacatctttaggggaagctatctggcgggcgccggtctccttttctccattatgaaaaacactgcaaatacccgccgggggacaggaaacactggcgagaccctgggtgagaagtggaaaaatcgattgaacgctctgggcaagtcagaatttcaaatatacaaaaagtctgggatccaggaggtggacagaacactcgccaaagaaggaattaagaggggcgagacggatcatcacgcagtaagtcgcgggtcggctaagctgcggtggttcgtggagagaaatttagtcaccccagaaggaaaagttgtggaccttggctgcggtcgtgggggatggagctattactgtggcggtctgaagaacgtcaaagaggtgaagggcctcactaaagggggacctggccatgaggaacccatccctatgtccacatatgggtggaatctagtaaggctgcagtctggagtggatgttttctttacctcaccagaaaagtgcgacactttgctgtgtgatattggcgagagctcccccaaccctacagtggaggccggtcggaccctccgcgtccttaatctggtggaaaactggttgaataacaatacgcaattctgcatcaaggtcctgaacccatacatgcccagtgtgatagagaaaatggaagccctccagcgaaagtacgggggagcgttagttagaaatccgctgtctaggaacagcacccacgagatgtattgggtatcaaacgcttccggcaatatcgtgagtagcgtcaacatgatttctcggatgcttatcaatcgctttacaatgagacacaaaaaggcaacttacgaacctgacgtggatctgggctccgggaccaggaacattggaatcgagtcagagacaccaaatctagacataattggtaaacgaatcgaaaagatcaagcaggagcatgaaactagctggcactatgatcaggaccatccctacaaaacctgggcctatcacggctcgtacgagacaaagcaaaccgggtctgctagttccatggttaacggagtggtccggctcctgactaaaccttgggacgtgattccaatggtaacgcagatggccatgacagataccactcccttcggccagcagcgtgtgtttaaggaaaaagttgacaccagaacacaagagccgaaggagggtacgaagaaattgatgaagataaccgcagaatggctgtggaaagagctcgggaagaaaaagactcctcgcatgtgtacaagggaagagttcacccggaaagtcagaagcaatgccgctcttggagcgatctttactgatgagaacaagtggaagtcagcccgcgaagcagtggaggactccggcttctgggaactggtggataaagagaggaatttacacctggaaggcaagtgcgagacatgtgtctataacatgatggggaaacgagagaagaaattgggagaatttggtaaggctaagggctctcgggccatttggtacatgtggctcggggcaagattcctggagtttgaagccctaggattccttaatgaggaccattggtttagcagggaaaacagtctgtccggcgttgagggtgaggggctccacaaactgggatacatcttgcgcgatgtgagcaagaaagaaggcggcgctatgtatgccgacgataccgcggggtgggacacacgtattactctggaggatctcgaaaatgaggaaatggtaaccaaccatatggagggagagcacaagaaacttgcagaagccatcttcaagctgacgtaccagaataaggtggtccgggtgcagagacccaccccaaggggtacagttatggacataatctctcgccgagaccagcggggctcagggcaagtggtcacttatggattaaacaccttcacaaacatggaggctcagctgattagacagatggaaggcgagggtgtgtttaaaagtatccaacagttgactgtaaaggaggaaattgccgttaaaaattggctcaccagggtggggcgcgagagactgtcccggatggcaatcagcggagatgactgcgtcgtgaagcctctagatgacaggttcgcttctgcccttacggctctgaacgatatgggcaaagtgcgtaaggacattcagcagtgggaaccctcgcgaggctggaatgattggacacaagtcccattttgctcacatcacttccacgagctcataatgaaggacgggcgcgttctggtggtaccctgtagaaaccaggatgaattgatcggacgggccaggattagccagggtgcaggctggtccttacgcgagaccgcgtgcctggggaaaagttacgcccagatgtggtctctcatgtattttcatagacgggaccttaggctggctgccaatgcaatctgtagcgctgtgccttcccactggatcccaacttcacgaacaacctggagtattcatgccactcacgagtggatgaccacagaagatatgctaacggtctggaaccgtgtgtggatacaagagaatccgtggatggaagacaagacccccgttgagtcttgggaagagatcccttacctgggaaaaagagaggatcagtggtgcggcagcctcattggtttgacttcccgcgcaacatgggccaagaacatccagaccgcgattaatcaggtgcggtcactgatcgggaacgaagagtatactgactacatgccaagcatgaaaaggttcagacgcgaagaggaagaggctggagtcctttggtga

SEQ ID NO: 14360 - RNA, 9876 nt, synthetic construct
  misc_feature 1..9876: note = derived and/or modified CDS sequence (opt3) from DENV-2__KM279568__SS-prME
  source 1..9876: mol_type = other RNA
accgccggcatcattataatgatgatccccacagtgatggctttccacctgactacgagaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaaatcacgccacagtcaagtattacagaagcagagctgaccggatacggcactgtgaccatggaatgtagcccgaggacaggtcttgacttcaatgagatggtcctgttgcagatggaaaacaaggcttggctcgtgcaccggcaatggtttctggatttacccctgccttggctcccaggggccgacacccagggctctaactggatccagaaagagactcttgttacattcaagaatccccacgcgaagaaacaggatatagtggtcctgggatcccaagagggcgccatgcatacggcattgaccggggctactgaaattcagatgtcaagcggaaacctactgtttacaggtcacctcaagtgccgtctgcgcatggacaaacttcagctgaagggcatgagttattctatgtgtaccgggaaattcaaggtggtaaaggagatcgccgaaacacaacatggaactatcgttattagagtgcagtacgagggcgacggttccccttgcaaaatcccattcgagattatggatttggaaaagaggcacgtcctcgggcggctgataaccgtgaatcccatcgtcacggagaaagacagcccggtgaacattgaagctgagcctccctttggcgattcgtacatcatcattggagttgaaccaggccagttaaagctgtcttggttcaaaaaggggtcctcaataggacagatgtttgagaccacaatgcgaggtgccaagcgcatggcaatcctaggcgacactgcctgggatttcgggagtctcggaggcgtgtttaccagcattggtaaagctctgcatcaagtattcggggcgatctatggcgcagccttttccggagtctcttggacaatgaagattcttatcggcgtggttataacttggatcgggatgaatagcagatcaaccagtttgtccgtgagcctggtcctcgtgggagtagtgacgctgtaccttggcgttatggtccaggctgactctggttgtgtggtgtcatggaaaaacaaggagctgaaatgcgggagtggaattttcatcacagataatgtccacacctggactgaacagtataagtttcagcctgagagcccctccaagttggcctctgcaattcaaaaagcccacgaagagggcatctgtggtataaggtcggttacacggctcgaaaacctgatgtggaagcagattaccccagagttaaatcatatcctgactgagaacgaagtgaaactaaccattatgacaggcgacatcaaggggataatgcaggctggaaaacgcagcctcagaccccagcctacggagctgaagtactcctggaaagcctggggcaaggcaaagatgctttcaaccgaattgcacaatcatactttcctgatcgatgggccagagacagcggaatgcccgaacaccaatagggcttggaacagtctcgaggtggaggactatggatttggcgtattcacaactaatatttggctgaaattaaaggaacgtcaagatgtcttttgtgactctaaactgatgagcgccgcaatcaaggacaaccgggccgtgcacgctgatatgggttactggattgagtccgcccttaacgacacctggaaaatcgaaaaggcatcattcatagaggttaagagctgccactggcccaaatctcatacgttgtggtccaatggggtgctcgagagtgaaatgattatccctaagaacttcgctggaccagtcagccagcacaattatcgacccggctaccatacacagaccgccggtccttggcacctgggcagactagagatggattttgacttctgtgaagggactaccgtggttgtgacagaggattgcggaaacaggggcccatctctgcgcactaccacagcgtccgggaaactcatcacggaatggtgctgtcggtcatgcaccctgcccccgcttagatacaggggagaggacggctgttggtatggtatggagattcgccctttgaaggaaaaagaggaaaatctggtaaacagtttagtcactgccgggcatggacagatcgataattttagcctcggcgtgctgggtatggctcttttcctggaggaaatgttgcgaacacgggtgggcaccaagcacgcaattctcctggtcgccgtttcgtttgtgactctaataacagggaacatgtccttccgtgacctgggaagagtaatggtgatggtcggcgctaccatgacggatgacatcgggatgggagtgacttacctcgccctgcttgcagcgtttaaggttaggccaaccttcgccgctggcttgctgttacgcaaactcacatctaaggagctgatgatgaccactattggtatcgtgcttctgagccaatcaacaattcccgagagtatcctagaactcaccgatgccctggcattggggatgatggtcctgaaaatagtgcggaatatggagaagtatcagttagctgttacaatcatggccatttcctgcgtgcctaacgcagtcatcctccagaatgcctggaaagtatcttgtactaccctggctgtggttagcgtgtccccccttctgttgacgtcaagccaacagaaggcggactggattccactcgccctgacaatcaagggactaaaccctaccgcaatatttctgactacccttagtagaacatctaaaaagaggtcctggcccctcaatgaagctattatggccgtcggcatggtgagcatcctggcctcgtcattgctgaaaaacgatatcccaatgactggcccgttagtagctgggggactcctgaccgtgtgctacgtccttacgggtcgatctgcagacctggagttggaacgcgccgcggacgttcggtgggaggagcaggctgaaattagtggctccagccctatactctctatcacaattagcgaggatgggtccatgtcaatcaagaatgaagaggaggaacagaccctgactattctaatcagaacaggactgcttgtgataagtggcctcttccccgtgagcatcccaattaccgccgcagcctggtatctgtgggaggtcaaaaagcaaagggctggtgtgttgtgggacgttccctctcctccacccgtagggaaagcagaattagaggatggagcctaccgtatcaagcagaagggcattctgggctattcccagatcggggcgggagtgtacaaagaaggtacttttcacacaatgtggcatgtcacccgcggcgctgtgctcatgcacaaggggaaacggatagagccttcatgggccgacgttaagaaagatctgattagttacggaggcggttggaagcttgagggggaatggaaggagggagaagaggtgcaggtcctggcattggaaccgggcaaaaacccaagagccgtgcaaacgaagcccggcctattcaaaactaacaccgggacaatcggagctgtaagcctggacttttcccctggtacctctggctcgccaatcgtcgataagaaagggaaggtggttggactctatggcaatggtgtggtcacaaggagcgggacttacgtgtcagccattgcacagaccgagaagtccatcgaggacaaccccgaaatagaggatgacattttccgaaaaaagcggctgacgatcatggatcttcatcctggagctggcaaaacaaagcgctatttaccggccattgttagagaagcgatcaaaaggggcctgcggactctcatattggcccccacccgagtggtcgcagctgagatggaagaggccctgagagggctcccaattcgctaccagacacctgctatcagggcagagcacaccggacgtgaaatcgtggacctgatgtgtcatgccactttcaccatgcggcttctgagtcccattagagtaccaaattataacttgatcattatggatgaggcccactttacagaccctgcttctatagcggcaaggggttacatcagcacgcgcgtggaaatgggcgaggccgctgggattttcatgactgccacccccccaggatcccgagacccgtttcctcagtcaaatgcacccatcatggatgaggaaagagagatcccagaacggtcttggaacagcggccacgagtgggttacagacttcaagggtaagaccgtctggtttgtgcccagtattaaagccgggaatgatatagctgcgtgcctaaggaagaacggaaaaaaggtgatccaactgtcccgcaaaactttcgacagcgaatatattaagacacgtaccaatgattgggactttgtcgtaacgactgatatctctgagatgggcgccaacttcaaggcagagagagtgattgaccctcggaggtgtatgaaaccagttatcctcacagatggcgaagagcgcgtgatattagctgggcccatgcctgtcacccattcatccgccgcacagcgaagaggacgggtgggtaggaatccgaagaacgaaaatgaccagtacatctacatgggcgagccactggaaaacgatgaggactgcgcccactggaaagaggctaagatgcttctggacaatattaacacccccgaagggatcattcctagtatgtttgagcccgaacgcgagaaagttgatgccatcgacggagaatatagactcaggggcgaggcgcggaagactttcgtggatttgatgcgtcgcggtgacctgccagtctggctcgcataccgagtggccgctgaggggataaactatgccgatagaaggtggtgttttgacggcgtaaaaaataaccaaattctggaagagaatgtggaagttgagatctggacaaaggagggagaacggaagaaacttaagcctcgctggctagatgctagaatttacagcgaccccctggcattgaaagagttcaaggaattcgccgctggcaggaaatcgttaaccctgaacctcatcacagagatggggcggctgccaacttttatgacgcagaaggccaagaatgcacttgataacctggcggtcctccataccgccgaagctggaggtcgagcctataatcacgcattgtctgagctgcctgagacactagaaactctgctccttctgaccttattggctacagtgaccggcgggatattcctgtttctcatgtccggaaaaggcatcggtaagatgactctggggatgtgctgcattatcacggccagcattcttctgtggtacgcacagatccagccgcactggatagccgcttcaattatcctcgagttctttttgatcgtgctgttaattcccgaaccagagaaacaaagaacccctcaggacaaccagctaacatatgtcgttatcgcgatactgactgtggtagccgcaaccatggctaatgaaatgggcttcctcgagaagacaaaaaaggattttggacttggcagtattaccactcagcaacccgagtctaacatcctggacattgatttgcgcccagcctccgcctggacactgtacgcagtggctacgaccttcatcactcctatgctcaggcatagcatagaaaattcaagtgtcaacgtgagcctgacagccatcgcgaatcaggctaccgttcttatggggctcggaaagggttggcccctgtccaaaatggacattggcgtgccgttgctggccatcgggtgttactctcaggtcaacccaattaccttaacagcagccctactgctccttgtagctcactatgcaatcattggacctggcctgcaggccaaggcgactcgggaggctcaaaaacgtgccgcagccggtatcatgaagaatcccacggtggacgggatgaccgttatagatttggacccaattccctacgatcctaaatttgaaaagcagctgggccaggtgatgctcctggtcctttgcgtgacacaggtcttaatgatgagaactacctgggctctgtgtgaggccctcacattggcaaccggaccgatcagcactctgtgggaaggcaaccccgggaggttctggaatacgacaatcgctgtgtccatggccaacatttttcgcggatcatatctagcgggcgccggtctgctcttctctataatgaagaacaccgcaaatactcggcgagggaccggaaacacaggcgagactcttggtgagaaatggaagaatagactgaacgctttgggcaaaagtgaatttcaaatctacaagaaatcggggattcaggaggttgacaggaccctggccaaggaaggaatcaaacgcggcgagacagatcatcacgcagtgagccgggggtccgctaagctcagatggttcgtagagcgtaatctggtgacgccagaaggaaaggtcgttgacttaggctgcggtagggggggatggtcttattactgtggcggtcttaaaaacgtgaaggaggtcaaaggcctgaccaaggggggacctggccatgaagagcccattcctatgtcaacttatgggtggaatctcgtgcggctacagagcggagtagatgtgttctttacaccacccgaaaaatgcgacaccctgttgtgtgatatcggcgagtccagtcctaacccaactgttgaggccggtcgcacactgcgagtgctcaatcttgtcgaaaactggctgaataacaatacccaattctgcataaaggtgttgaacccctacatgccgtctgtcatcgagaagatggaagccctgcagagaaaatacgggggagcgctcgtgaggaatcctttaagccggaactcaacgcacgagatgtattgggtttccaacgctagtggcaatattgtaagctctgtgaacatgatctcccgcatgctgattaatagatttaccatgaggcacaagaaagcaacatacgaaccagacgtcgatcttggctcagggactcgaaacatcggaatagagagcgagacccccaatctggacattatcggtaagcggatcgaaaaaattaagcaggagcatgaaacatcgtggcactatgatcaggaccatccttacaagacttgggcctatcacggctcttacgagaccaaacaaacagggagtgcttccagcatggtgaacggagttgtgcgtctactcaccaagccatgggacgtcatacccatggtgactcagatggccatgacggatacaaccccgttcggccagcagagagtatttaaagaaaaggtggacactcgcacccaagagcctaaagagggtacaaagaagctgatgaaaatcacggcagaatggttgtggaaggagctggggaaaaagaaaacccccaggatgtgtactcgggaagagttcacaagaaaggttcgctcaaatgccgctctcggagcgatttttaccgatgagaacaaatggaagtccgccagggaagcagtcgaggactctggcttctgggaacttgtggataaggagcgaaatctgcacttagaaggcaaatgcgagacttgtgtgtataacatgatggggaagcgggagaaaaagctgggagaatttggtaaagctaagggcagcagagccatctggtacatgtggttgggggcaaggttcctcgagtttgaagccctgggattcctaaatgaggaccattggtttagtcgcgaaaactcccttagcggcgtcgagggtgaggggctgcacaagctcggatacattctgcgtgatgtttctaaaaaggaaggcggcgctatgtatgccgacgatacagcggggtgggacacccggatcacattggaggatctgaaaaatgaagagatggtgactaaccatatggaaggagagcacaagaaactcgcagaggccatattcaagcttacctaccagaataaggtagtgagagtccagaggccaacgcctcgcggtaccgtgatggacatcatttcacgacgggaccagagaggcagtgggcaagttgtgacatatggactgaacactttcaccaacatggaagctcagttaatcaggcagatggagggcgaaggtgtctttaaatccattcaacagctgacagtgaaggaggagatcgccgtaaaaaattggttgattcgcgttgggagagaacggctcagcaggatggcaatatctggagatgactgcgtggtcaagcccctggatgaccgtttcgcttcggccctaactgctcttaacgatatgggcaaagtgcgaaaggacatccagcagtgggagccatcacgcggctggaatgattggacccaagtgcccttttgcagccatcacttccacgaactgattatgaaggacgggagagtcctcgttgtgccttgtcggaaccaggatgagctgatcggaagggcccgcatctcccagggtgcaggctggagtttgagagaaacggcgtgcttagggaaatcttacgcccagatgtggagcctgatgtattttcatcggagggacctccgacttgctgccaatgcaatttgttccgctgtaccatcacactggataccgacaagtcgtaccacttggtctatccatgccacacacgagtggatgaccactgaggatatgctgaccgtgtggaacagagtctggattcaagaaaatccctggatggaggacaagacacctgtggaaagctgggaggaaatcccatacctaggaaaacgcgaggatcagtggtgcggctccctgattggtctcacgtcacgggcaacctgggccaagaacatccagactgcgataaatcaggttaggagcttgatcgggaacgaggaatatacagactacatgccctctatgaaaagattccgccgggaggaagaggaagctggagtgctgtggtga

SEQ ID NO: 14361 - RNA, 9876 nt, synthetic construct
  misc_feature 1..9876: note = derived and/or modified CDS sequence (opt3) from DENV-2__KM279569__SS-prME
  source 1..9876: mol_type = other RNA
accgccggcatcattataatgatgatccccacagtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgtagcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgagatgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcacgctcagaccccagcctaccgagctgaagtacagctggaaagcctggggcaaggcaaagatgctttccactgaattgcacaatcatacattcctgatcgatgggccagagaccgcggaatgcccgaacacaaatagggcttggaactcactcgaggtcgaggactatggatttggcgtgttcactaccaatatatggctgaaattaaaggaacgtcaagatgtattttgtgacagtaaactgatgtctgccgcaatcaaggacaaccgggccgtgcacgctgatatgggttactggattgagagcgcccttaacgacacgtggaaaatcgaaaaggcatccttcattgaggtcaagtcatgccactggcccaaaagccatacattgtggtctaatggggtgctcgagtccgaaatgatcatacctaagaacttcgctggaccagttagtcagcacaattatcgacccggctaccatacccagactgccggtccttggcacctgggcagactagagatggattttgacttctgtgaagggaccacagtggtagtcactgaggattgcggaaacaggggcccaagcctgcgcaccacaacggcgtctgggaaactcattaccgaatggtgctgtcggtcctgcactctgcccccgcttagatacaggggagaggacggctgttggtatggtatggagatccgccctttgaaggaaaaagaggaaaatctggtgaactcattagtgacagccgggcatggacagatcgataattttagtctcggcgtcctgggtatggctcttttcctggaggaaatgttgcgaacccgggttggcactaagcacgcaattctcctggtggccgttagctttgtgacactaatcaccgggaacatgtcgttccgtgacctgggaagagtcatggtgatggttggcgctacgatgactgatgacattgggatgggagtgacctacctcgccctgcttgcagcgtttaaggtcaggccaacattcgccgctggcttgctgttacgcaaactcacctccaaggagctgatgatgactacaataggtatcgtgcttctgtctcaaagcaccattcccgagtcaatcctagaactcacagatgccctggcattggggatgatggttctgaaaattgtgcggaatatggagaagtatcagttagctgtcactatcatggccatactctgcgtacctaacgcagtgatcctgcagaatgcctggaaagttagttgtaccacgcttgctgtggtctccgtgtctcccctgttgctcacaagctcccaacagaaggcggactggattccactggccctaaccatcaagggactgaaccctactgcaatttttcttaccacactctcaagaactagcaaaaagaggagttggcccctgaatgaagctatcatggccgtaggcatggtgtctatattggcctccagcctgctaaagaacgatattccaatgaccggcccgctcgtcgctgggggactgcttacggtttgctacgtgctgacaggtcgatcggcagacttggagctcgaacgcgccgcggacgtgcggtgggaggagcaggctgaaatctcaggctctagtcctatcctgtccattaccataagcgaggatgggtctatgagcatcaagaatgaagaggaggaacagactctaacaattctgatcagaaccggacttctcgtcatttccggcctgttccccgtgtcaatcccaataactgccgcagcctggtatttgtgggaggttaaaaagcaaagggctggtgtattatgggacgtgcccagtcctccacccgtcgggaaagcagaactggaggatggagcctaccgtatcaagcagaagggcattctcggctatagccagatcggggcgggagtgtacaaagaaggtacatttcacaccatgtggcatgttacgcgcggcgctgtgctgatgcacaaggggaaacggattgagccttcttgggccgacgtcaagaaagatcttatctcctacggaggcggttggaagctggagggggaatggaaggagggagaagaggtgcaggtattggcactagaaccgggcaaaaacccaagagccgtccaaactaagcccggcctgttcaaaaccaacacagggaccataggagctgtgtcactcgactttagtcctggtacaagcggctccccaattgttgataagaaagggaaggtggtcggactgtatggcaatggtgtggttactaggtctgggacctacgtgtcggccatcgcacagacggaaaagagcatcgaggacaaccccgaaattgaggatgacatcttcagaaagaagcggcttacaataatggatttacatcctggagctggcaaaactaagcgctatctgccggccattgtcagagaagcgatcaaaaggggcctccggaccttgattctggcccccacacgagtggtagcagctgagatggaagaggccctcagagggctgccaatccgctaccagacccctgctataagggcagagcacactggacgtgaaattgtggaccttatgtgtcatgccaccttcacaatgcggctgttgtcacccatcagagttccaaattataacctaatcattatggatgaggcccactttacggaccctgcttccatcgcggcaaggggttacattagtactcgcgtcgaaatgggcgaggccgctgggatattcatgaccgccacacccccaggatctcgagacccgtttcctcagagcaatgcacccatcatggatgaggaaaaggagattccagaaagatcctggaactcaggccacgagtgggtgaccgacttcaagggtaaaactgtgtggtttgtcccctctatcaaggccgggaatgatatcgctgcgtgcctgcggaaaaacggaaagaaagtaattcaactcagcaggaagacattcgacagtgaatatataaagacccgcacgaatgattgggactttgtggttactacagatatctccgagatgggcgccaacttcaaagcagagcgtgtgattgaccctagacggtgtatgaagccagtcatcttaaccgatggcgaagagagggtgattctggctgggcccatgcctgttacccatagctctgccgcacagcgccgaggaagagtgggtcggaatccgaaaaacgaaaatgaccagtacatctacatgggcgagccacttgaaaacgatgaggactgcgcccactggaaggaggctaaaatgctgctcgacaatataaacactcccgaagggatcattccttcaatgtttgagcccgaaagggagaaggtcgatgccatcgacggagaatatcgcttgagaggcgaggcgaggaaaacattcgtggatctgatgcggcgtggtgacctcccagtatggctggcataccgcgtggccgctgaggggattaactatgccgatcgaagatggtgttttgacggcgttaagaataaccaaatccttgaagagaatgtcgaagtggagatatggaccaaggagggagaaaggaaaaagctaaaacctcggtggctggatgctcgcatttactccgaccccttggcattaaaggagttcaaagagttcgccgctggcagaaagagtctgacactcaacctgatcactgagatggggaggcttccaacgtttatgacccagaaggccaaaaatgcactggataacctcgcggtgttgcatacagccgaagctggaggtcgggcctataatcacgcactgagcgagctacctgagactctggaaaccctccttctgttaacattgctggctaccgtcactggcgggattttcctctttctgatgtcgggaaagggcatcggtaaaatgacgcttgggatgtgctgcataatcaccgcctctattctgctctggtacgcacagatccagccgcactggattgccgcttccatcatattggagttctttctgattgttttactaatccccgaaccagagaagcaacgaacacctcaggacaaccagctgacttatgtggtaatcgcgattctcaccgtggtcgccgcaacaatggctaatgaaatgggcttccttgagaaaaccaagaaggattttggactgggcagcatcactacacagcaacccgagtcaaacatattggacattgatctgagaccagccagtgcctggacgctctacgcagtggctaccactttcatcacacctatgctgcgccattctattgaaaattccagcgttaacgtgtcacttaccgccatcgcgaatcaggctaccgtcctcatggggctgggaaaaggttggcccttgagtaagatggacataggcgtaccgctgttagccatcgggtgttacagccaggtgaacccaattacactaactgcagccctgctccttctggttgctcactatgcaatcattggacctggcttgcaggccaaagcgacgagggaggctcaaaagcgggccgcagccggtatcatgaaaaatcccaccgtggacgggatgacagtcattgatctggacccaatcccctacgatcctaagtttgaaaagcagctcggccaggtgatgctgcttgtcttatgcgtgactcaggttctgatgatgcgtaccacatgggctctctgtgaggccttgaccctggcaactggaccgatatccacgctatgggaaggcaaccccgggagattctggaatacaaccattgctgtgtctatggccaacatctttaggggaagctatctggcgggcgccggtctccttttctccatcatgaaaaacactgcaaatacccgccgggggacaggaaacactggcgagaccctgggtgagaagtggaaaaatcgattgaacgctctgggcaagtcagaatttcaaatttacaaaaagtctgggatacaggaggtagacagaacactcgccaaagaaggaatcaagaggggcgagacggatcatcacgcagtgagtcgcgggtcggctaagctgcggtggttcgtcgagagaaatttagttaccccagaaggaaaagtggtcgaccttggctgcggtcgtgggggatggagctattactgtggcggtctgaagaacgtgaaagaggtaaagggcctcactaaagggggacctggccatgaggaacccattcctatgtccacatatgggtggaatctagtgaggctgcagtctggagttgatgtgttctttaccccacccgaaaagtgcgacactttgctgtgtgatatcggcgagtcaagccctaacccaacagtcgaggccggtcggaccctccgcgtgcttaatctggtcgaaaactggttgaataacaatacgcaattctgcattaaggtgctgaacccctacatgccgtccgttatcgagaaaatggaagccctccagcgaaagtacgggggagcgttagtaagaaatcctctgagtaggaactctacccacgagatgtattgggtgagcaacgcttcaggcaatatagtctccagtgtgaacatgatcagccggatgcttattaatcgctttacaatgagacacaaaaaggcaacttacgaaccagacgttgatctgggctctgggaccaggaacatcggaattgagtccgagacacccaatctagacatcataggtaaacgaattgaaaagatcaagcaggagcatgaaacttcatggcactatgatcaggaccatccttacaaaacctgggcctatcacggcagctacgagacaaagcaaaccgggtcggcttctagtatggtgaacggagtcgtgcggctcctgactaaaccatgggacgtaatccccatggtgacgcagatggccatgacagataccactccgttcggccagcagcgtgtttttaaggaaaaagtcgacaccagaacacaagagcctaaggagggtacgaagaaattgatgaagattaccgcagaatggctgtggaaagagctcgggaagaaaaagactccccgcatgtgtacaagggaagagttcacccggaaagtgagatccaatgccgctcttggagcgatatttactgatgagaacaagtggaaaagcgcccgcgaagcagtggaggactcaggcttctgggaactggtcgataaagagaggaatttacacctggaaggcaagtgcgagacatgtgtttataacatgatggggaaacgagagaagaaattgggagaatttggtaaggctaagggctcccgggccatctggtacatgtggctcggggcaagattcctggagtttgaagccctaggattccttaatgaggaccattggttttctagggaaaacagcctgagtggcgtggagggtgaggggctccacaaactgggatacattttgcgcgatgtatccaagaaagaaggcggcgctatgtatgccgacgataccgcggggtgggacacacgtatcactctggaggatctcaagaatgaagagatggtgaccaaccatatggaaggagagcacaagaaacttgcagaggccattttcaaactgacgtaccagaataaagtcgtgcgggttcagagaccaacccctaggggtacagtgatggacatcataagccgccgagaccagcggggctctgggcaagtcgtgacttatggattaaacaccttcacaaacatggaagctcagctgatcagacagatggagggcgaaggtgtatttaagtcaattcaacagttgactgttaaagaggagatcgccgtgaaggattggctcattagggtcgggcgcgaaagactgagtcggatggcaatctccggagacgattgcgtggtgaaacccctagacgataggttcgctagcgcccttaccgctctgaatgacatgggcaaggtccgtaaggatattcagcagtgggagccatctcgaggctggaacgactggacgcaagttcccttttgctcgcatcacttccacgaactcataatgaaagatgggcgcgtgctggtagtgccttgtagaaatcaggacgagttgatcggacgggccaggatttcacagggtgcaggctggagcttacgcgaaacagcgtgcctggggaagtcctacgcccagatgtggagtctcatgtattttcatagacgggatcttaggctggctgccaacgcaatctgttctgctgtcccaagccactggatcccgacctcccgaactacatggtcaattcatgccacccacgagtggatgactaccgaggacatgctaacagtgtggaatcgtgtttggatacaagaaaacccctggatggaggataaaacgcctgtggaaagttgggaggaaatcccatacctgggaaagagagaggaccagtggtgcggctctctcattggtttgaccagccgcgcaacttgggccaaaaatatccagacagcgattaaccaggtccggtccctgatcgggaatgaggaatataccgactacatgccctcaatgaagaggttcagacgcgaggaagaggaagctggagtgctttggtga

SEQ ID NO: 14362 - RNA, 9876 nt, synthetic construct
  misc_feature 1..9876: note = derived and/or modified CDS sequence (opt3) from DENV-2__KM279570__SS-prME
  source 1..9876: mol_type = other RNA
accgcaggaatcattataatgatgatccccacagtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgttgcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgaggtgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcagcctcagaccccagcctacggagctgaagtactcctggaaagcctggggcaaggcaaagatgctttcaaccgaattgcacaatcatactttcctgatcgatgggccagagacagcggaatgcccgaacaccaatagggcttggaacagtctcgaggtcgaggactatggatttggcgtgttcacaactaatatatggctgaaattaaaggaacgtcaagatgtattttgtgactctaaactgatgagcgccgcaatcaaggacaaccgggccgtgcacgctgatatgggttactggattgagtccgcccttaacgacacctggaaaatcgaaaaggcatcattcattgaggtcaagagctgccactggcccaaatctcatacgttgtggtccaatggggtgctcgagagtgaaatgatcatacctaagaacttcgctggaccagttagccagcacaattatcgacccggctaccatacacagaccgccggtccttggcacctgggcagactagagatggattttgacttctgtgaagggactaccgtggcggtaacagaggattgcggaaacaggggcccatctctgcgcactaccacagcctccgggaaactcattacggaatggtgctgtcggtcatgcaccctgcccccgcttagatacaggggagaggacggctgttggtatggtatggagatccgccctttgaaggaaaaagaggaaaatctggtcaacagtttagtgactgctgggcatggacagatcgataattttagcctcggcgtgctgggtatggcacttttcctggaggaaatgttgcgaacacgggtcggcaccaagcacgccattctcctggttgctgtgtcgtttgtaactctaatcacagggaacatgtccttccgtgacctgggaagagtgatggtcatggtgggcgccaccatgacggatgacattgggatgggagttacttacctcgcactgcttgcggcctttaaggtgaggccaaccttcgctgccggcttgctgttacgcaaactcacatctaaggagctgatgatgaccactataggtatcgtccttctgagccaatcaacaattcccgagagtatcctagaactcaccgatgcactggctttggggatgatggtgctgaaaattgttcggaatatggagaagtatcagttagccgtgacaatcatggcaatactctgcgtccctaacgccgtaatcctgcagaatgcttggaaagtgtcctgtactacccttgcggttgtgtctgtcagccccctgttgctcacgtcctcacaacagaaggccgactggattccactggcactaacaatcaagggactgaaccctaccgctatttttcttactaccctcagcagaacaagtaaaaagaggtcttggcccctgaatgaagccatcatggccgtgggcatggtatccatattggctagctcgctgctaaagaacgatattccaatgactggcccgctcgtggcagggggactgcttaccgtctgctacgttctgacgggtcgatcagccgacttggagctcgaacgcgcggctgacgtgcggtgggaggagcaggccgaaatctctggcagttcccctatcctgagcattacaatatctgaggatgggagcatgtccatcaagaatgaagaggaggaacagaccctaactattctgatcagaacaggacttctcgtgatttcaggcctgttccccgtcagtatcccaataaccgcagccgcttggtatttgtgggaggtgaaaaagcaaagggccggtgttttatgggacgtacccagccctccacccgtggggaaagccgaactggaggatggagcgtaccgtatcaagcagaagggcattctcggctattctcagatcggggctggagtctacaaagaaggtacttttcacacaatgtggcatgtgacccgcggcgccgttctgatgcacaaggggaaacggattgagccttcctgggcagacgtgaagaaagatcttatctcatacggaggcggttggaagctggagggggaatggaaggagggagaagaggtccaggtgttggccctagaaccgggcaaaaacccaagagctgtacaaacgaagcccggcctgttcaaaactaacaccgggacaataggagccgtcagtctcgactttagccctggtacctccggctctccaattgtggataagaaagggaaggttgtgggactgtatggcaatggtgtcgtgacaaggtcggggacttacgttagcgcaatcgctcagaccgagaagtcaatcgaggacaaccccgaaattgaggatgacatcttccggaaaaagagacttacgataatggatttacatcctggagccggcaaaacaaagcgctatctgccggcgattgtgagagaagccatcaaaaggggcctccggactttgattctggcacccacccgagtcgtggctgccgagatggaagaggctctcagagggctgccaatccgctaccagacccctgcaataagggccgagcacaccggacgtgaaattgtagaccttatgtgtcatgccactttcaccatgcggctgttgtcccccatcagagtgccaaattataacctaatcattatggatgaggctcactttacagaccctgcgagtatcgcagccaggggttacatttctacgcgcgttgaaatgggcgaggctgccgggatattcatgactgcaacacccccaggaagccgagacccgtttcctcagtccaatgcccccatcatggatgaggaaagagagattccagaacggtcatggaactctggccacgagtgggtcacagacttcaagggtaagaccgtgtggtttgtgcccagcatcaaagctgggaatgatatcgcggcctgcctgaggaagaacggcaaaaaggtcattcaactcagtcgcaaaactttcgactccgaatatataaagacacgtaccaatgattgggactttgtagtgacgactgatatcagcgagatgggcgcaaacttcaaggctgagagagttattgaccctcggaggtgtatgaaaccagtgatcttaacagatggcgaagaacgcgtcattctggccgggcccatgcctgtgacccattcttcagcagcccagcgaagaggacgggttggtaggaatccgaagaacgaaaatgaccagtacatctacatgggcgagccacttgaaaacgatgaggactgcgctcactggaaagaggccaagatgctgctcgacaatataaacacccccgaagggatcattccttccatgtttgagcccgaacgcgagaaagtggatgcgatcgacggagaatatagattgaggggcgaggcacggaagactttcgtcgatctgatgcgtcgcggtgacctcccagtgtggctggcctaccgagtagctgccgaggggattaactatgctgatagaaggtggtgttttgacggcgtgaaaaataaccaaatccttgaagagaatgttgaagtcgagatatggacaaaggagggagaacggaagaaactaaagcctcgctggctggatgcaagaatttacagtgaccccttggccttaaaagagttcaaggagttcgctgccggcaggaaaagcctgaccctcaacctgatcacagagatggggcggcttccaacttttatgacgcagaaggcaaagaatgcgctggataacctcgccgtgttgcataccgctgaagccggaggtcgagcatataatcacgctctgtcggagctacctgagacactggaaactctccttctgttaaccttgctggccacagtgaccggcgggattttcctctttctgatgtctggaaaaggcatcggtaagatgactcttgggatgtgctgcataatcacggcatccattctgctctggtacgcccagatccagccgcactggattgctgcgagcatcatattggagttctttctgattgtcttactaatccccgaaccagagaaacaaagaacccctcaggacaaccagctgacatatgttgtgatcgccattctcactgtagtggcagctaccatggccaatgaaatgggcttccttgagaagaccaaaaaggattttggactgggctcaatcaccactcagcaacccgagagtaacatattggacattgatctgcgcccagcctctgcatggacactctacgctgtcgccacgaccttcatcactcctatgctgaggcattccattgaaaatagctcagtgaacgttagtcttacagcgatcgctaatcaggccaccgtgctcatggggctgggaaagggttggcccttgagcaaaatggacataggcgtcccgctgttagcaatcgggtgttactcccaggtaaacccaattaccctaacagccgctctgctccttctggtggcacactatgccatcattggacctggcttgcaggcgaaggctactcgggaggcccaaaaacgtgcagccgctggtatcatgaagaatcccacggttgacgggatgaccgtgattgatctggacccaatcccctacgatcctaaatttgaaaagcagctcggccaggtcatgctgcttgtgttatgcgtcacacaggtgctgatgatgagaactacctgggccctctgtgaggcattgacactggctaccggaccgatatctactctatgggaaggcaaccccgggaggttctggaatacgacaattgccgttagcatggcgaacatctttcgcggatcctatctggccggcgcaggtctccttttctcaatcatgaagaacaccgctaatactcggcgagggaccggaaacacaggcgagactctgggtgagaaatggaagaatagattgaacgccctgggcaaatctgaatttcaaatttacaagaaaagtgggatacaggaggtggacaggaccctcgcaaaggaaggaatcaaacgcggcgagacagatcatcacgctgtatcgcgggggagcgccaagctgagatggttcgtggagcgtaatttagtcacgccagaaggaaaggttgtggaccttggctgcggtagagggggatggtcctattactgtggcggtctgaaaaacgtcaaggaggtgaaaggcctcaccaaagggggacctggccatgaagaacccattcctatgtctacttatgggtggaatctagtacggctgcagtcaggagtggatgttttctttacaccacccgaaaaatgcgacaccttgctgtgtgatatcggcgagagctcccctaacccaactgtggaggccggtcgcacactccgagtccttaatctggtggaaaactggttgaataacaatacccaattctgcattaaggtcctgaacccctacatgccgagtgtgatcgagaagatggaagcgctccagagaaaatacgggggagctttagttaggaatcctctgtctcggaacagcacgcacgagatgtattgggtatcaaacgcatccggcaatatagtgagtagcgtcaacatgatctctcgcatgcttattaatagatttaccatgaggcacaagaaagccacatacgaaccagacgtggatctgggctccgggactcgaaacatcggaattgagtcagagacccccaatctagacatcataggtaagcggattgagaaaatcaagcaggagcatgaaacaagctggcactatgatcaggaccatccttacaagacttgggcttatcacggctcgtacgagaccaaacaaacagggtctgccagttccatggttaacggagtggtccgtctcctgaccaagccatgggacgtgatccccatggtaactcagatggcaatgacggatacaaccccgttcggccagcagagagtgtttaaagaaaaggttgacactcgcacccaagagcctaaagagggtacaaagaagttgatgaaaattacggccgaatggctgtggaaggagctcgggaaaaagaaaacccccaggatgtgtactcgggaagagttcacaagaaaggtccgcagcaatgctgcgcttggagccatatttaccgatgagaacaaatggaagtcagcaagggaagctgtggaggactccggcttctgggaactggtggataaggagcgaaatttacacctggaaggcaaatgcgagacttgtgtctataacatgatggggaagcgggagaaaaagttgggagaatttggtaaagccaagggctctagagcaatctggtacatgtggctcggggccaggttcctggagtttgaagctctaggattccttaatgaggaccattggtttagccgcgaaaacagtctgtccggcgttgagggtgaggggctccacaagctgggatacattttgcgtgatgtgagcaaaaaggaaggcggcgccatgtatgcggacgatacagcagggtgggacacccggatcacactggaggatctcaaaaatgaagagatggtaactaaccatatggaaggagagcacaagaaacttgccgaggctattttcaagctgacctaccagaataaggtggtcagagtgcagaggccaacgcctcgcggtaccgttatggacatcatatctcgacgggaccagagaggctcagggcaagtggtcacatatggattaaacactttcaccaacatggaagcccagctgatcaggcagatggagggcgaaggtgtgtttaaaagtattcaacagttgacagtaaaggaggagatcgcagttaaaaattggctcattcgcgtggggagagaacggctgtccaggatggctatcagcggagatgactgcgtcgtgaagcccctagatgaccgtttcgcctctgctcttactgccctgaacgatatgggcaaagtgcgaaaggacattcagcagtgggagccatcgcgcggctggaatgattggacccaagtccccttttgctcacatcacttccacgaactcataatgaaggacgggagagttctggtggtaccttgtcggaaccaggatgagttgatcggaagggcacgcattagccagggtgcgggctggtccttaagagaaacggcctgcctggggaaaagttacgctcagatgtggtctctcatgtattttcatcggagggaccttcgactggccgcaaatgctatctgtagcgccgtgccatcccactggatcccgacatcacgtaccacttggagtattcatgcaacacacgagtggatgaccactgaggatatgctaaccgtctggaacagagtgtggatacaagaaaatccctggatggaggacaagacacctgttgaatcttgggaggaaatcccatacctgggaaaacgcgaggatcagtggtgcggcagcctcattggtttgacgtcccgggccacctgggcgaagaacatccagactgctattaatcaggtgaggtcactgatcgggaacgaggaatatacagactacatgcccagcatgaaaagattccgccgggaggaagaggaagccggagtcctttggtga

SEQ ID NO: 14363 - RNA, 9876 nt, synthetic construct
  misc_feature 1..9876: note = derived and/or modified CDS sequence (opt3) from DENV-2__KM279596__SS-prME
  source 1..9876: mol_type = other RNA
accgcaggaatcattataatgatgatccccacagtgatggctttccacctgactacgcgaaacggggagcctcatatgattgtcagcaggcaggaaaagggaaaatccctcctttttaagaccgagaatggtgttaacatgtgcacactgatggcaatggacttgggcgaattatgtgaggatactatcacctacaattgcccactgttacggcaaaacgaaccggaggacattgattgttggtgcaattctacatcaacctgggtgacttatgggacatgtaccgccacgggagagcaccgccgagaaaaacgtagtgttgcgctcgtgccccatgtcggcatgggtctggagactagaaccgaaacatggatgagctccgagggggcttggaagcacgcccagaggatcgagacttggatacttcggcatcctggattcaccatcatggcagccattctggcttacacaatcggcaccacgtattttcagcgcgtgttgattttcatcctcctgactgcagttacaccatctatggccatgaggtgcataggcatttcgaacagggactttgtggaaggggtctcaggaggtagctgggtggatatcgtactggagcacggcagttgtgttaccactatggctaaaaataagcccacactcgacttcgaattaattaagaccgaggccaaacacctggcgacgcttcggaagtactgcgtggaagcaaaattgaccaacacaactaccgcctcccgctgtcctacacagggggagccatctctgaatgaggaacaagataagcgatttgtctgcaaacatagcatggtggacagaggatggggcaacggttgtgggctattcggaaagggcggcatcgtgacttgcgctatgtttacctgcaagaaaaatatggaggggaaggtcgttcagcccgaaaacctcgagtatacaatcgtgattacccctcactccggagaagagaatgccgtaggtaacgatactggcaaacatgggaaggagataaaagtgacgccacagtcaagtatcacagaagcagagctgaccggatacggcactgtcaccatggaatgtagcccgaggacaggtcttgacttcaatgagatggtgctgttgcagatggaaaacaaggcttggctcgttcaccggcaatggtttctggatttacccctgccttggctcccaggggccgacacccagggctctaactggattcagaaagagactcttgtgacattcaagaatccccacgcgaagaaacaggatgtcgtggtactgggatcccaagagggcgccatgcatacggcattgaccggggctactgaaatccagatgtcaagcggaaacctactgtttacaggtcacctcaagtgccgtctgcgcatggacaaacttcagctgaagggcatgagttattctatgtgtaccgggaaattcaaggttgtgaaggagatagccgaaacacaacatggaactattgtcatcagagtgcagtacgagggcgacggttccccttgcaaaatcccattcgagattatggatttggaaaagaggcacgtcctcgggcggctgatcaccgtgaatcccattgttacggagaaagacagcccggtgaacatagaagctgagcctccctttggcgattcgtacatcattatcggagtagaaccaggccagttaaagctgtcttggttcaaaaaggggtcctcaatcggacagatgtttgagaccacaatgcgaggtgccaagcgcatggcaattctaggcgacactgcctgggatttcgggagtctcggaggcgtctttaccagcataggtaaagctctgcatcaagtgttcggggcgatctatggcgcagccttttccggagtttcttggacaatgaagattcttatcggcgtggtcattacttggatcgggatgaatagcagatcaaccagtttgtccgtgagcctggtactcgtgggagttgtcacgctgtaccttggcgtgatggtgcaggctgactctggttgtgtcgtttcatggaaaaacaaggagctgaaatgcgggagtggaatattcatcacagataatgtgcacacctggactgaacagtataagtttcagcctgagagcccctccaagttggcctctgcaattcaaaaagcccacgaagagggcatctgtggtattaggtcggtgacacggctcgaaaacctgatgtggaagcagatcaccccagagttaaatcatatactgactgagaacgaagtaaaactaaccattatgacaggcgacatcaaggggattatgcaggctggaaaacgcagcctcagaccccagcctacggagctgaagtactcctggaaagcctggggcaaggcaaagatgctttcaaccgaattgcacaatcatactttcctgatcgatgggccagagacagcggaatgcccgaacaccaatagggcttggaacagtctcgaggtcgaggactatggatttggcgtgttcacaactaatatatggctgaaattaaaggaacgtcaagatgtattttgtgactctaaactgatgagcgccgcaatcaaggacaaccgggccgtgcacgctgatatgggttactggattgagtccgcccttaacgacacctggaaaatcgaaaaggcatcattcattgaggtcaagagctgccactggcccaaatctcatacgttgtggtccaatggggtgctcgagagtgaaatgatcatacctaagaacttcgctggaccagttagccagcacaattatcgacccggctaccatacacagaccgccggtccttggcacctgggcagactagagatggattttgacttctgtgaagggactaccgtggcggtaacagaggattgcggaaacaggggcccatctctgcgcactaccacagcctccgggaaactcattacggaatggtgctgtcggtcatgcaccctgcccccgcttagatacaggggagaggacggctgttggtatggtatggagatccgccctttgaaggaaaaagaggaaaatctggtcaacagtttagtgactgctgggcatggacagatcgataattttagcctcggcgtgctgggtatggcacttttcctggaggaaatgttgcgaacacgggtcggcaccaagcacgccattctcctggttgctgtgtcgtttgtaactctaatcacagggaacatgtccttccgtgacctgggaagagtgatggtcatggtgggcgccaccatgacggatgacattgggatgggagttacttacctcgcactgcttgcggcctttaaggtgaggccaaccttcgctgccggcttgctgttacgcaaactcacatctaaggagctgatgatgaccactataggtatcgtccttctgagccaatcaacaattcccgagagtatcctagaactcaccgatgcactggctttggggatgatggtgctgaaaattgttcggaatatggagaagtatcagttagccgtgacaatcatggcaatactctgcgtccctaacgccgtaatcctgcagaatgcttggaaagtgtcctgtactacccttgcggttgtgtctgtcagccccctgttgctcacgtcctcacaacagaaggccgactggattccactggcactaacaatcaagggactgaaccctaccgctatttttcttactaccctcagcagaacaagtaaaaagaggtcttggcccctgaatgaagccatcatggccgtgggcatggtatccatattggctagctcgctgctaaagaacgatattccaatgactggcccgctcgtggcagggggactgcttaccgtctgctacgttctgacgggtcgatcagccgacttggagctcgaacgcgcggctgacgtgcggtgggaggagcaggccgaaatctctggcagttcccctatcctgagcattacaatatctgaggatgggagcatgtccatcaagaatgaagaggaggaacagaccctaactattctgatcagaacaggacttctcgtgatttcaggcctgttccccgtcagtatcccaataaccgcagccgcttggtatttgtgggaggtgaaaaagcaaagggccggtgttttatgggacgtacccagccctccacccgtggggaaagccgaactggaggatggagcgtaccgtatcaagcagaagggcattctcggctattctcagatcggggctggagtctacaaagaaggtacttttcacacaatgtggcatgtgacccgcggcgccgttctgatgcacaaggggaaacggattgagccttcctgggcagacgtgaagaaagatcttatctcatacggaggcggttggaagctggagggggaatggaaggagggagaagaggtccaggtgttggccctagaaccgggcaaaaacccaagagctgtacaaacgaagcccggcctgttcaaaactaacaccgggacaataggagccgtcagtctcgactttagccctggtacctccggctctccaattgtggataagaaagggaaggttgtgggactgtatggcaatggtgtcgtgacaaggtcggggacttacgttagcgcaatcgctcagaccgagaagtcaatcgaggacaaccccgaaattgaggatgacatcttccggaaaaagagacttacgataatggatttacatcctggagccggcaaaacaaagcgctatctgccggcgattgtgagagaagccatcaaaaggggcctccggactttgattctggcacccacccgagtcgtggctgccgagatggaagaggctctcagagggctgccaatccgctaccagacccctgcaataagggccgagcacaccggacgtgaaattgtagaccttatgtgtcatgccactttcaccatgcggctgttgtcccccatcagagtgccaaattataacctaatcattatggatgaggctcactttacagaccctgcgagtatcgcagccaggggttacatttctacgcgcgttgaaatgggcgaggctgccgggatattcatgactgcaacacccccaggaagccgagacccgtttcctcagtccaatgcccccatcatggatgaggaaagagagattccagaacggtcatggaactctggccacgagtgggtcacagacttcaagggtaagaccgtgtggtttgtgcccagcatcaaagctgggaatgatatcgcggcctgcctgaggaagaacggcaaaaaggtcattcaactcagtcgcaaaactttcgactccgaatatataaagacacgtaccaatgattgggactttgtagtgacgactgatatcagcgagatgggcgcaaacttcaaggctgagagagttattgaccctcggaggtgtatgaaaccagtgatcttaacagatggcgaagaacgcgtcattctggccgggcccatgcctgtgacccattcttcagcagcccagcgaagaggacgggttggtaggaatccgaagaacgaaaatgaccagtacatctacatgggcgagccacttgaaaacgatgaggactgcgctcactggaaagaggccaagatgctgctcgacaatataaacacccccgaagggatcattccttccatgtttgagcccgaacgcgagaaagtggatgcgatcgacggagaatatagattgaggggcgaggcacggaagactttcgtcgatctgatgcgtcgcggtgacctcccagtgtggctggcctaccgagtagctgccgaggggattaactatgctgatagaaggtggtgttttgacggcgtgaaaaataaccaaatccttgaagagaatgttgaagtcgagatatggacaaaggagggagaacggaagaaactaaagcctcgctggctggatgcaagaatttacagtgaccccttggccttaaaagagttcaaggagttcgctgccggcaggaaaagcctgaccctcaacctgatcacagagatggggcggcttccaacttttatgacgcagaaggcaaagaatgcgctggataacctcgccgtgttgcataccgctgaagccggaggtcgagcatataatcacgctctgtcggagctacctgagacactggaaactctccttctgttaaccttgctggccacagtgaccggcgggattttcctctttctgatgtctggaaaaggcatcggtaagatgactcttgggatgtgctgcataatcacggcatccattctgctctggtacgcccagatccagccgcactggattgctgcgagcatcatattggagttctttctgattgtcttactaatccccgaaccagagaaacaaagaacccctcaggacaaccagctgacatatgttgtgatcgccattctcactgtagtggcagctaccatggccaatgaaatgggcttccttgagaagaccaaaaaggattttggactgggctcaatcgccacccagcaacccgagagtaacatattggacattgatctgcgcccagcatctgcttggactctctacgccgtcgcgacaacgttcatcacccctatgctgaggcattccattgaaaatagctcagtgaacgttagtcttactgctatcgccaatcaggcaacagtgctcatggggctgggaaagggttggcccttgagcaaaatggacataggcgtcccgctgttagccatcgggtgttactcccaggtaaacccaattaccctaaccgctgcactgctccttctggtggcccactatgcgatcattggacctggcttgcaggctaaggccacacgggaggcacaaaaacgtgccgctgccggtatcatgaagaatcccactgttgacgggatgacggtgattgatctggacccaatcccctacgatcctaaatttgaaaagcagctcggccaggtcatgctgcttgtgttatgcgtcacccaggtgctgatgatgagaacaacttgggcactctgtgaggctttgaccctggccacaggaccgatatctaccctatgggaaggcaaccccgggaggttctggaatactacgattgcggttagcatggccaacatctttcgcggatcctatctggcaggcgctggtctccttttctcaatcatgaagaacacagccaatacccggcgagggactggaaacaccggcgagacactgggtgagaaatggaagaatagattgaacgcactgggcaaatctgaatttcaaatttacaagaaaagtgggatacaggaggtggacaggactctcgctaaggaaggaatcaaacgcggcgagaccgatcatcacgccgtatcgcgggggagcgccaagctgagatggttcgtggagcgtaatttagtcacaccagaaggaaaggttgtggaccttggctgcggtagagggggatggtcctattactgtggcggtctgaaaaacgtcaaggaggtgaaaggcctcacgaaagggggacctggccatgaagaacccattcctatgtctacctatgggtggaatctagtacggctgcagtcaggagtggatgttttctttactccacccgaaaaatgcgacacattgctgtgtgatatcggcgagagctcccctaacccaaccgtggaggcgggtcgcactctccgagtccttaatctggtggaaaactggttgaataacaatacacaattctgcattaaggtcctgaacccctacatgccgagtgtgatcgagaagatggaagctctccagagaaaatacgggggagcattagttaggaatcctctgtctcggaacagcacccacgagatgtattgggtatcaaacgcctccggcaatatagtgagtagcgtcaacatgatctctcgcatgcttattaatagatttacgatgaggcacaagaaagctacctacgaaccagacgtggatctgggctccgggacacgaaacatcggaattgagtcagagactcccaatctagacatcataggtaagcggattgagaaaatcaagcaggagcatgaaaccagctggcactatgatcaggaccatccttacaagacatgggcctatcacggctcgtacgagactaaacaaaccgggtctgcaagttccatggttaacggagtggtccgtctcctgacaaagccatgggacgtgatccccatggtaacccagatggccatgactgatacgacaccgttcggccagcagagagtgtttaaagaaaaggttgacacccgcactcaagagcctaaagagggtaccaagaagttgatgaaaattacagctgaatggctgtggaaggagctcgggaaaaagaaaacgcccaggatgtgtacccgggaagagttcactagaaaggtccgcagcaatgcggcccttggagcaatatttacagatgagaacaaatggaagtcagctagggaagccgtggaggactccggcttctgggaactggtggataaggagcgaaatttacacctggaaggcaaatgcgagacctgtgtctataacatgatggggaagcgggagaaaaagttgggagaatttggtaaagcaaagggctctagagccatctggtacatgtggctcggggctaggttcctggagtttgaagccctaggattccttaatgaggaccattggtttagccgcgaaaacagtctgtccggcgttgagggtgaggggctccacaagctgggatacattttgcgtgatgtgagcaaaaaggaaggcggcgcgatgtatgcagacgatactgccgggtgggacacacggatcaccctggaggatctcaaaaatgaagagatggtaacaaaccatatggaaggagagcacaagaaacttgctgaggccattttcaagctgacttaccagaataaggtggtcagagtgcagaggccaacccctcgcggtacggttatggacatcatatctcgacgggaccagagaggctcagggcaagtggtcacctatggattaaacacattcactaacatggaagcacagctgatcaggcagatggagggcgaaggtgtgtttaaaagtattcaacagttgaccgtaaaggaggagatcgctgttaaaaattggctcattcgcgtggggagagaacggctgtccaggatggccatcagcggagatgactgcgtcgtgaagcccctagatgaccgtttcgcttctgcccttacagcactgaacgatatgggcaaagtgcgaaaggacattcagcagtgggagccatcgcgcggctggaatgattggactcaagtccccttttgctcacatcacttccacgaactcataatgaaggacgggagagttctggtggtaccttgtcggaaccaggatgagttgatcggaagggcgcgcattagccagggtgccggctggtccttaagagaaaccgcttgcctggggaaaagttacgcccagatgtggtctctcatgtattttcatcggagggaccttcgactggcagctaatgccatctgtagcgcagtgccatcccactggatcccgacgtcacgtacaacctggagtattcatgccactcacgagtggatgacaaccgaggatatgctaactgtctggaacagagtgtggatacaagaaaatccctggatggaggacaagacccctgttgaatcttgggaggaaatcccatacctgggaaaacgcgaggatcagtggtgcggcagcctcattggtttgacatcccgggcgacgtgggctaagaacatccagaccgccattaatcaggtgaggtcactgatcgggaacgaggaatatactgactacatgcccagcatgaaaagattccgccgggaggaagaggaagcaggagtcctttggtga

SEQ ID NO: 14364 - RNA, 9876 nt, synthetic construct
  misc_feature 1..9876: note = derived and/or modified CDS sequence (opt3) from DENV-2__FJ850072__SS-prME
  source 1..9876: mol_type = other RNA
accgccggcgtgataattatgctgatacccactgctatggcattccacctcactacgagaaatggggagcctcatatgatcgtcggaagacaggaaaagggtaaaagccttctgtttaagaccgaggacggcgttaatatgtgcaccttgatggccatggatttaggggaactgtgtgaggacactattacctacaaatgcccactactccggcaaaacgaaccggaggatatcgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggattgagacctggatcctgcggcatcctggcttcgccataatggcagccatcttggcttacacaattggcaccacgcactttcagcgcgcactcatcttcattctgctgactgccgttgctccatccatgacaatgagatgcatcgggatatctaacagggattttgtggaaggagtctcgggtggctcatgggtggacattgtactcgagcacgggagctgtgttaccactatggccaagaataagcccacattagatttcgaactgatcaaaaccgaggcgaagcagcctgcaacgcttcggaaatattgcattgaagccaagttgaccaacacaactaccgagagtcgctgtccaacacaaggagagccctccctgaatgaagaacaggacaaacgatttatctgcaagcattctatggtggatagaggctggggtaacgggtgtggactattcggcaagggcgggatcgtcacttgcgctatgtttacctgcaaaaagaatatggaaggaaaagtggtgctccctgagaacctggaatacacaattgtcataaccccacacagcggtgaggagcatgccgttggcaatgacactgggaagcacggagaagagatcaaaattacgccgcagtcctcaatcacagaagcagagcttaccggctatggtactgtgaccatggaatgtagtcccaggacagggctggatttcaacgagatggtattgctccagatggaggaaaaggcttggctggtgcaccggcaatggtttttagacctgcctctcccatggcttcccggcgccgatacccagggaagcaattggatacagaaagagactctggtcacattcaagaaccctcatgcgaagaaacaggacgtggttgtgttgggctctcaagaaggggccatgcacacggcactaaccggagctactgagattcagatgtcctcaggtaatctgctctttacaggccatctgaagtgccgtcttcgcatggacaaactgcagttgaaggggatgagctacagtatgtgtaccggaaaattcaagatcgtcaaggagatcgccgaaacacaacacggcactattgtgatcagagtacagtatgagggtgatgggtctccatgcaaaattcccttcgaaataatggacctcgagaagaggcatgctctgggccggttaatcaccgttaacccgattgtgacggaaaaagattcccctgtcaacatcgaggccgagcccccatttggagacagctacatcattataggcgtggaacctgggcagctgaagctaaattggttcaaaaagggatcgtctatcggtcagatgtttgagaccacaatgcgaggcgcaaagcgcatggccattctcggggatactgcttgggacttcggatccctgggcggtgtctttacctcaatcgggaaagcgcttcaccaagtgttcggcgcaatttacggagccgcttttagtggcgttagctggacaatgaagatcttgataggggtgatcattacttggatcggaatgaactccagatctaccagcctgtcagtaagtctcgtcctggtgggcgttgtgacgctttatctgggtgccatggtccaggcagattccgggtgtgtggtaagctggaaaaataaggaattgaaatgcggatctggcattttcatcacagacaacgtgcacacctggactgagcagtacaagtttcagcccgaatcaccaagtaagctcgccagcgctatacaaaaagcccatgaggagggtatttgtggcatcaggtccgttacacggctggaaaatttaatgtggaagcagattacccccgagctgaaccacatcctatctgaaaatgaggtcaaactcactataatgaccggggatatcaagggaattatgcaggcaggcaaacgctcgctgagacctcagccaacagaacttaagtatagctggaaaacgtgggggaaggcgaagatgttgtccaccgagtcacataaccaaactttcctgatcgacggaccggagacagctgaatgccccaataccaacagggcctggaatagtctcgaggtggaagattacggctttggtgtgttcacaactaacatttggctgaaattacgtgagaagcaggacgtcttttgtgactctaaactgatgagcgcagccatcaaggataatcgggctgttcacgccgacatggggtattggatagagtccgcacttaacgatacctggaaaatggaaaaggcttcattcattgaggtgaagtcatgccactggcctaaatctcatacgttgtggtccaatggagtgctcgaaagtgagatgatcatcccaaagaacttcgccggccccgtaagccagcacaactaccgacctggttatcatacacagaccgcgggcccatggcacctggggaaactagaaatggactttgatttctgtgagggaactaccgtcgtggttacagaggactgcggcaatagagggccctctctgaggactaccacagcctccggaaagctcattacggaatggtgctgtcgctcatgcaccctgccgcctcttcggtacagaggcgaggatggttgttggtacgggatggaaatcaggccattgaaagagaaggaagagaacctggtgaatagtttagtcactgctggacatggccaaattgacaactttagcctcggtgtgctgggcatggcacttttcctggaggaaatgttgcgcacacgagttgggaccaagcacgccatactcctggtggctgtatcgtttgtcactctaatcacaggaaatatgtccttccgggatctgggccgtgtgatggtgatggtcggggttgccatgaccgacgatattggaatgggcgtgacgtatctcgcactgcttgcggcctttaaagtaagacccactttcgctgccggtttgctgttaaggaagctcacctctaaagagctgatgatggcaacaatcgggattacccttctgagccagtcaactatccctgaaacaatactagagctcaccgacgctctggccttgggaatgatggtgctgaagatcgtccgcaacatggaaaaataccagttagcagtgacaattatgactatcagttgcgttcccaatgccatgattctcctgaacgcttggaaggtgtcctgtaccatccttgcggtcgtgtctgttagcccactgttgctcacgtcctcacaacagaagacagattggatacctctggccctaaccattaaaggcctgaatcccactgcaatctttcttaccacactcagccggacaagtaagaaaagatcttggccactgaacgaggctgtgatggccgtcggcatggtatccatcttggccagctcgctgttaaagaatgacattccgatgaccgggcctctcgtggctggaggtctgcttacggtttgctatgtgctgacaggcaggtcagcagacttggagctcgaacgagccaccgatgtcaaatgggaggaccaggcggaaatatctgggagttcccccatcctgagcattactatctctgaggatggaagcatgtccattaagaacgaggaagaggaacagacactaaccatcctgatacgcactggccttctcgtgatctcaggtgtattcccagtgagtattcccatcacagctgccgcatggtacctgtgggaggtcaaaaagcaacgggccggggttttgtgggacgtgcctagcccaccccctgtggaaaaggctgagttagaggatggagcatatagaattaaacagaggggcatcctgggctactctcagataggggccggagtctataaggaaggtacctttcacacgatgtggcatgtgactcgtggcgcggttctcatgcaccgcgggaaacggattgagccgtcctgggctgacgtaaagaaagatctgatctcatacggaggcggttggaaacttgaaggggagtggaaggaaggagaggaggtgcaggtcctggccttggaaccaggcaaaaatcccagagcagtgcaaaccaagcctggcctattcaaaacaaacaccgggacaatcggagccgttagtctggactttagcccaggtacttccggctctcccattgtggataggaaggggaaagtcgtgggactctacggcaatggtgtagtcacccgatcgggggcttatgtgagcgccatcgcacagacggagaagtcaatagaagacaaccctgagattgaagatgacatcttccggaagaaacgcctgacaattatggatcttcatccgggagctggcaagactaaaagatacttacccgccatcgttagggaggcgataaagcggggcctgcgaaccctcattttggccccaacaagagtggtcgcagctgagatggaagaggccctgcgcgggctccctatcaggtatcagacccccgctatccgtgcagaacacactggacgggagattgtggacctgatgtgtcatgccaccttcacaatgagacttctgtccccagttagggtgcctaactacaatttgatcattatggacgaggcccactttacggatcccgctagtatagcggcacgcggttatatctctactcgagtcgaaatgggcgaggccgctgggattttcatgaccgccacaccaccgggaagcagagacccttttccccagtccaacgcaccaatcatggatgaagaacgggaaatccccgagaggtcatggaactctggccacgagtgggtgaccgacttcaaaggtaagactgtatggtttgtgcctagcattaaggccgggaacgatatagctgcgtgcctacgcaaaaatggaaagaaagttatccaactgagtcgtaagacattcgactccgaatacgtcaaaaccagagccaacgattgggactttgtggtgacgactgatattagcgagatgggcgcaaatttccgggctgaaagggtcatcgacccacgccgatgtatgaagcccgtaattctcacagatggcgaggaaagagtgatcttagccgggcctatgccggttacccattcttcagcagcccagcggaggggacgcgtgggtagaaacccaaagaatgagaacgaccagtatatatacatgggcgagcccctggaaaatgacgaggattgcgctcactggaaagaagccaagatgcttctggacaacatcaatacccctgaggggattatcccctccatgtttgaaccagagagggagaaagtcgatgcgattgacggagaataccggctccgtggcgaggcacgcaagactttcgtggatttgatgcgaagaggtgacctgcctgtttggctcgcctatagggtggctgccgaagggatcaactacgctgatcggcgctggtgttttgacggcatcaagaataaccaaattctggaggagaacgtcgaagtggagatctggacaaaggaaggagagaggaagaaacttaagcccaggtggctagatgcacggatttatagtgacccactggccttgaaagagttcaaggagttcgctgccggccgaaagagcttaaccctgaatctcatcacagagatggggagactgcctacttttatgacgcagaaggcacgcaacgcgcttgataatctggccgtactccataccgctgaagccggaggtagggcatacaaccacgctttgtcggagctgccggaaacactagagactctgctccttctgaccttattggccacagtgaccggcgggatattcctgtttctcatgtctggaaaaggcatcggtaagatgactctggggatgtgctgcattatcacggcatccattcttctgtggtatgcccagatccagccccactggatagctgcgagcattatcctcgagttctttttgatcgttctgttaattccagagcctgagaagcaacggacaccccaggacaatcagctaacatacgtcgtgatcgccatactgactgtggtcgcagctaccatggccaacgaaatgggcttcctcgagaaaacaaagaaagatcttggactgggctcaattaccactcaggaaagtgagtctaatatcttggacattgacctgcgtccagcctccgcatggacactctatgctgttgccacgacctttatcactcctatgctgagacatagcatagaaaactcaagtgtgaatgtaagccttacagcgatcgctaaccaagccaccgtgctcatggggctgggaaagggttggcccttgtccaaaatggatattggcgtcccgctgttagcaatcgggtgttactctcaggtgaatccaattaccctaacagccgctctgctcagccttgttgcacactacgccatcattggacctggcctgcaggcgaaggctactagggaggcccagaagcgcgcagccgctggtatcatgaaaaaccccacggtggacgggataaccgtcattgatttggagccaatcccctatgaccctaagttcgaaaaacaactgggccaggtaatgctcctgatcctttgcgtgacacaggttttaatgatgcggactacctgggccctgtgtgaggcactcacattggctaccggaccgatttccactctgtgggaaggcaatcccgggcgattttggaacacgacaatagccgtgtcaatggcgaatatcttcagaggatcttacctagccggcgcaggtctgctctttagtattatgaagaacaccactaataccaggcgcgggacaggaaacatcggcgagactcttggtgagaaatggaagtcgcggctgaacgctttgggcaagagcgagttccagatttataaaagatccgggatccaagaggtcgatcgtaccctggccaaggaaggaataaaaaggggcgagacagaccatcacgcagtgtctcgggggtcagctaagctccgctggtttgtcgaacgaaatatggtgacgccagagggaaaagttgtggatctgggctgcggtagagggggatggagctactattgtggcggtttaaagaacgtaagggaggtgaaaggccttaccaaaggcgggcctgggcatgaagaacccatccctatgtccacttacgggtggaatctggtccggctccagagtggagttgacgtgttcttcacaccacccgaaaagtgcgataccctactgtgtgacattggcgagtctagccctaacccaactatcgaagccggtcgcacattgagagtcctgaatctcgtggagaactggcttaataacaatacccagttttgcattaaagtactgaacccctatatgccgtcagtgatcgagaagatggaaacgttgcaaaggaaatacgggggagccctggttcgaaatcctctctcccggaacagtacccacgagatgtactgggtgagcaatgcgacaggcaacatagtctcttccgtgaatatgatttcacgtatgttaatcaacagattcactatgaagcacaaaaaggctacctatgaaccagatgtcgacctgggcagcgggacacgcaacatcggaattgagtcggaaatacccaatcttgatatcattggtaagaggatcgagaaaattaagcaggagcatgaaacttcttggcactacgaccaggaccatccttataaaacctgggcataccacggcagttatgagacaaagcagaccgggtccgccagctcaatggtgaacggagttgtacggctgctaactaaaccatgggatgtggtccccatggtgacgcaaatggctatgacagacaccactccgtttggccagcagagagttttcaaggaaaaggtggatacccgcacacaggagcctaaagagggtacgaagaaactcatgaggatcaccgccgaatggctgtggaaggagttggggaaaaagaagactccccgaatgtgtacacgggaagagtttaccagaaaagtcaggtccaatgcagccctgggagctatattcactgacgaaaacaagtggaaatctgcgcgcgaggccgtggaggatagccgtttttgggaactcgtagaccgggagagaaatcttcacctggaaggcaagtgcgagacatgtgtgtacaacatgatgggcaaaagggaaaagaaattaggggagttcggaaaggcaaagggtagtcgcgctatctggtatatgtggctgggcgcccgatttttggagttcgaagcactcgggtttctgaatgaggatcattggttctcccggggaaacagcctatctggcgttgaaggtgaggggcttcacagactgggatacattctcagggacgtcagcaaaaaggaaggcggcgccatgtacgctgatgacaccgccgggtgggatacacgcatcactctggaggacttgaaaaatgaggaaatggtgaccaaccatatgaagggagagcacaaaaagctggcggaagcagtgtttaagctcacgtatcaaaataaagtcgttagagtgcagcggccaacccctaggggtacagtaatggacattatcagtcgtcgagatcagcgcggctccggacaggtgggaacttacggccttaacaccttcacaaatatggaggcccaactgattagacagatggagggtgaagggatattcaagagcatccagcatttaactgtcaccgaggaaattgctgtgcaaaactggctggcccgggttggaagggagcgcttgtctagaatggcaatctcgggcgacgattgcgtggtcaaacccctcgacgatcggtttgcttcagccctgacggctctaaatgacatgggcaaggtgaggaaagatatccagcagtgggaaccaagccgagggtggaacgactggacacaggtacccttctgctcccaccactttcatgagcttgttatgaaggatggacgtatgctggtggtcccttgtagaaaccaagacgagctcattggtcgcgcccggataagtcagggcgcagggtggtctctgaaggaaaccgcgtgcttgggaaaaagctatgcccagatgtggactttaatgtacttccacaggagagatctgcgcctcgctgccaatgcaatctgttccgctgtgccatcacattgggtgccgacaagtcggaccacttggtctattcacgccaagcacgagtggatgaccacagaagacatgcttgcagtctggaacagggtttggatccaggagaatccctggatggaagataaaacgcctgtggagagctgggaggaagtaccatatctgggcaagcgagaggaccaatggtgcggttccctaattgggctgacctcaagagccacttgggcgaaaaacatccagacagctataaatcaggtgcggagcctcatcggaaacgaagagtacaccgactatatgccctctatgaagaggtttcgccgtgaagaggaggaagccggcgtcttgtggtga

SEQ ID NO: 14365 - RNA, 9876 nt, synthetic construct
  misc_feature 1..9876: note = derived and/or modified CDS sequence (opt3) from DENV-2__JN819419__SS-prME
  source 1..9876: mol_type = other RNA
accgccggagtgatcgtcatgctgattcccacagctatggcattccacctcactacgaggaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccaggacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgcggtgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcgtcgaagcaaagttgacaaacactaccacagagagtcgctgtccaactcaaggagagccctccctgaatgaggaacaggacaaacgatttatttgcaagcattctatggtggatagaggctggggtaacgggtgtggactattcggcaagggcgggatcgtgacctgcgccatgtttacatgcaaaaagaatatggaaggaaaagtcgttcagcctgagaacctcgaatacaccatcgtgattactccacacagcggtgaggagcatgctgtaggcaatgacacggggaagcacggaaaagaaataaagatcacaccgcagtcctcaattaccgaggccgaactgactggctatggtaccgtgacaatggagtgtagtcccaggaccgggcttgatttcaacgaaatggtcctgttgcaaatggaggacaaagcatggctcgtgcaccggcagtggtttctggatttacctctgccatggctccccggcgctgacactcagggaagcaattggatccagaaggagacacttgttacgttcaagaaccctcatgccaaaaagcaagacgtggtcgtgctgggctctcaggaaggggcgatgcacaccgccttgactggagcaacagagatacagatgtcctcaggtaatctactgtttaccggccatctcaaatgccgtctgcgcatggataaacttcaactgaaagggatgagctacagtatgtgtacaggaaagttcaagattgtaaaagaaatcgctgagactcagcacggcaccatcgttattagagtgcagtatgagggtgacgggtctccatgcaagatccccttcgaaattatggatttggagaaaaggcatgtcctcggccggctgataacggtgaacccgatcgtcaccgaaaaggactcccctgtgaacattgaggccgaacccccatttggagatagctacatcatcattggcgttgagcctgggcagttaaaactgaattggttcaagaagggatcgtctataggtcaaatgtttgagacaactatgcgaggcgctaaacgcatggccatcctaggggacaccgcatgggatttcggatccctcggcggtgtgtttacatcaattgggaaggccctgcaccaggtattcggcgctatctacggagcggcatttagtggcgtcagctggactatgaaaattcttatcggggtgataatcacctggattggaatgaactccagatctacgagcttgtcagttagtctggtgctcgtcggcgtggtaacactgtatcttggtgccatggtgcaggctgactccgggtgtgttgtcagctggaagaataaagaactgaagtgcggatctggcatcttcattaccgataacgtgcacacttggacagagcagtacaagtttcaacccgaatcaccaagtaaattggccagcgcaatccagaaggcccatgaggaaggtatatgtggcattaggtccgtgacccggctcgagaatctgatgtggaaacagatcactcccgagttaaaccacattctgtctgaaaatgaggtcaagctaaccatcatgacaggggacataaaaggaatcatgcaggctggcaagcgctcgctcagacctcaaccaacggaactgaaatatagctggaagacctgggggaaggccaaaatgctttccactgagtcacataaccagacattcttgattgatggaccggaaaccgcagagtgccccaatacaaacagggcgtggaatagtctggaggttgaagactacggctttggtgtgttcactaccaacatctggctcaagctgcgtgagaaacaggacgtgttttgtgattctaagttaatgagcgctgccattaaagacaatcgggcagtacacgccgatatggggtattggatcgaatccgctctgaacgacacgtggaagatggagaaggcctcattcatagaggtcaaaagctgccactggcctaagtctcatacactttggtccaatggagtgttggaaagtgagatgattatccccaagaacttcgcaggccccgttagccagcacaactaccgacctggttatcatacccaaactgctggcccatggcacctcgggaagctggaaatggattttgacttctgtgagggaaccacagtggtcgtgactgaagattgcggcaatagagggccctctctaaggaccacaacggcctccggaaaactgatcaccgagtggtgctgtcgctcatgcactctcccgcctctgcggtacagaggcgaggacggttgttggtacgggatggaaattaggccacttaaggagaaggaagagaacttggttaatagtctggtgacagcgggacatggccagatcgataactttagcttaggtgtactcggcatggccctgttccttgaagagatgctgcgcacccgagtcgggactaaacacgctattttgctcgtggcagtgtcgtttgtcacactgataaccggaaatatgtccttccgggacctaggccgtgttatggtgatggtaggggccacgatgactgatgacatcggaatgggcgtgacctatctggctctcctggccgcatttaaggtcagacccacattcgcggccggtcttttgctgaggaaattaacctctaaggagctcatgatggctactattggggtggccctgcttagccagtcaacaatccctgaaaccattctggagctaacagatgcactcgctctgggaatgatggccttgaaaatcgttaagaacatggaaaagtaccaactggcagtgactataatggccatcagttgcgtccccaatgctgtgattttacagaacgcgtggaaagtttcctgtaccatcctcgccgcagtgtctgtcagcccactgcttctgacgtcctcacagcagaaggctgactggattcctttggccctcacaatcaaaggcctgaatcccaccgccatatttctaactaccctgagccgcacaagtaagaaacggtcttggccacttaacgaggctattatggcagtaggcatggtgtccatcctcgccagctcgctgttgaagaatgacatcccgatgactgggcctctggttgcgggaggtttactcaccgtgtgctatgtcctgacgggcagatcagctgatcttgaactggagagggccgcagacgtgaaatgggaggatcaagccgaaatttctgggagttcccccatattgagcatcacaatttctgaggacggaagcatgtccatcaagaacgaagaggaggaacagaccctcactattctgatccgaacaggcctactggtaatatcaggtgtgttcccagtcagtatccccattaccgctgcagcctggtacctttgggaggttaagaaacagcgcgcgggggtgctctgggatgtgcctagcccaccccctgtcggaaaggctgaactggaggacggcgcctatcggatcaaacagagaggcattttggggtactctcaaatcggagccggtgtgtataaggaaggcacttttcacacaatgtggcatgttaccagaggggcagtattaatgcaccgtggaaaacgcatagagccgtcctgggctgatgtgaagaaggacctggtctcatacggcggtgggtggaaactcgagggagaatggaaggagggcgaagaggtgcaggttctggcccttgaaccaggcaaaaatccccgggcagtgcagacgaagcctgggattttcaaaactaacaccggaaatatcggtgctgtcagtctggattttagcccaggcacatccgggtctcccatcgtggacagaaagggaaaggtagtcggcttgtacggtaacggggtggttaccaggtcgggagcctatgtgagcgcgattgcccagacagagaaatcaatcgaggataaccctgaaatagaggacgatattttccgaaagaaacggctaactatcatggacctgcatccgggcgcaggcaagaccaaacgctacctccccgctattgtcagagaagccatcaagagggggctgcggacgcttatattagctccaacacgagtggttgcagccgagatggaagaggccctgagaggactccctattcgctatcaaactcccgctatcagggcggagcacaccggtcgtgaaatcgtggacttgatgtgtcatgcaacattcaccatgcggctgctctccccagtcagagtgcctaattacaacctgattatcatggatgaggcccactttactgaccccgctagtattgccgcaaggggctatatatctacccgcgtagaaatgggggaggccgctggaatcttcatgacagcgacgccaccgggcagccgagatccttttccccagtccaatgccccaattatggacgaggaaagagagatccccgaacggtcatggaactctggtcacgagtgggtgactgatttcaaggggaaaaccgtttggtttgtccctagcatcaaggcaggaaatgacattgctgcctgccttaggaaaaacggcaagaaagtgatacagctgagtcgcaagacattcgattccgaatacgtgaagacccgtgcaaatgactgggattttgtcgtaactacagacatcagcgagatgggcgccaacttcaaagctgagagagtgattgatccacggaggtgtatgaagcccgttatcttgaccgacggggaggaacgcgtgattctagccggacctatgccggtcacgcattcttcagcggcacaacgaagaggtcggatcggcaggaatcccaaaaacgaaaatgaccagtatatatacatgggggagcccctggaaaacgatgaggactgcgcccactggaaggaggctaaaatgctcttagataatatcaacactcctgaaggaattatcccctccatgtttgagccagaacgcgagaaggtggacgccattgatggcgaatacagactgaggggtgaggctcggaaaacattcgttgaccttatgcgtcgcggggatctgcctgtgtggctcgcatataaggtcgccgctgagggcatcaattacgccgaccgaagatggtgttttgatggaataaagaacaaccagattttggaagagaatgtggaagtagagatctggaccaaagagggcgaaaggaagaaactgaagccccggtggctcgacgcacgcatttatagtgatccactggcgcttaaagagttcaaggagttcgccgctgggagaaagagcctaaccctgaacttgatcactgagatgggaaggttacctacatttatgacccagaaagcccggaatgcactggacaacctcgctgtgctgcatacagccgaagccggtggaaaggcatacaatcacgctctttcggagctgccggagactctcgaaacgttgctgctactgaccctccttgcgacagttactgggggaatattcctgtttttaatgtctggcaaaggtatcgggaagatgaccttgggcatgtgctgcattatcacagcctccattctgctctggtatgcacaaatccagccccactggatagctgccagcattatcctggagttctttcttatcgtcctgctcattccagaacctgagaaacagcgaaccccacaggataaccaattgacttacgtggtgatcgccatactgacggtcgttgcagctaccatggccaatgaaatgggattcttagagaagacaaagaaagacctaggcctggggtcaattactacccaggagagtgaatctaacatcctcgacattgatcttagaccagcgtccgcttggacactgtatgccgtggcaaccacttttgtaacacctatgttgcgccatagcatcgaaaattcaagtgtgaacgtcagcctgacggccatagctaatcaggcaaccgtgctcatgggactgggtaagggctggcccctttccaaaatggacatcggggccccgctcctggcgattggatgttactctcaggttaacccaatcactttgacagctgccctgttactactggtggcacactacgccattatcggccctggtctccaagctaaggccaccagggaagcacagaaacgggctgccgcggggattatgaagaatcccaccgtcgatggcatcacagtaatagaccttgagccaattccctatgatcctaagttcgaaaaacagctgggacaggtgatgttgctgatcctctgcgttactcaagtgctgatgatgcgtacgacctgggccctttgtgaggcattaacactggctactggcccgatcagcaccctctgggaggggaaccccggaagattttggaatacaaccattgccgtctccatggcaaacatattcaggggctcatacttggctggtgccgggctgctattttctatcatgaagaatactacgaacacacgccggggaaccggcaacattggtgaaactctgggcgagaaatggaagagtcgactcaatgcccttgggaaatcggagttccagatctataagaaaagcggcattcaggaggtggacagaaccctggcgaaggagggcatcaagagaggggaaacagatcatcacgctgtctcccgcggatctgcaaaattgcggtggtttgtggagagaaacatggttactccagaaggcaaggtggtagacctgggttgcgggcgtggaggctggtcatactattgtggtggcctcaaaaatgtgagggaggtcaaggggctgaccaaaggaggccctgggcatgaagaaccaatacctatgagcacatacggatggaacttagttcggcttcaatccggcgtggatgtcttcttcacgccacccgagaagtgcgacaccctgctctgtgatatcggtgaaagttctcctaatccaactattgaggccgggcgcacactacgagtgctgaacttggtagaaaattggctgaacaataacacccagttttgcatcaaggtgctcaatccctatatgccgagcgttattgagaaaatggaaactcttcagagaaagtacggaggcgctctggtgaggaaccctttgtcaagaaattccacacacgagatgtactgggtcagtaacgccaccggcaatatcgtgagctctgtcaacatgatatcccgcatgctgattaacagattcacgatgaaacacaagaaagcaacctatgagccagacgtggatctcgggtcaggaacaaggaatatcggtatcgaaagcgagattcccaacttagacataatcggcaagcgaattgaaaagatcaaacaggagcatgaaacttcgtggcactacgaccaagatcatccttataagacctgggcctaccacgggtcttatgagacaaaacagactggaagtgcttccagcatggttaatggcgtagtgcggctgcttaccaagccatgggacgtcgtgcccatggttacacagatggcgatgaccgatactacgccgtttggtcagcaacgtgtgttcaaagagaaggtcgacacaagaacccaggaacctaaggaggggactaaaaagctgatgaaaattaccgccgaatggctatggaaggagctcggcaaaaagaaaatcccccgcatgtgtacaagggaggaatttacgcggaaggtgagatcaaacgcagctctgggcgccatattcaccgatgagaataagtggaaatccgcacgcgaagccgtagaggacggcaggttttgggaattggtggatcgagagcggaacctgcacctcgaggggaagtgcgaaacttgtgtttacaatatgatgggaaaaagagagaagaaacttggtgagttcggcaaggctaaggggtctagggccatctggtatatgtggctgggagcgcgctttttagagttcgaagcactgggctttttgaacgaggaccattggttcagccgtggtaatagtctctccggggtcgagggagaaggcctgcaccggctaggctacattcttagagatgtgagcaaaaaggaagggggagccatgtacgctgacgatacagccggttgggacaccaggatcactctggaagacctcaaaaacgaggaaatggtgacaaatcatatgaagggcgagcacaaaaagctggcagaggctatttttaagttgacctatcagaacaaagtcgttcgcgtgcagcgaccaacacctcgggggactgtaatggatatcatttctagaagggaccaacgcggatcaggccaggtgggtacctacgggctgaatacgttcaccaacatggaagcccagctcataagacaaatggagggagaaggcatcttcaagagtattcagcatcttacagtcactgaggagatcgctgtgcagaattggctggcccgggttggcagggaacgtttaacccgaatggcaatctccggggatgactgcgtggtcaaacccattgatgaccgctttgcgaacgccctgacagctttgaacgatatgggaaaggtgagaaaagacatacagcaatgggagccaagccggggttggaatgattggactcaggtacccttctgctctcaccactttcatgaactcgttatgaaggacggcagggtgctggtcgtgccttgtcgcaaccaggatgagctaatcgggagagcccggatttcgcagggagcaggctggtcacttaaggaaaccgcttgcctgggtaaaagctatgcccaaatgtggacgctcatgtacttccacaggcgagacctgcgtttggcagccaatgcgatctgttccgctgtgccaagtcattgggtcccgacatctagaaccacttggagcattcacgccaagcacgagtggatgacaaccgaggatatgttagcagtttggaaccgcgtgtggatccaggaaaatccctggatggaggacaaaactcctgtagaatcctgggaggaagtgccatatctggggaagcgggaggaccagtggtgcggatcactcataggccttaccagtagggccacatgggctaaaaacatccagacggccattaatcaagtcagatctctgatcggcaacgaggaatacaccgattatatgcccagcatgaagcgctttcggagggaggaagaggaagcaggggtgctatggtga

SEQ ID NO: 14366 - RNA, 9876 nt, synthetic construct
  misc_feature 1..9876: note = derived and/or modified CDS sequence (opt3) from DENV-2__FJ850074__SS-prME
  source 1..9876: mol_type = other RNA
accgccggcgtgatcgtcatgctgattcccacagttatggctttccacctcactacgagaaacggggagcctcatatgatagtgggaaggcaggaaaagggtaaaagccttctgtttaagaccgaggacggcgtaaatatgtgcacattgatggcaatcgatttaggggaactgtgtgaggacactattacctacaaatgcccactactccggcaaaacgaaccggaggatatcgactgttggtgcaattccacatctacctgggtgacttatggaacatgtaccacgactggcgagcaccgccgagaaaagcgttcagtcgccctggtgccccatgttggtatggggcttgagaccagaacagaaacttggatgagtagcgagggagcgtggaaacacgtgcagaggattgagacctggatcctgcggcatcctggcttcacaatgatggctgccatattggcatacaccatcggcacgactcactttcagcgcgccctcattttcatcctgctgacagctgtcgcaccatccatgaccatgagatgcattgggatctctaacagggattttgtggaaggagtatcgggtggctcatgggttgacatagtgctcgagcacgggagctgtgtcactacaatggccaagaataagcccaccttagatttcgaactgattaaaacggaggctaagcagcctgccacccttcggaaatattgcgtggaagcgaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgcaatgtttacatgcaaaaagaatatggaaggaaaagttgtgcagcctgagaacctcgaatacaccatcgtaatcactccacacagcggtgaggagcatgccgtgggcaatgacacggggaagcacggaaaagaaattaagataacaccgcagtcctcaatcaccgaggctgaactgactggctatggtaccgtcacaatggagtgtagtcccaggaccgggcttgatttcaacgaaatggtgctgttgcaaatggaggacaaagcctggctcgttcaccggcagtggtttctggatttacctctgccatggctccccggcgcagacactcagggaagcaattggattcagaaggagacacttgtgacgttcaagaaccctcatgctaaaaagcaagacgtcgtggtactgggctctcaggaaggggccatgcacaccgcgttgactggagccacagagatccagatgtcctcaggtaatctactgtttaccggccatctcaaatgccgtctgcgcatggataagcttcaactgaaagggatgagctacagtatgtgtacaggaaagttcaagatagttaaagaaattgcagagactcagcacggcaccatcgtgatcagagtccagtatgagggtgacgggtctccatgcaagattcccttcgaaatcatggatttggagaaaaggcatgtgctcggccggctgattacggtcaacccgatagtgaccgaaaaggactcccctgttaacatcgaggctgaacccccatttggagatagctacattatcatcggcgtggagcctgggcagttaaaactgaattggttcaagaagggatcgtctattggtcaaatgtttgagacaactatgcgaggcgccaaacgcatggctatactaggggacaccgcctgggatttcggatccctcggcggtgtatttacatcaatcgggaaggcactgcaccaggtcttcggcgccatttacggagctgcgtttagtggcgtgagctggactatgaaaatccttattggggttatcataacctggatcggaatgaactccagatctacgagcttgtcagtgagtctggtcctcgtgggcgtagtgacactgtatcttggtgcaatggttcaggccgactccgggtgtgtcgtgagctggaagaataaagaactgaagtgcggatctggcattttcatcaccgataacgtgcacacttggacagagcagtacaagtttcaacccgaatcaccaagtaaattggctagcgccattcagaaggcacatgaggaaggtatctgtggcataaggtccgtcacccggctcgagaatctgatgtggaaacagattactcccgagttaaaccacatcctgtctgaaaatgaggttaagctaaccattatgacaggggacatcaaaggaataatgcaggccggcaagcgctcgctcagacctcaaccaacggaactgaaatatagctggaagacctgggggaaggctaaaatgcttccgactgagtcccataaccagacattcttgatcgatggacccgaaaccgccgagtgccctaatacaaacagggcatggaattcactggaggtggaagactacggctttggtgtgttcactaccaacatttggctcaagctgcgtgagaaacaggacgtattttgtgatagtaagttaatgtctgcggctatcaaagacaatcgggccgtccacgcagatatggggtattggattgaaagcgccctgaacgacacgtggaagatggagaaggcttccttcatcgaggtgaaatcatgccactggccaaagagccatacactttggtctaatggagttttggaatccgagatgataattcccaaaaacttcgccggccctgtgagtcagcacaactaccgaccaggttatcatacccaaactgcaggcccctggcacctcgggaagctggaaatggattttgacttctgtgagggaaccacagtcgtggttactgaagattgcggcaatagagggccgagcctaaggaccacaacggcttctggaaaactgatcaccgagtggtgctgtcgctcctgcactctccctccactgcggtacagaggcgaggacggttgttggtacgggatggaaatcaggccccttaaggagaaggaagagaacttggtgaattcactggtaacagccggacatggccagattgataactttagtttaggtgtcctcggcatggcgctgttccttgaagagatgctgcgcacccgagtggggactaaacacgccatcttgctcgtggctgtcagctttgttacactgattaccggaaatatgtcgttccgggacctaggccgtgtgatggtaatggtgggggcaacgatgactgatgacataggaatgggcgtcacctatctggccctcctggctgcctttaaggtgagacctacattcgcagcgggtcttttgctgaggaaattaacctccaaggagctcatgatggccactatcggggttgctctgctttctcagagcacaattcccgaaaccatcctggagctaacagatgccctcgcactgggaatgatggctttgaaaattgtgaagaacatggaaaagtaccaactggccgtcactatcatggcaatatcatgcgtgccaaatgccgttatcttacagaacgcttggaaagtgagttgtaccattctcgcggccgtctccgtatctcctctgcttctgacgagctcccagcagaaggcagactggatccccttggctctcacaattaaaggcctgaatccaaccgccatctttctaactaccctgtcacgcacaagcaagaaacggagttggccgcttaacgaggccataatggctgtgggcatggtttctattctcgcatccagcctgttgaagaatgacatccctatgactgggcccctggtggccggaggtttactcaccgtctgctatgtgctgacgggcagatcggcggatcttgaactggagagggctgccgacgtaaaatgggaggatcaagcagaaatctcagggtctagtccaattttgtccataacaatcagcgaggacggatctatgagcattaagaacgaagaggaggaacagaccctcactatcctgattcgaacaggcctactggtgatctccggtgtcttccccgtttcaatacctatcaccgccgctgcatggtacctttgggaggtgaagaaacagcgcgccggggtgctctgggatgtcccaagtccccctccggtgggaaaggcggaactggaggacggcgcttatcggattaaacagagaggcatcttggggtacagccaaattggagccggtgtttataaggaaggcacttttcacacaatgtggcatgtaaccaggggggcagtgttaatgcaccgtggaaaacgcatcgagccatcttgggccgatgtcaagaaggacctggtgtcctacggcggtgggtggaaactcgagggagaatggaaggagggcgaagaggttcaggtgctggctcttgaacccggcaaaaatcctcgggccgtccagacgaagccagggatattcaaaactaacaccggaacaattggtgcagtgtcactggattttagtcccggcaccagcgggtcccctatcgtagacagaaagggaaaggtcgtgggcttgtacggtaatggggttgtgacaaggtctggagcttatgtctcggccatcgcgcagactgagaaaagcattgaggataacccggaaatcgaggacgatatattccgaaagaaacggctaaccattatggacctgcatcccggcgccggcaagacgaaacgctacctcccagcaatcgtgagagaagctattaagagggggctgcggacacttatcttagcccctactcgagttgtggctgcagagatggaagaggccctgagaggactccccatacgctatcaaaccccagccattagggctgagcacacaggtcgtgaaatcgtcgacttgatgtgtcatgcgaccttcactatgcggctgctctcacctgtgagagtacccaactacaatctgatcattatggatgaggcacactttaccgacccagcctccatcgctgccaggggctatattagtacacgcgtggaaatgggggaggcagccggaatattcatgacggctactccgcctggctctcgagatccctttccacagagcaacgcgcccatcatggacgaggaaagagagattcctgaacggtcctggaattcaggtcacgagtgggttaccgatttcaaggggaaaacagtctggtttgtgccatctatcaaggccggaaacgacatcgcagcttgccttaggaaaaatggcaagaaagtgattcagctgagccgcaagaccttcgatagtgaatacgtcaagactcgttccaacgactgggattttgtagtgacaaccgacataagcgagatgggcgccaatttcaaagcagagagagttatcgatccccggaggtgtatgaagcctgtgattttgacggacggggaagagcgcgtcatcctagccggaccgatgccagtgactcattcttcagctgcccaacgaagaggtcggattggcaggaaccccaaaaatgaaaacgaccagtatatctacatgggggagcctctggaaaatgatgaggactgcgcgcactggaaggaggcaaaaatgctcttagataacataaatacacccgaaggaatcattccatccatgtttgagcctgaacgcgagaaggttgacgccatcgatggcgaatacagactgaggggtgaggctcggaaaaccttcgtggaccttatgcgtcgcggggatctgcccgtctggctcgcctataaggtggctgcagagggcattaactacgccgaccgaagatggtgttttgatggaatcaagaataaccagatattggaagagaacgtagaagtggagatttggaccaaagagggcgaaaggaagaaactgaagccacggtggctcgacgctcgcatctatagtgatcctctggcccttaaagagttcaaggaattcgcagcggggagaaagagcctaactctgaatttgattacagagatgggaaggttaccgacctttatgacacagaaagcccggaacgctctggacaatctcgccgttctgcatactgcagaagctggtggcaaggcctacaaccacgcactttcggagctgcccgagacgctcgaaaccttgctgctactgacactccttgccactgtcaccgggggaatcttcctgtttttaatgtctggcaaaggtatagggaagatgacattgggcatgtgctgcatcattaccgcttccatcctgctctggtatgcgcaaattcagccacactggatcgccgcaagcataattctggagttctttcttatcgtgctgctcatccctgaacccgagaaacagcgaactccacaggataatcaattgacgtacgtggtcattgctatcctgaccgttgtggccgccacaatggcaaacgaaatgggattcttagagaagactaagaaagacctaggcctggggtcaataaccacacaggagagtgaatctaatattctcgacatcgatcttagacctgcttccgcctggaccctgtatgcggtagctactacatttgtgacgcccatgttgcgccatagcattgagaactcaagtgtcaatgtgagcctgaccgccatcgcaaaccaggccactgttctcatgggactgggtaagggctggccgctttccaaaatggacataggggtgccactcctggctatcggatgttactctcaggtcaatcctattacattgaccgcagccctgttactactggtagcgcactacgctatcattggccccggtctccaagccaaggcaaccagggaagcccagaaacgggctgccgcagggatcatgaagaacccaacagtggatggcattactgttatcgaccttgagcccataccttatgatccgaagttcgaaaaacagctgggacaggtgatgttgctgattctctgcgtcacgcaagtgctgatgatgcgtaccacatgggctctttgtgaggccttaactctggcgaccggccccatcagcacactctgggaggggaatccaggaagattttggaacaccactatcgccgtctccatggcaaatattttcaggggctcatacttggctggtgccgggctgctattttctataatgaagaacacgacaaatacccgccggggaactggcaacatcggtgaaaccctgggcgagaaatggaagagtcgactcaacgcacttgggaaatcggaattccagatttataagaaaagcggaatccaggaggtggacagaacactggctaaggagggcattaagaggggggaaactgatcatcacgccgtttcccgcggatctgccaaattgcggtggtttgtggagagaaatatggtaacccctgaaggcaaggtggtcgacctgggttgcgggcgtggaggctggtcatactattgtggtggcctcaaaaacgttagggaggtgaaggggctgacaaaaggaggccccgggcatgaagagcctatcccaatgagcacgtacggatggaatttagtccggcttcaatccggcgtggatgtattcttcaccccccctgagaagtgcgacactctgctctgtgatataggtgaaagttctccaaaccccacaatcgaggcggggcgcaccctacgagtgctgaatttggttgaaaactggctgaataacaatactcagttttgcattaaggtgctcaacccgtatatgcctagcgtcatcgagaaaatggaaacacttcagagaaagtacggaggcgctctggtgaggaatccattgtcacggaactccacccacgagatgtactgggtcagtaatgcaacgggcaacattgtgagctctgttaatatgatctcccgcatgctgataaacagattcaccatgaaacacaagaaagccacatatgagcccgacgtagatctcgggtcaggaactaggaacattggtatcgaaagcgagatccctaatttagacattataggcaagcgaatcgaaaagattaaacaggagcatgaaacctcgtggcactacgaccaagatcatccatataagacatgggcttaccacgggtcttatgagactaaacagaccggaagtgcctccagcatggtgaacggcgtcgtgcggctgcttacaaagccctgggacgttgtgccgatggtcacccagatggcaatgactgatacgacaccttttggtcagcaacgtgtgttcaaagagaaggtagacaccagaactcaggaacccaaggaggggaccaaaaagctgatgaaaatcacagccgaatggctatggaaggagctcggaaaaaagaaaacgccacgcatgtgtaccagggaggaatttactcggaaggtgagatcaaatgctgcgctgggcgccattttcacagatgagaacaagtggaaatccgcacgcgaagctgttgaggacggcaggttttgggaattggtcgatcgagagcggaatctgcacctcgaggggaagtgcgaaacctgtgtgtacaacatgatgggaaaaagagagaagaaacttggtgaattcggcaaggccaaggggtctagggcaatctggtatatgtggctgggagcccgctttttagagttcgaagctctgggctttttgaatgaggaccattggttcagccgtggtaacagtctctccggggtggagggagaaggcctgcaccggctaggctacatacttagagatgtcagcaaaaaggaggggggagccatgtacgcggacgatactgcaggttgggacacaaggatcaccctggaagacctcaaaaatgaggaaatggttacaaaccatatgaagggcgagcacaaaaagctggccgaggctatttttaagttgacttatcagaataaagtggtacgcgtgcagcgacctaccccccgggggacggtcatggatatcatttctagaagggaccaacgcggatcaggccaggtgggtacctacgggctgaacacattcactaatatggaagcccagctcatcagacaaatggagggagaaggcattttcaagagtatacagcatcttaccgttacagaggagatcgcagtgcagaactggctggctcgggtcggcagggaacgtttaactcgaatggccatttccggggatgactgcgtggtaaaaccaatcgatgaccgctttgctaatgccctgaccgcattgaacgatatgggaaaggttagaaaagacatccagcaatgggagcccagccggggttggaacgattggacgcaggtgcctttctgctctcaccactttcatgaactcgtcatgaaggacggcagggtgctggtggtcccatgtcgcaatcaggatgagctaattgggagagcgcggatatcgcagggagccggctggtcacttaaggaaacagcttgcctgggtaaaagctatgcccaaatgtggaccctcatgtacttccacaggcgagacctgcgtttggcagctaacgccatctgttccgcagttccgagtcattgggtgcccacttctagaacaacctggagcattcacgccaagcacgagtggatgactaccgaggatatgttagcggtatggaatcgcgtgtggatccaggaaaacccttggatggaggacaaaacaccagtcgaatcctgggaggaagtgccctatctggggaagcgggaggaccagtggtgcggatcactcattggccttacgagtagggctacctgggccaaaaatatccagactgcaataaaccaagttagatctctgatcggcaatgaggaatacacagattatatgcctagcatgaagcgctttcggagggaggaagaggaagccggggtgctatggtga

SEQ ID NO: 14367 - RNA, 9876 nt, synthetic construct
  misc_feature 1..9876: note = derived and/or modified CDS sequence (opt3) from DENV-2__FJ850076__SS-prME
  source 1..9876: mol_type = other RNA
accgccggagctatcgtgatgctgattcccaccgtcatggcattccacctcactacgaggaatggggagcctcatatgatagttggaaggcaggaaaagggtaaaagccttctgtttaagaccgaggacggagtgaatatgtgcaccttgatggccatcgatttaggggaactgtgtgaggacactattacctacaaatgcccactactccggcaaaatgaaccggaggatatcgactgttggtgcaattccacgtctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaatgatggccgcaatattggcctacaccatcggcacgactcactttcagcgcgctctcattttcatcctgctgacagcagtggccccatccatgaccatgagatgcattgggatctctaacagggattttgtcgaaggagtgtcgggtggctcatgggtagacatagttctcgagcacgggagctgtgtgactacaatggctaagaataagcccaccttagatttcgaactgattaaaacggaggccaagcagcctgcgacccttcggaaatattgcgtcgaagcaaagttgacaaacactaccacagagagtcgctgtccaactcaaggagagccctccctgaatgaggaacaggacaaacgatttatctgcaagcattctatggtggatagaggctggggtaacgggtgtggactattcggcaagggcgggattgtgacctgcgccatgtttacatgcaaaaagaatatggaaggaaaagtcgttcagcctgagaacctcgaatacaccatcgtgatcactccacacagcggtgaggagcatgctgtaggcaatgacacggggaagcacggaaaagaaattaagataacaccgcagtcctcaatcaccgaggccgaactgactggctatggtaccgtgacaatggagtgtagtcccaggaccgggcttgatttcaacgaaatggtcctgttgcaaatggaggacaaagcatggctcgtgcaccggcagtggtttctggatttacctctgccatggctccccggcgctgacactcagggaagcaattggattcagaaggagacacttgttacgttcaagaaccctcatgccaaaaagcaagacgtggtcgtgctgggctctcaggaaggggcgatgcacaccgccttgactggagcaacagagatccagatgtcctcaggtaatctactgtttaccggccatctcaaatgccgtctgcgcatggataaacttcaactgaaagggatgagctacagtatgtgtacaggaaagttcaagatagtaaaagaaattgctgagactcagcacggcaccatcgttatcagagtgcagtatgagggtgacgggtctccatgcaagattcccttcgaaatcatggatttggagaaaaggcatgtcctcggccggctgattacggtgaacccgatagtcaccgaaaaggactcccctgtgaacatcgaggccgaacccccatttggagatagctacattatcatcggcgttgagcctgggcagttaaaactgaattggttcaagaagggatcgtctattggtcaaatgtttgagacaactatgcgaggcgctaaacgcatggccatactaggggacaccgcatgggatttcggatccctcggcggtgtgtttacatcaatcgggaaggccctgcaccaggtattcggcgctatttacggagcggcatttagtggcgtcagctggactatgaaaatccttattggggtgatcataacctggatcggaatgaactccagatctacgagcttgtcagttagtctggtgctcgtcggcgtggtaacactgtatcttggtgccatggtgcaggctgactccgggtgtgttgtcagctggaagaataaagaactgaagtgcggatctggcattttcatcaccgataacgtgcacacttggacagagcagtacaagtttcaacccgaatcaccaagtaaattggccagcgcaattcagaaggcccatgaggaaggtatctgtggcataaggtccgtgacccggctcgagaatctgatgtggaaacagattactcccgagttaaaccacatcctgtctgaaaatgaggtcaagctaaccattatgacaggggacatcaaaggaataatgcaggctggcaagcgctcgctcagacctcaaccaacggaactgaaatatagctggaagacctgggggaaggccaaaatgcttccgactgagtcccataaccagacattcttgatcgatggacccgaaaccgcagagtgccctaatacaaacagggcgtggaactcactggaggttgaagactacggctttggtgtgttcactaccaacatttggctcaagctgcgtgagaaacaggacgtgttttgtgatagtaagttaatgtctgctgccatcaaagacaatcgggcagtacacgccgatatggggtattggattgaaagcgctctgaacgacacgtggaagatggagaaggcctccttcatcgaggtcaaatcatgccactggccaaagagccatacactttggtctaatggagtgttggaatccgagatgataattcccaaaaacttcgcaggccctgttagtcagcacaactaccgaccaggttatcatacccaaactgctggcccctggcacctcgggaagctggaaatggattttgacttctgtgagggaaccacagtggtcgtgactgaagattgcggcaatagagggccgagcctaaggaccacaacggcctctggaaaactgatcaccgagtggtgctgtcgctcctgcactctccctccactgcggtacagaggcgaggacggttgttggtacgggatggaaatcaggccccttaaggagaaggaagagaacttggttaattcactggtgacagcgggacatggccagattgataactttagtttaggtgtactcggcatggccctgttccttgaagagatgctgcgcacccgagtcgggactaaacacgctatcttgctcgtggcagtgagctttgtcacactgattaccggaaatatgtcgttccgggacctaggccgtgttatggtgatggtaggggccacgatgactgatgacataggaatgggcgtgacctatctggctctcctggccgcatttaaggtcagacctacattcgcggccggtcttttgctgaggaaattaacctccaaggagctcatgatggctactatcggggtggccctgctttctcagagcacaattcccgaaaccatcctggagctaacagatgcactcgctctgggaatgatggccttgaaaattgttaagaacatggaaaagtaccaactggcagtgactatcatggccatatcatgcgtcccaaatgctgtgatcttacagaacgcgtggaaagttagttgtaccattctcgccgcagtgtccgtctctcctctgcttctgacgagctcccagcagaaggctgactggatccccttggccctcacaattaaaggcctgaatccaaccgccatctttctaactaccctgtcacgcacaagcaagaaacggagttggccgcttaacgaggctataatggcagtaggcatggtgtctattctcgcctccagcctgttgaagaatgacgttcctatgactgggcccctggtggcgggaggtttactcaccgtctgctatgtgctgacgggcagatcggctgatcttgaactggagagggccgcagacgtaaaatgggaggatcaagccgaaatctcagggtctagtccaatcttgtccattacaataagcgaggacggatctatgagcatcaagaacgaagaggaggaacagaccctcactattctgatccgaacaggcctactggtgatttccggtgtcttccccgtttcaatccctataaccgctgcagcctggtacctttgggaggtgaagaaacagcgcgcgggggtgctctgggatgtcccaagtccccctccggtgggaaaggctgaactggaggacggcgcctatcggatcaaacagagaggcattttggggtacagccaaatcggagcaggggtttataaggaaggcacttttcacacaatgtggcatgtaaccaggggtgcagtgttaatgcaccgtggaaaacgcattgagccatcttgggctgatgtcaagaaggacctggtgtcctacggcggtgggtggaaactcgagggagaatggaaggagggcgaagaggttcaggtgctggcccttgaacccggcaaaaatcctcgggcagtccagacgaagccagggatcttcaaaactaacaccggaacaataggtgctgtgtcactggattttagtcccggcaccagcgggtcccctattgtagacagaaagggaaaggtcgtgggcttgtacggtaatggggttgtgacaaggtctggagcctatgtctcggcgatcgcccagactgagaaaagcatcgaggataacccggaaattgaggacgatatcttccgaaagaaacggctaaccataatggacctgcatcccggcgcaggcaagacgaaacgctacctcccagctattgtgagagaagccatcaagagggggctgcggacacttattttagctcctactcgagttgtggcagccgagatggaagaggccctgagaggactccccatccgctatcaaaccccagctataagggcggagcacacaggtcgtgaaattgtcgacttgatgtgtcatgcaaccttcactatgcggctgctctcacctgtgagagtacccaactacaatctgatcatcatggatgaggcccactttaccgacccagcttccattgccgcaaggggctatatcagtacacgcgtggaaatgggggaggccgctggaattttcatgacggcgactccgcctggctctcgagatccctttccacagagcaacgcccccataatggacgaggaaagagagatccctgaacggtcctggaactcaggtcacgagtgggttaccgatttcaaggggaaaacagtctggtttgtgccatctattaaggcaggaaacgacatcgctgcctgccttaggaaaaatggcaagaaagtgatccagctgagccgcaagaccttcgatagtgaatacgtcaagactcgttccaacgactgggattttgtagtgacaaccgacattagcgagatgggcgcaaatttcaaagccgagagagttatagatccccggaggtgtatgaagcctgtgatcttgacggacggggaagaacgcgtcattctagctggaccgatgccagtgactcattcttcagccgcgcaacgaagaggtcggatcggcaggaaccccaaaaatgaaaacgaccagtatatttacatgggggagcctctggaaaatgatgaggactgcgcacactggaaggaggccaaaatgctcttagataacatcaatacacccgaaggaataatcccatccatgtttgagcctgaacgcgagaaggttgacgctattgatggcgaatacagactgaggggtgaggcccggaaaaccttcgtggaccttatgcgtcgcggggatctgcccgtctggctcgcttataaggtggcagccgagggcatcaactacgctgaccgaagatggtgttttgatggaattaagaataaccagatcttggaagagaacgtagaagtggagatatggaccaaagagggcgaaaggaagaaactgaagccacggtggctcgacgcccgcatttatagtgatcctctggcacttaaagagttcaaggagttcgcggccgggagaaagagcctaactctgaatttgatcacagagatgggaaggttaccgacctttatgacacagaaagctcggaacgccctggacaatctcgcagttctgcatactgctgaagccggtggcaaggcatacaaccacgccctttcggagctgcccgagacgctcgaaaccttgctgctactgacactccttgctactgtcaccgggggaattttcctgtttttaatgtctggcaaaggtatcgggaagatgacattgggcatgtgctgcataatcaccgcgtccattctgctctggtatgcccaaatccagccacactggattgcagctagcatcatactggagttctttcttattgtgctgctcatccctgaacccgagaaacagcgaactccacaggataatcaattgacgtacgtggtcatcgccattctgaccgttgtggccgcaacaatggctaacgaaatgggattcttagagaagactaagaaagacctaggcctggggtcaatcaccacacaggagagtgaatctaatatactcgacattgatcttagacctgcctccgcgtggaccctgtatgctgtagccactacatttgtgacgcccatgttgcgccatagcatcgagaactcaagtgtcaatgtgagcctgaccgcaattgccaaccaggctactgttctcatgggactgggtaagggctggccgctttccaaaatggacatcggggtgccactcctggcaataggatgttactctcaggtcaatcctatcacattgaccgccgcgctgttactactggtagctcactacgccattatcggccccggtctccaagcaaaggccaccagggaagctcagaaacgggccgcagctgggattatgaagaacccaacagtggatggcatcactgttattgaccttgagcccatcccttatgatccgaagttcgaaaaacagctgggacaggtgatgttgctgatactctgcgtcacgcaagtgctgatgatgcgtaccacatgggccctttgtgaggcgttaactctggccaccggccccattagcacactctgggaggggaatccaggaagattttggaacaccactatcgcagtctccatggctaatatcttcaggggctcatacttggccggtgcagggctgctattttctattatgaagaacacgacaaatacccgccggggaactggcaacataggtgaaaccctgggcgagaaatggaagagtcgactcaacgctcttgggaaatcggagttccagatctataagaaaagcggcattcaggaggtggacagaacactggccaaggagggcatcaagagaggggaaactgatcatcacgccgtttcccgcggatctgcgaaattgcggtggtttgtggagagaaatatggtaacccctgaaggcaaggtggtcgacctgggttgcgggcgtggaggctggtcatactattgtggtggcctcaaaaacgttagggaggtgaaggggctgacaaaaggaggccccgggcatgaagaacctattccaatgagcacgtacggatggaatttagtccggcttcaatccggcgtggatgtattcttcacaccccctgagaagtgcgacactctgctctgtgatatcggtgaaagttctccaaaccccacaatagaggctgggcgcaccctacgagtgctgaatttggttgaaaactggctgaataacaatactcagttttgcatcaaggtgctcaacccgtatatgcctagcgtcattgagaaaatggaaacacttcagagaaagtacggaggcgcactggtgaggaatccattgtcacggaactccacccacgagatgtactgggtcagtaatgccacgggcaacatcgtgagctctgttaatatgatttcccgcatgctgatcaacagattcaccatgaaacacaagaaagctacatatgagcccgacgtagatctcgggtcaggaactaggaacataggtattgaaagcgagatccctaatttagacatcattggcaagcgaatagaaaagatcaaacaggagcatgaaacctcgtggcactacgaccaagatcatccatataagacatgggcctaccacgggtcttatgagactaaacagaccggaagtgcatccagcatggtgaacggcgtcgtgcggctgcttacaaagccctgggacgttgtgccgatggtcacccagatggccatgactgatacgacaccttttggtcagcaacgtgtgttcaaagagaaggtagacaccagaactcaggaacccaaggaggggaccaaaaagctgatgaaaattacagctgaatggctatggaaggagctcggcaagaagaaaacgccacgcatgtgtaccagggaggaatttactcggaaggtgagatcaaatgcggccctgggcgcaatcttcacagatgagaacaagtggaaatccgctcgcgaagccgttgaggacggcaggttttgggaattggtcgatcgagagcggaatctgcacctcgaggggaagtgcgaaacctgtgtgtacaacatgatgggaaaaagagagaagaaacttggtgagttcggcaaggcaaaggggtctagggccatttggtatatgtggctgggagctcgctttttagagttcgaagccctgggctttttgaatgaggaccattggttcagccgtggtaacagtctctccggggtggagggagaaggcctgcaccggctaggctacatccttagagatgtcagcaaaaaggaagggggagcgatgtacgcagacgatactgccggttgggacacaaggataaccctggaagacctcaaaaatgaggaaatggttacaaaccatatgaagggcgagcacaaaaagctggctgaggccatctttaagttgacttatcagaataaagtggtacgcgtgcagcgacctacaccccgggggacggtcatggatattatctctagaagggaccaacgcggatcaggccaggtgggtacctacgggctgaacacattcactaatatggaagcacagctcattagacaaatggagggagaaggcatcttcaagagtattcagcatcttaccgttacagaggagatagctgtgcagaactggctggcccgggtcggcagggaacgtttaactcgaatggctatctccggggatgactgcgtggtaaaaccaattgatgaccgctttgccaatgcactgaccgcgttgaacgatatgggaaaggttagaaaagacatccagcaatgggagcccagccggggttggaacgattggacacaggtgcctttctgctctcaccactttcatgaactcgtcatgaaggacggcagggtgctggtggtcccatgtcgcaatcaggatgagctaatcgggagagcccggatttcgcagggagctggctggtcacttaaggaaacagcctgcctgggtaaaagctatgcacaaatgtggaccctcatgtacttccacaggcgagacctgcgtttggctgccaacgcaatatgttccgccgttccgagtcattgggtgcccacttctagaacaacctggagcatccacgcgaagcacgagtggatgactaccgaggatatgttagctgtatggaatcgcgtgtggattcaggaaaacccttggatggaggacaaaacaccagtcgaatcctgggaggaagtgccctatctggggaagcgggaggaccagtggtgcggatcactcatcggccttacgagtagggccacctgggccaaaaatattcagactgccatcaaccaagttagatctctgataggcaatgaggaatacacagattatatgcctagcatgaagcgctttcggagggaggaagaggaagctggggtgctatggtga

SEQ ID NO: 14368 - RNA, 9876 nt, synthetic construct
  misc_feature 1..9876: note = derived and/or modified CDS sequence (opt3) from DENV-2__GQ868640__SS-prME
  source 1..9876: mol_type = other RNA
accgccggagctatcgtgatgctgattcccaccgtcatggcattccacctcactacgaggaatggggagcctcatatgatagttggaaggcaggaaaagggtaaaagccttctgtttaagaccgaggacggcgtgaatatgtgcaccttgatggccatcgatttaggggaactgtgtgaggacactattacctacaaatgcccactactccggcaaaatgaaccggaggatatcgactgttggtgcaattccacgtctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaatgatggccgcaatattggcctacaccatcggcacgactcactttcagcgcgctctcattttcatcctgctgacagcagtggccccatccatgaccatgagatgcattgggatctctaacagggattttgtcgaaggagtgtcgggtggctcatgggtagacatagttctcgagcacgggagctgtgtgactacaatggctaagaataagcccaccttagatttcgaactgattaaaacggaggccaagcagcctgcgacccttcggaaatattgcgtcgaagcaaagttgacaaacactaccacagagagtcgctgtccaactcaaggagagccctccctgaatgaggaacaggacaaacgatttatctgcaagcattctatggtggatagaggctggggtaacgggtgtggactattcggcaagggcgggattgtgacctgcgccatgtttacatgcaaaaagaatatggaaggaaaagtcgttcagcctgagaacctcgaatacaccatcgtgatcactccacacagcggtgaggagcatgctgtaggcaatgacacggggaagcacggaaaagaaattaagataacaccgcagtcctcaatcaccgaggccgaactgactggctatggtaccgtgacaatggagtgtagtcccaggaccgggcttgatttcaacgaaatggtcctgttgcaaatggaggacaaagcatggctcgtgcaccggcagtggtttctggatttacctctgccatggctccccggcgctgacactcagggaagcaattggattcagaaggagacacttgttacgttcaagaaccctcatgccaaaaagcaagacgtggtcgtgctgggctctcaggaaggggcgatgcacaccgccttgactggagcaacagagatccagatgtcctcaggtaatctactgtttaccggccatctcaaatgccgtctgcgcatggataaacttcaactgaaagggatgagctacagtatgtgtacaggaaagttcaagatagtaaaagaaattgctgagactcagcacggcaccatcgttatcagagtgcagtatgagggtgacgggtctccatgcaagattcccttcgaaatcatggatttggagaaaaggcatgtcctcggccggctgattacggtgaacccgatagtcaccgaaaaggactcccctgtgaacatcgaggccgaacccccatttggagatagctacattatcatcggcgttgagcctgggcagttaaaactgaattggttcaagaagggatcgtctattggtcaaatgtttgagacaactatgcgaggcgctaaacgcatggccatactaggggacaccgcatgggatttcggatccctcggcggtgtgtttacatcaatcgggaaggccctgcaccaggtattcggcgctatttacggagcggcatttagtggcgtcagctggactatgaaaatccttattggggtgatcataacctggatcggaatgaactccagatctacgagcttgtcagttagtctggtgctcgtcggcgtggtaacactgtatcttggtgccatggtgcaggctgactccgggtgtgttgtcagctggaagaataaagaactgaagtgcggatctggcattttcatcaccgataacgtgcacacttggacagagcagtacaagtttcaacccgaatcaccaagtaaattggccagcgcaattcagaaggcccatgaggaaggtatctgtggcataaggtccgtgacccggctcgagaatctgatgtggaaacagattactcccgagttaaaccacatcctgtctgaaaatgaggtcaagctaaccattatgacaggggacatcaaaggaataatgcaggctggcaagcgctcgctcagacctcaaccaacggaactgaaatatagctggaagacctgggggaaggccaaaatgcttccgactgagtcccataaccagacattcttgatcgatggacccgaaaccgcagagtgccctaatacaaacagggcgtggaactcactggaggttgaagactacggctttggtgtgttcactaccaacatttggctcaagctgcgtgagaaacaggacgtgttttgtgatagtaagttaatgtctgctgccatcaaagacaatcgggcagtacacgccgatatggggtattggattgaaagcgctctgaacgacacgtggaagatggagaaggcctccttcatcgaggtcaaatcatgccactggccaaagagccatacactttggtctaatggagtgttggaatccgagatgataattcccaaaaacttcgcaggccctgttagtcagcacaactaccgaccaggttatcatacccaaactgctggcccctggcacctcgggaagctggaaatggattttgacttctgtgagggaaccacagtggtcgtgactgaagattgcggcaatagagggccgagcctaaggaccacaacggcctctggaaaactgatcaccgagtggtgctgtcgctcctgcactctccctccactgcggtacagaggcgaggacggttgttggtacgggatggaaatcaggccccttaaggagaaggaagagaacttggttaattcactggtgacagcgggacatggccagattgataactttagtttaggtgtactcggcatggccctgttccttgaagagatgctgcgcacccgagtcgggactaaacacgctatcttgctcgtggcagtgagctttgtcacactgattaccggaaatatgtcgttccgggacctaggccgtgttatggtgatggtaggggccacgataactgatgacatcggaatgggcgtgacctatctggctctcctggccgcatttaaggtcagacctacattcgcggccggtcttttgctgaggaaattaacctccaaggagctcatgatggctactattggggtggccctgctttctcagagcacaatccccgaaaccattctggagctaacagatgcactcgctctgggaatgatggccttgaaaatcgttaagaacatggaaaagtaccaactggcagtgactataatggccatctcatgcgtcccaaatgctgtgattttacagaacgcgtggaaagttagttgtaccatcctcgccgcagtgtccgtctctcctctgcttctgacgagctcccagcagaaggctgactggattcccttggccctcacaatcaaaggcctgaatccaaccgccatatttctaactaccctgtcacgcacaagcaagaaacggagttggccgcttaacgaggctattatggcagtaggcatggtgtctatcctcgcctccagcctgttgaagaatgacgttcctatgactgggcccctggtggcgggaggtttactcaccgtctgctatgtgctgacgggcagatcggctgatcttgaactggagagggccgcagacgtaaaatgggaggatcaagccgaaatctcagggtctagtccaattttgtccataacaatcagcgaggacggatctatgagcattaagaacgaagaggaggaacagaccctcactatcctgattcgaacaggcctactggtgatctccggtgtcttccccgtttcaatacctatcaccgctgcagcctggtacctttgggaggtgaagaaacagcgcgcgggggtgctctgggatgtcccaagtccccctccggtgggaaaggctgaactggaggacggcgcctatcggattaaacagagaggcatcttggggtacagccaaattggagcaggggtttataaggaaggcacttttcacacaatgtggcatgtaaccaggggtgcagtgttaatgcaccgtggaaaacgcatcgagccatcttgggctgatgtcaagaaggacctggtgtcctacggcggtgggtggaaactcgagggagaatggaaggagggcgaagaggttcaggtgctggcccttgaacccggcaaaaatcctcgggcagtccagacgaagccagggatattcaaaactaacaccggaacaattggtgctgtgtcactggattttagtcccggcaccagcgggtcccctatcgtagacagaaagggaaaggtcgtgggcttgtacggtaatggggttgtgacaaggtctggagcctatgtctcggcgatcgcccagactgagaaaagcattgaggataacccggaaatcgaggacgatatattccgaaagaaacggctaaccattatggacctgcatcccggcgcaggcaagacgaaacgctacctcccagctatcgtgagagaagccattaagagggggctgcggacacttatcttagctcctactcgagttgtggcagccgagatggaagaggccctgagaggactccccatacgctatcaaaccccagctattagggcggagcacacaggtcgtgaaatcgtcgacttgatgtgtcatgcaaccttcactatgcggctgctctcacctgtgagagtacccaactacaatctgatcattatggatgaggcccactttaccgacccagcttccatcgccgcaaggggctatattagtacacgcgtggaaatgggggaggccgctggaatattcatgacggcgactccgcctggctctcgagatccctttccacagagcaacgcccccatcatggacgaggaaagagagattcctgaacggtcctggaactcaggtcacgagtgggttaccgatttcaaggggaaaacagtctggtttgtgccatctatcaaggcaggaaacgacatcgctgcctgccttaggaaaaatggcaagaaagtgattcagctgagccgcaagaccttcgatagtgaatacgtcaagactcgttccaacgactgggattttgtagtgacaaccgacataagcgagatgggcgcaaatttcaaagccgagagagttatcgatccccggaggtgtatgaagcctgtgattttgacggacggggaagaacgcgtcatcctagctggaccgatgccagtgactcattcttcagccgcgcaacgaagaggtcggattggcaggaaccccaaaaatgaaaacgaccagtatatctacatgggggagcctctggaaaatgatgaggactgcgcacactggaaggaggccaaaatgctcttagataacataaatacacccgaaggaatcattccatccatgtttgagcctgaacgcgagaaggttgacgctatcgatggcgaatacagactgaggggtgaggcccggaaaaccttcgtggaccttatgcgtcgcggggatctgcccgtctggctcgcttataaggtggcagccgagggcattaactacgctgaccgaagatggtgttttgatggaatcaagaataaccagatattggaagagaacgtagaagtggagatttggaccaaagagggcgaaaggaagaaactgaagccacggtggctcgacgcccgcatctatagtgatcctctggcacttaaagagttcaaggagttcgcggccgggagaaagagcctaactctgaatttgattacagagatgggaaggttaccgacctttatgacacagaaagctcggaacgccctggacaatctcgcagttctgcatactgctgaagccggtggcaaggcatacaaccacgccctttcggagctgcccgagacgctcgaaaccttgctgctactgacactccttgctactgtcaccgggggaatcttcctgtttttaatgtctggcaaaggtatagggaagatgacattgggcatgtgctgcatcattaccgcgtccatcctgctctggtatgcccaaattcagccacactggatcgcagctagcataattctggagttctttcttatcgtgctgctcatccctgaacccgagaaacagcgaactccacaggataatcaattgacgtacgtggtcattgccatcctgaccgttgtggccgcaacaatggctaacgaaatgggattcttagagaagactaagaaagacctaggcctggggtcaataaccacacaggagagtgaatctaatattctcgacatcgatcttagacctgcctccgcgtggaccctgtatgctgtagccactacatttgtgacgcccatgttgcgccatagcattgagaactcaagtgtcaatgtgagcctgaccgcaatcgccaaccaggctactgttctcatgggactgggtaagggctggccgctttccaaaatggacataggggtgccactcctggcaatcggatgttactctcaggtcaatcctattacattgaccgccgcgctgttactactggtagctcactacgccatcattggccccggtctccaagcaaaggccaccagggaagctcagaaacgggccgcagctgggatcatgaagaacccaacagtggatggcattactgttatcgaccttgagcccataccttatgatccgaagttcgaaaaacagctgggacaggtgatgttgctgattctctgcgtcacgcaagtgctgatgatgcgtaccacatgggccctttgtgaggcgttaactctggccaccggccccatcagcacactctgggaggggaatccaggaagattttggaacaccactatcgcagtctccatggctaatattttcaggggctcatacttggccggtgcagggctgctattttctataatgaagaacacgacaaatacccgccggggaactggcaacatcggtgaaaccctgggcgagaaatggaagagtcgactcaacgctcttgggaaatcggagttccagatttataagaaaagcggaatccaggaggtggacagaacactggccaaggagggcattaagagaggggaaactgatcatcacgccgtttcccgcggatctgcgaaattgcggtggtttgtggagagaaatatggtaacccctgaaggcaaggtggtcgacctgggttgcgggcgtggaggctggtcatactattgtggtggcctcaaaaacgttagggaggtgaaggggctgacaaaaggaggccccgggcatgaagaacctatcccaatgagcacgtacggatggaatttagtccggcttcaatccggcgtggatgtattcttcacaccccctgagaagtgcgacactctgctctgtgatataggtgaaagttctccaaaccccacaatcgaggctgggcgcaccctacgagtgctgaatttggttgaaaactggctgaataacaatactcagttttgcattaaggtgctcaacccgtatatgcctagcgtcatcgagaaaatggaaacacttcagagaaagtacggaggcgcactggtgaggaatccattgtcacggaactccacccacgagatgtactgggtcagtaatgccacgggcaacattgtgagctctgttaatatgatctcccgcatgctgataaacagattcaccatgaaacacaagaaagctacatatgagcccgacgtagatctcgggtcaggaactaggaacattggtatcgaaagcgagatccctaatttagacattataggcaagcgaatcgaaaagattaaacaggagcatgaaacctcgtggcactacgaccaagatcatccatataagacatgggcctaccacgggtcttatgagactaaacagaccggaagtgcatccagcatggtgaacggcgtcgtgcggctgcttacaaagccctgggacgttgtgccgatggtcacccagatggccatgactgatacgacaccttttggtcagcaacgtgtgttcaaagagaaggtagacaccagaactcaggaacccaaggaggggaccaaaaagctgatgaaaatcacagctgaatggctatggaaggagctcggcaagaagaaaacgccacgcatgtgtaccagggaggaatttactcggaaggtgagatcaaatgcggccctgggcgcaattttcacagatgagaacaagtggaaatccgctcgcgaagccgttgaggacggcaggttttgggaattggtcgatcgagagcggaatctgcacctcgaggggaagtgcgaaacctgtgtgtacaacatgatgggaaaaagagagaagaaacttggtgagttcggcaaggcaaaggggtctagggccatctggtatatgtggctgggagctcgctttttagagttcgaagccctgggctttttgaatgaggaccattggttcagccgtggtaacagtctctccggggtggagggagaaggcctgcaccggctaggctacatacttagagatgtcagcaaaaaggaagggggagcgatgtacgcagacgatactgccggttgggacacaaggatcaccctggaagacctcaaaaatgaggaaatggttacaaaccatatgaagggcgagcacaaaaagctggctgaggccatttttaagttgacttatcagaataaagtggtacgcgtgcagcgacctacaccccgggggacggtcatggatatcatttctagaagggaccaacgcggatcaggccaggtgggtacctacgggctgaacacattcactaatatggaagcacagctcatcagacaaatggagggagaaggcattttcaagagtatacagcatcttaccgttacagaggagatcgctgtgcagaactggctggcccgggtcggcagggaacgtttaactcgaatggctatttccggggatgactgcgtggtaaaaccaatcgatgaccgctttgccaatgcactgaccgcgttgaacgatatgggaaaggttagaaaagacatccagcaatgggagcccagccggggttggaacgattggacacaggtgcctttctgctctcaccactttcatgaactcgtcatgaaggacggcagggtgctggtggtcccatgtcgcaatcaggatgagctaattgggagagcccggatatcgcagggagctggctggtcacttaaggaaacagcctgcctgggtaaaagctatgcacaaatgtggaccctcatgtacttccacaggcgagacctgcgtttggctgccaacgcaatctgttccgccgttccgagtcattgggtgcccacttctagaacaacctggagcattcacgcgaagcacgagtggatgactaccgaggatatgttagctgtatggaatcgcgtgtggatccaggaaaacccttggatggaggacaaaacaccagtcgaatcctgggaggaagtgccctatctggggaagcgggaggaccagtggtgcggatcactcattggccttacgagtagggccacctgggccaaaaatatccagactgccataaaccaagttagatctctgatcggcaatgaggaatacacagattatatgcctagcatgaagcgctttcggagggaggaagaggaagctggggtgctatggtga

SEQ ID NO: 14369 - RNA, 9876 nt, synthetic construct
  misc_feature 1..9876: note = derived and/or modified CDS sequence (opt3) from DENV-2__FJ850078__SS-prME
  source 1..9876: mol_type = other RNA
accgccggcgtgatcgtcatgctgattcccacagttatggctttccacctcactacgagaaacggggagcctcatatgatagtgggaaggcaggaaaagggtaaaagccttctgtttaagaccgaggacggcgtaaatatgtgcacattgatggcaatcgatttaggggaactgtgtgaggacactattacctacaaatgcccactactccggcaaaacgaaccggaggatatcgactgttggtgcaattccacatctacctgggtgacttatggaacatgtaccacgactggcgagcaccgccgagaaaagcgttcagtcgccctggtgccccatgttggtatggggcttgagaccagaacagaaacttggatgagtagcgagggagcgtggaaacacgtgcagaggattgagacctggatcctgcggcatcctggcttcacaatgatggctgccatattggcatacaccatcggcacgactcactttcagcgcgccctcattttcatcctgctgacagctgtcgcaccatccatgaccatgagatgcattgggatctctaacagggattttgtggaaggagtatcgggtggctcatgggttgacatagtgctcgagcacgggagctgtgtcactacaatggccaagaataagcccaccttagatttcgaactgattaaaacggaggctaagcagcctgccacccttcggaaatattgcgtggaagcgaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgcaatgtttacatgcaaaaagaatatggaaggaaaagttgtgcagcctgagaacctcgaatacaccatcgtaatcactccacacagcggtgaggagcatgccgtgggcaatgacacggggaagcacggaaaagaaattaagataacaccgcagtcctcaatcaccgaggctgaactgactggctatggtaccgtcacaatggagtgtagtcccaggaccgggcttgatttcaacgaaatggtgctgttgcaaatggaggacaaagcctggctcgttcaccggcagtggtttctggatttacctctgccatggctccccggcgcagacactcagggaagcaattggattcagaaggagacacttgtgacgttcaagaaccctcatgctaaaaagcaagacgtcgtggtactgggctctcaggaaggggccatgcacaccgcgttgactggagccacagagatccagatgtcctcaggtaatctactgtttaccggccatctcaaatgccgtctgcgcatggataagcttcaactgaaagggatgagctacagtatgtgtacaggaaagttcaagatagttaaagaaattgcagagactcagcacggcaccatcgtgatcagagtccagtatgagggtgacgggtctccatgcaagattcccttcgaaatcatggatttggagaaaaggcatgtgctcggccggctgattacggtcaacccgatagtgaccgaaaaggactcccctgttaacatcgaggctgaacccccatttggagatagctacattatcgtgggcgtagagcctgggcagttaaaactgaattggttcaagaagggatcgtctatcggtcaaatgtttgagacaactatgcgaggcgccaaacgcatggctattctaggggacaccgcctgggatttcggatccctcggcggtgtctttacatcaatagggaaggcactgcaccaggtgttcggcgccatctacggagctgcgtttaacggcgttagttggactatgaaaattcttatcggggtgattatcacctggataggaatgaatagcagatccacgtctttgagcgtctcactggtgctcgtaggcgtggttacactgtatcttggtgcaatggtccaggccgacagtgggtgtgtggtgtcctggaagaacaaagaactgaagtgcggaagcggcatcttcattaccgataatgtccacacttggacagagcagtacaagtttcaacccgaatctccatcaaaattggctagtgccatccagaaggcacatgaggaaggtatttgtggcatcaggagcgttacccggctcgagaacctgatgtggaaacagataactcccgagttaaatcacattctgtccgaaaacgaggtgaagctaaccatcatgacaggggacattaaaggaatcatgcaggccggcaagcgctctctcagacctcaaccaacggaactgaaatattcgtggaagacctgggggaaggctaaaatgcttccgactgagagccataatcagacattcttgatagatggacccgaaaccgccgagtgccctaacgcaaatagggcgtggaactccctggaggtggaagactacggctttggtgtattcacaactaatatctggctcaagctgcgtgagaaacaggacgtcttttgtgattcaaagttaatgagtgctgccattaaagacaaccgggcagtgcacgccgatatggggtattggatcgaatctgctctgaatgacacctggaagatggagaaggccagcttcattgaggttaaatcctgccactggccaaagtcacatacgctttggagcaacggagtgttggaatctgagatgatcatacccaaaaacttcgcaggccctgtctcccagcacaattaccgaccaggttatcatacacaaaccgctggcccctggcacctcgggaagctggaaatggattttgacttctgtgagggaactaccgtggttgtgacagaagattgcggcaacagagggccgagtctaaggactaccacagccagcggaaaactgattacggagtggtgctgtcgctcttgcaccctccctccactgcggtacagaggcgaggacggttgttggtacgggatggaaatcaggccccttaaggagaaggaagagaatttggtaaactccctggtcactgcgggacatggccagatcgataatttttcattaggtgtgctcggcatggccctgttccttgaagagatgctgcgcacacgagtggggaccaaacacgctattttgctcgtcgcagttagttttgtgactctgatcacaggaaacatgagcttccgggacctaggccgtgtaatggtgatggtcggggccaccatgacggatgacattggaatgggcgtgacttatctggctctcctggccgcatttaaggttagacctaccttcgcggccggtcttttgctgaggaaattaacatcgaaggagctcatgatggctaccataggggtggccctgctttcccagtctactatccccgaaacaattctggagctaaccgatgcactcgctctgggaatgatggccttgaaaatcgtcaagaatatggaaaagtaccaactggcagtgacaattatggccatcagctgcgttccaaacgctgtgatattacagaatgcgtggaaagtctcatgtactatcctcgccgcagtaagtgtgtcccctctgcttctgacctctagccagcagaaggctgactggattcccttggccctcacgatcaaaggcctgaacccaacagccatttttctaaccactctgtcccgcacctcaaagaaacggagctggccgcttaatgaggctgttatggcagtgggcatggtcagtatcctcgcctcttccctgttgaagaacgacatacctatgacagggcccctggtggcgggaggtttactcactgtatgctatgtgctgaccggcagaagcgctgatcttgaactggagagggccgcagacgtcaaatgggaggatcaagccgaaatttcggggtcatctccaatcttgagtatcacgatttccgaggacggaagcatgtctataaagaatgaagaggaggaacagacactcaccatcctgattcgaactggcctactggttatcagcggtgtgttccccgtgtccattcctatcacagctgcagcctggtacctttgggaggtcaagaaacagcgcgcgggggtgctctgggatgttccatcaccccctccggtagaaaaggctgagctggaagacggagcctatcggataaaacagagaggcatcttgggctacagtcaaattggggcaggagtgtataaggagggtacctttcacactatgtggcatgtcacaaggggcgccgtgttaatgcaccgtgggaaacgcatcgagccaagctgggctgatgttaagaaggacctggtgtcttacggaggcggttggaaactcgaaggggagtggaaggaaggagaggaagtccaggtgctggcccttgagcccggcaaaaaccctcgggcagtacagaccaagccaggcattttcaaaacgaatactgggaccatcggagctgtctccctggatttttcacccggtacaagtggcagccctatagtggacagaaaggggaaggttgtgggattgtacggcaacggtgtcgtgaccaggtccggggcctatgtttctgcgattgcccagacagagaaatcgatcgaagataacccggagatcgaagacgatattttccgaaagaaacggctaactatcatggacctgcatcccggagcaggcaagaccaaacgctacctcccagctatagtgagagaggccattaagaggggcctgcggacgcttatcttagctcctacacgagtcgtggcagccgaaatggaggaggccctgagagggctccccattcgctatcaaactccagctatcagggcggaacacaccggacgtgagatagtagacttgatgtgtcatgcaacattcaccatgcggctgctcagccctgtgagagttcccaattacaacctgattatcatggatgaagcccactttactgacccagcttcaatcgccgcaaggggttatatttccacccgcgtcgagatgggcgaggccgctgggatcttcatgacagcgacgccgcctggaagtcgagatccctttccacagtctaatgcccccattatggacgaagagagagaaatacctgagcggagctggaactccggccacgaatgggtgactgatttcaagggtaaaaccgtgtggtttgtcccatcaatcaaggcagggaatgacattgctgcctgccttaggaaaaacggaaagaaagtaatccagctgtctcgcaagacattcgatagcgagtacgtgaagacccgtagtaatgactgggattttgttgtgactacagacatctccgagatgggcgcaaacttcaaagccgaaagagtcattgatccccggaggtgtatgaagcctgtgatattgaccgacggcgaggaacgcgttatcctagctgggccgatgccagtgacgcatagctctgccgcgcaacgaagaggacggattggtaggaatcccaaaaacgagaatgaccagtatatctacatgggcgaacctctggagaacgatgaggactgcgcacactggaaggaagccaaaatgctcttagataatattaacactcccgaggggatcataccatcaatgtttgaacctgagcgcgaaaaggtcgacgctatcgatggagagtacagactgaggggcgaggcccggaaaacattcgtggaccttatgcgtcgcggtgatctgcccgtatggctcgcttataaggtggcagccgaagggattaattacgctgaccgaagatggtgttttgatggcatcaagaacaaccagattttggaggaaaatgttgaggtcgagatctggaccaaagaaggagagaggaagaaactgaagccacggtggctcgacgcccgcatatattccgatcctctggcacttaaagaattcaaggagttcgcggccggcagaaagagtctaaccctgaacttgattactgaaatggggaggttaccgacatttatgacccagaaagctcggaatgccctggacaacctcgcagtgctgcatacagctgaggccggaggtaaggcatacaatcacgcccttagcgagctgcccgaaactctcgagacgttgctgctactgaccctccttgctacagtgactggcgggatcttcctgtttttaatgtcgggaaaaggcattggtaagatgaccttggggatgtgctgcatcataacagcgtctatcctgctctggtatgcccaaattcagccacactggatcgcagcttccattatcctggaattctttcttatagtcctgctcattcctgagcccgaaaaacagcgaaccccacaggataaccaattgacttacgttgtgatcgccatcctgacggtagtggccgcaaccatggctaatgagatgggcttcttagagaagacaaagaaagacctaggactgggcagcattactacccaggaatcagagagtaacatcctcgacatagatcttagacctgcctctgcgtggacactgtatgctgtcgccaccacttttgtgacacccatgttgcgccattccattgaaaatagctcagttaacgtgagtctgacggcaatcgccaatcaggctaccgtcctcatggggctgggaaagggttggccgcttagcaaaatggacattggcgtaccactcctggcaatcgggtgttactcccaggtgaaccctataactttgacagccgcgctgttactactggttgctcactacgccatcattggacccggcctccaagcaaaggccaccagggaggctcagaaacgggccgcagctggtatcatgaagaatccaaccgtggatgggattacagtcatcgaccttgaacccattccttatgatccgaagttcgagaaacagctgggccaggtgatgttgctgatcctctgcgtcactcaagtgctgatgatgcgtacgacctgggccctttgtgaggcgttaacactggccactggacccatatctaccctctgggaaggcaacccagggagattttggaatacaaccattgcagttagcatggctaacatcttcaggggatcctacttggccggcgcaggtctgctattttcaatcatgaagaatactacgaacacacgccgggggaccggaaacattggcgagactctgggtgaaaaatggaagtctcgactcaatgctcttggcaaaagtgagttccagatatataagaaatcggggatccaggaggtggacagaaccctggccaaggaaggaattaagaggggcgagacagatcatcacgccgtaagccgcgggtccgcgaaattgcggtggtttgtggaaagaaacatggtcactcctgagggaaaggttgtggacctgggctgcggtcgtgggggatggtcttactattgtggcggtctcaaaaatgtcagggaagtgaagggcctgacccgggggggacccggccatgaggagcctatcccaatgtcaacatacgggtggaacttagtacgccttcaaagcggagtggatgttttcttcacgccccctgaaaaatgcgacaccctgctctgtgatattggcgagtccagtccaaatcccactatcgaagctggtcgaacactaagagtgctgaacttggtcgagaattggctgaacaataacacccagttttgcataaaggtgctcaatccgtatatgccttctgtcatcgaaaagatggagactcttcagaggaaatacgggggagcactggtgcggaacccattgagccgcaattcaacacacgagatgtactgggtttccaacgccaccggcaatattgtaagtagcgtgaacatgatctctagaatgctgattaacaggttcacgatgaagcacaaaaaggctacctatgaacccgacgtcgatctcggctccgggacacgaaatatcggaatagagtcagaaattcctaacttagacatcatcggtaaacggattgagaagataaagcaggaacatgagactagctggcactacgaccaagatcatccatataaaacctgggcctaccacggctcgtatgagacaaagcagactgggtctgcaagttccatggtgaatggagttgtgcgtctgcttaccaaaccctgggacgtcgtgccgatggtaacacagatggccatgaccgatactacgccttttggccagcaaagagtgttcaaggaaaaagttgacacacgcacccaggagcccaaggaaggtactaagaaactgatgaagatcaccgctgagtggctatggaaagagctcgggaagaaaaagacaccaaggatgtgtacgcgggaagagtttaccagaaaagtccgcagcaacgcggccctgggagcaattttcactgatgaaaataagtggaagtcagctagggaggccgtggaagacggccgattttgggagttggtggatcgggagagaaacctgcacctcgaaggcaaatgcgagacatgtgtctacaatatgatggggaagagggaaaaaaagcttggagagttcggtaaagcaaagggctcccgcgccatctggtatatgtggctgggggctcgttttttagaattcgaggccctgggatttttgaacgaggaccattggttctctcggggcaatagcctcagtggtgttgaaggggagggactgcacagactaggctacattcttagggatgtgtccaagaaagaaggcggggcgatgtacgcagacgataccgccggatgggacactcgcatcacactggaggacctcaagaacgaagagatggtaaccaatcatatgaaaggtgagcacaagaaactggctgaagccatatttaagttgacatatcagaacaaggtggtccgagtgcagcggcctactcccagaggcaccgttatggatatcattagcaggcgcgaccaaagagggtctggacaggtgggcacgtacggtctgaataccttcacaaacatggaggcacagctcatccggcaaatggaaggggagggaattttcaaatcaatccagcatcttactgtcaccgaggaaattgctgtgcagaattggctggccagggtaggccgtgagcgattaacacgcatggctataagtggcgatgactgcgttgtgaagccaatcgatgacagatttgccaacgcactgactgcgttgaacgatatggggaaagtccggaaggacattcagcaatgggaaccctccaggggatggaatgattggacccaggtgcctttctgcagccaccactttcatgagctcgtgatgaaagacggtcgcgtcctggttgtgccatgtagaaaccaggatgaactaatcggccgggccaggatctctcagggggctggatggtcgcttaaggagacggcctgcctgggcaagtcatatgcacaaatgtggacactcatgtacttccaccgacgtgacctgagattggctgccaatgcaatttgtagcgccgtaccgtcccattgggtgcccaccagtcgcactacatggtctatacacgcgaaacacgagtggatgaccactgaagatatgttagctgtctggaaccgggtgtggatccaggagaatccttggatggaagacaagaccccagttgagagctgggaagaggtgccctatctgggtaaaagggaggaccagtggtgcgggtccctcattggacttacatcaagagccacgtgggcaaagaacatccagaccgccattaatcaagtccgcagtctgatcggcaacgaagagtacactgattatatgccttctatgaaacggtttaggcgagaagaggaagaggctggcgtgctatggtga

SEQ ID NO: 14370 - RNA, 9876 nt, synthetic construct
  misc_feature 1..9876: note = derived and/or modified CDS sequence (opt3) from DENV-2__FJ850082__SS-prME
  source 1..9876: mol_type = other RNA
accgtgggcgtcatcgttatgctgattcccacagccatggctttccacctcactacgagaaacggggagcctcatatgatagtgggaaggcaggaaaagggtaaaagccttctgtttaagaccgagaatggcgtaaacatgtgcacattgatggcaatcgacttaggggaactgtgtgaggatactattacctacaaatgcccactactccggcaaaatgaaccggaggacatcgattgttggtgcaactccacatctacctgggtgacttatggaacatgtaccacgactggcgagcaccgccgagaaaagcgttcagtcgccctggtgccccatgttggtatggggcttgagaccagaacagaaacttggatgagtagcgagggagcgtggaaacacgtgcagaggattgagacctggatcctgcggcatcctggcttcacaataatggctgccatcttggcatacaccattggcacgactcactttcagcgcgccctcatcttcattctgctgacagctgtcgcaccatccatgaccatgagatgcatcgggatatctaatagggactttgtggaaggagtatcgggtggctcatgggttgatattgtgctcgagcacgggagctgtgtcactacaatggccaagaacaagcccaccttagacttcgaactgatcaaaacggaggctaagcagcctgccacccttcggaaatattgcgtggaagcgaagttgacaaatactaccacagagagtcgctgtccaactcaaggagagccctccctgaacgaagagcaggataaacgatttatttgcaagcattctatggtggacagaggctggggtaatgggtgtggactattcggcaagggcgggatcgtcacctgcgcaatgtttacatgcaaaaagaacatggaaggaaaagttgtgcagcctgagaatctcgaatacaccatcgtaattactccacacagcggtgaggagcatgccgtgggcaacgatacggggaagcacggaaaagaaataaagatcacaccgcagtcctcaattaccgaggctgaactgactggctatggtaccgtcacaatggagtgtagtcccaggaccgggcttgacttcaatgaaatggtgctgttgcaaatggaggataaagcctggctcgttcaccggcagtggtttctggacttacctctgccatggctccccggcgcagatactcagggaagcaactggatccagaaggagacacttgtgacgttcaagaatcctcatgctaaaaagcaagacgtcgtggtactgggctctcaggaaggggccatgcacaccgcgttgactggagccacagagatacagatgtcctcaggtaacctactgtttaccggccatctcaaatgccgtctgcgcatggacaagcttcaactgaaagggatgagctacagtatgtgtacaggaaagttcaagattgttaaagaaatcgcagagactcagcacggcaccatcgtgattagagtccagtatgagggtgatgggtctccatgcaagatccccttcgaaattatggacttggagaaaaggcatgtgctcggccggctgataacggtcaacccgatcgtgaccgaaaaggattcccctgttaatattgaggctgaacccccatttggagacagctacatcatcattggcgtggagcctgggcagttaaaactgaactggttcaagaagggatcgtctataggtcaaatgtttgagacaactatgcgaggcgccaaacgcatggctatcctaggggataccgcctgggacttcggatccctcggcggtgtatttacatcaattgggaaggcactgcaccaggtcttcggcgccatctacggagctgcgtttagtggcgtgagctggactatgaaaattcttatcggggttataatcacctggattggaatgaattccagatctacgagcttgtcagtgagtctggtcctcgtgggcgtagtgacactgtatcttggtgcaatggttcaggccgattccgggtgtgtcgtgagctggaagaacaaagaactgaagtgcggatctggcatcttcattaccgacaatgtgcacacttggacagagcagtacaagtttcaacccgaatcaccaagtaaattggctagcgccatccagaaggcacatgaggaaggtatatgtggcattaggtccgtcacccggctcgagaacctgatgtggaaacagatcactcccgagttaaatcacattctgtctgaaaacgaggttaagctaaccatcatgacaggggatataaaaggaatcatgcaggccggcaagcgctcgctcagacctcaaccaacggaactgaaatatagctggaagacctgggggaaggctaaaatgctttccactgagtcacataatcagacattcttgattgacggaccggaaaccgccgagtgccccaacacaaatagggcatggaacagtctggaggtggaagattacggctttggtgtgttcactaccaatatctggctcaagctgcgtgagaaacaggacgtattttgtgactctaagttaatgagcgcggctgtcaaagataaccgggccgtgcacgcagacatggggtattggattgaatccgccctgaatgatacgtggaagatggagaaggcttcattcatcgaggttaaaagctgccactggcctaagtctcatacactttggtccaacggagtgttggaaagtgagatgataattccaaaaaacttcgccggccccgtcagccagcacaattaccgacctggttatcatacccaaactgcaggcccatggcacctcgggaagctggaaatggactttgatttctgtgagggaaccacagtggttgtgactgaagactgcggcaacagagggccctctctaaggaccacaacggcttccggaaaactgatcaccgagtggtgctgtcgctcatgcactctcccgcctctgcggtacagaggcgaggatggttgttggtacgggatggaaatcaggccacttaaggagaaggaagagaatttggtaaacagtctggtcacagccggacatggccagattgacaattttagcttaggtgtgctcggcatggcgctgttccttgaagagatgctgcgcacccgagtggggactaaacacgccatcttgctcgtcgctgtttcgtttgtgacactgattaccggaaacatgtccttccgggatctaggccgtgtaatggtgatggtcggggcaacgatgactgacgatataggaatgggcgtgacctatctggccctcctggctgcctttaaggttagacccacattcgcagcgggtcttttgctgaggaaattaacctctaaggagctcatgatggccactatcggggtggctctgcttagccagtcaacaattcctgaaaccatcctggagctaacagacgccctcgcactgggaatgatggctttgaaaattgtcaagaatatggaaaagtaccaactggccgtgactatcatggcaataagttgcgttcccaacgccgtgatcttacagaatgcttggaaagtctcctgtaccattctcgcggccgtatctgtgagcccactgcttctgacgtcctcacagcagaaggcagattggatccctttggctctcacaattaaaggcctgaaccccaccgccatctttctaactaccctgagccgcacaagtaagaaacggtcttggccacttaatgaggccataatggctgttggcatggtgtccattctcgcaagctcgctgttgaagaacgacatcccgatgactgggcctctggtcgccggaggtttactcaccgtgtgctatgtactgacgggcagatcagcggaccttgaactggagagggctgccgatgtgaaatgggaggaccaagcagaaatctctgggagttcccccattttgagcataacaatctctgaggatggaagcatgtccattaagaatgaagaggaggaacagaccctcactatcctgattcgaacaggcctactggtcatctcaggtgttttcccagtgagtatacccatcaccgccgctgcatggtacctttgggaggtgaagaaacagcgcgccggggtcctctgggacgtgcctagcccaccccctgttggaaaggcggaactggaggaaggcgcttatcggattaaacagagaggcatcttggggtactctcaaattggagccggtgtatataaggagggcacttttcacacaatgtggcatgtgaccaggggggcagtcttaatgcaccgtggaaaacgcatcgagccgtcctgggccgatgtgaagaaggacctggtttcatacggcggtgggtggaaactcgaaggagagtggaaggaaggcgaggaagtgcaggtcctggctcttgagccaggcaaaaacccccgggccgtgcagacgaagcctgggatattcaaaactaataccggaacaattggtgcagtaagtctggattttagcccaggcacctccgggtctcccatcgtcgacagaaagggaaaggtggttggcttgtacggtaacggggtggtcacaaggtcgggagcttatgtgagcgccatcgcgcagactgataaatcaattgaggacaaccctgaaatcgaggatgacatattccgaaagaaacggctaaccattatggatctgcatccgggcgccggcaagacgaaacgctacctccccgcaatcgttagagaagctattaagagggggctgcggacacttatcttagccccaactcgagtggtcgctgcagagatggaagaggccctgagaggactccctatacgctatcaaacccccgccattagggctgagcacacaggtcgtgaaatcgtggacttgatgtgtcatgcgaccttcactatgcggctgctctccccagtaagagtgcctaattacaacctgatcattatggacgaggcacactttaccgatcccgccagtatcgctgccaggggctatatttctacacgcgttgaaatgggggaggcagccggaatattcatgacggctactccaccgggcagccgagacccttttccccagtccaatgcgccaatcatggatgaggaaagagagattcccgaacggtcatggaactctggtcacgagtgggtcaccgacttcaaggggaaaacagtgtggtttgtgcctagcatcaaggccggaaatgatatcgcagcttgccttaggaaaaacggcaagaaagtcattcagctgagtcgcaagaccttcgactccgaatacgtaaagactcgtgccaatgattgggactttgtggttacaaccgatataagcgagatgggcgcaaacttcaaagccgagagagtgatcgacccacggaggtgtatgaagcccgtcattttgacggatggggaagagcgcgtgatcctagctggacctatgccggttactcattcttcagccgcgcaacgaagaggtcggattggcaggaatccaaaaaacgaaaatgaccagtatatctacatgggggagcccctggaaaacgacgaggattgcgcacactggaaggaggccaaaatgctcttagacaatataaacacacctgaaggaatcattccctccatgtttgagccagaacgcgagaaggtggatgctatcgacggcgaatacagactgaggggtgaggcccggaaaaccttcgtcgatcttatgcgtcgcggggacctgcctgtgtggctcgcttataaggtagcagccgagggcattaattacgctgatcgaagatggtgttttgacggaatcaagaacaaccagatattggaagagaatgtggaagttgagatttggaccaaagagggcgaaaggaagaaactgaagccccggtggctcgatgcccgcatctatagtgacccactggcacttaaagagttcaaggaattcgcggccgggagaaagagcctaactctgaacttgattacagagatgggaaggttacctacctttatgacacagaaagctcggaatgccctggataacctcgcagtcctgcatactgctgaagccggtggcaaggcatacaatcacgccctttcggagctgccggagacgctcgaaaccttgctgctactgacactccttgctactgtgaccgggggaatcttcctgtttttaatgtctggcaaaggtatagggaagatgacattgggcatgtgctgcatcattaccgcgtccatcctgctctggtatgcccaaattcagccccactggatcgcagctagcataattctggagttctttcttatcgtgctgctcatcccagaacctgagaaacagcgaactccccaggacaaccaattgacgtacgtcgttattgccatcctgaccgtggtagccgcaacaatggctaatgaaatgggattcttagagaagactaagaaagatctaggcctggggtcaataaccacacaggagagtgaatctaacattctcgacatcgaccttagaccagcctccgcgtggaccctgtatgctgtggccactacatttgtcacgcctatgttgcgccatagcattgagaattcaagtgtgaacgttagcctgaccgcaatcgccaatcaggctactgtgctcatgggactgggtaagggctggcccctttccaaaatggatataggggtcccgctcctggcaatcggatgttactctcaggtaaacccaattacattgaccgccgcgctgttactactggtggctcactacgccatcattggccctggtctccaagcaaaggccaccagggaagctcagaaacgggccgcagctgggatcatgaagaatcccacagttgacggcattactgtgatcgatcttgagccaataccctatgaccctaagttcgaaaaacagctgggacaggtcatgttgctgattctctgcgtgacgcaagtcctgatgatgcgtaccacatgggccctttgtgaggcgttaactctggccaccggcccgatcagcacactctgggaggggaaccccggaagattttggaataccactatcgcagtgtccatggctaacattttcaggggctcatacttggccggtgcagggctgctattttctataatgaagaatacgacaaacacccgccggggaactggcaacatcggtgaaaccctgggcgagaaatggaagagtcgactcaatgctcttgggaaatcggaattccagatttataagaaaagcggaatccaggaggttgatagaacactggccaaggagggcattaagaggggggaaactgaccatcacgccgtgtcccgcggatctgcgaaattgcggtggtttgtagagagaaacatggtgaccccagaaggcaaggtcgttgatctgggttgcgggcgtggaggctggtcatactattgtggtggcctcaaaaatgtgagggaggtcaaggggctgacaaaaggaggccctgggcatgaagagcccatccctatgagcacgtacggatggaacttagtgcggcttcaatccggcgtagacgtgttcttcaccccacccgagaagtgcgatactctgctctgtgacataggtgaaagttctcctaatccaacaatcgaggctgggcgcaccctacgagttctgaacttggtggaaaattggctgaacaataacactcagttttgcattaaggtcctcaatccctatatgccgagcgtgatcgagaaaatggaaacacttcagagaaagtacggaggcgcactggtcaggaaccctttgtcacggaattccacccacgagatgtactgggtgagtaacgccacgggcaatattgttagctctgtaaacatgatctcccgcatgctgataaacagattcaccatgaaacacaagaaagctacatatgagccagatgtggacctcgggtcaggaactaggaatattggtatcgaaagcgaggtccccaacttagatatcattggcaagcgaatagaaaagatcaaacaggagcatgaaacctcgtggcactacgaccaagaccatccttataagacatgggcctaccacgggtcttatgagactaaacagaccggaagtgcatccagcatggtgaatggcgttgtgcggctgcttacaaagccatgggatgtcgtgcccatggtaacccagatggccatgactgacacgacaccgtttggtcagcaacgtgtgttcaaagagaaggttgataccagaactcaggaacctaaggaggggaccaaaaagctgatgaaaattacagctgaatggctatggaaggagctcggaaaaaagaaaatcccccgcatgtgtacgagggaggaatttacccggaaggtcagatcaaacgcggccctgggcgcaattttcactgacgagaataagtggaaatccgctcgcgaagccgtggaggatggcaggttttgggaattggtggaccgagagcggaacctgcacctcgaggggaagtgcgaaacatgtgtctacaatatgatgggaaaaagagagaagaaacttggtgaattcggcaaggcaaaggggtctagggccatctggtatatgtggctgggagctcgctttttagagttcgaagccctgggctttttgaacgaggatcattggttcagccgtggtaatagtctctccggggttgagggagaaggcctgcaccggctaggctacatacttagagacgtgagcaaaaaggaggggggagcgatgtacgcagatgacaccgccggttgggatactaggatcacactggaagacctcaaaaacgaggaaatgattaccaatcatatgaagggcgagcacaaaaagctggctgaggccatctttaagttgacatatcagaacaaagtagtgcgcgtccagcgaccaactcctcgggggaccgtgatggacattatctctagaagggatcaacgcggatcaggccaggttggtacgtacgggctgaataccttcacaaacatggaagcacagctcattagacaaatggagggagaaggcatattcaagagtatccagcatcttactgtgaccgaggagattgctgtccagaattggctggcccgggtgggcagggaacgtttaacacgaatggctatctccggggacgattgcgtagttaaacccatcgacgatcgctttgccaacgcactgactgcgttgaacgacatgggaaaggtgagaaaagatattcagcaatgggagccaagccggggttggaatgactggacccaggtccccttctgctctcaccactttcatgaactcgtgatgaaggatggcagggtgctggtcgttccttgtcgcaaccaggacgagctaatagggagagcccggatctcgcagggagctggctggtcacttaaggaaacggcctgcctgggtaaaagctatgcacaaatgtggacactcatgtacttccacaggcgagatctgcgtttggctgccaatgcaatttgttccgccgtgccaagtcattgggtaccgacctctagaactacatggagcatccacgcgaagcacgagtggatgaccactgaggacatgttagctgtgtggaaccgcgtctggattcaggaaaatccctggatggaggataaaacccctgtggaatcctgggaggaagttccatatctggggaagcgggaggaccagtggtgcggatcactcatcggccttacaagtagggccacgtgggcaaaaaacatacagaccgccatcaatcaagtgagatctctgattggcaacgaggggtacactgactatatgcccagcatgaagcgctttcggagggaagaggaagaggctggagtcctatggtga

SEQ ID NO: 14371 - RNA, 9876 nt, synthetic construct
  misc_feature 1..9876: note = derived and/or modified CDS sequence (opt3) from DENV-2__FJ850085__SS-prME
  source 1..9876: mol_type = other RNA
accgtgggcgtcatcgttatgctgattcccacagccatggctttccacctcactacgaggaacggggagcctcatatgatagtgggaaggcaggaaaagggtaaaagccttctgtttaagaccgagaatggcgtcaacatgtgcacattgatggcaatcgacttaggggaactgtgtgaggatactattacctacaaatgcccactactccggcaaaatgaaccggaggacatcgattgttggtgcaactccacatctacctgggtgacttatggaacatgtaccacgactggcgagcaccgccgagaaaagcgttcagtcgccctggtgccccatgttggtatggggcttgagaccaggacagaaacttggatgagtagcgagggagcgtggaaacacgtgcagaggattgagacctggatcctgcggcatcctggcttcacaataatggctgccatcttggcatacaccattggcacgactcactttcagcgcgccctcatcttcattctgctgacagctgtcgcaccatccatgaccatgcggtgcatcgggatatctaatagggactttgtggaaggagtatcgggtggctcatgggttgatattgtgctcgagcacgggagctgtgtcactacaatggccaagaacaagcccaccttagacttcgaactgatcaaaacggaggctaagcagcctgccacccttcggaaatattgcgtggaagcgaagttgacaaatactaccacagagagtcgctgtccaactcaaggagagccctccctgaacgaggaacaggataaacgatttatttgcaagcattctatggtggacagaggctggggtaatgggtgtggactattcggcaagggcgggatcgtaacctgcgcaatgtttacatgcaaaaagaacatggaaggaaaagttgtgcagcctgagaatctcgaatacaccatcgtaattactccacacagcggtgaggagcatgccgtgggcaacgatacggggaagcacggaaaagaaataaagatcacaccgcagtcctcaattaccgaggctgaactgactggctatggtaccgtcacaatggagtgtagtcccaggaccgggcttgacttcaatgaaatggtgctgttgcaaatggaggataaagcctggctcgttcaccggcagtggtttctggacttacctctgccatggctccccggcgcagatactcagggaagcaactggatccagaaggagacacttgtgacgttcaagaatcctcatgctaaaaagcaagacgtcgtggtactgggctctcaggaaggggccatgcacaccgcgttgactggagccacagagatacagatgtcctcaggtaacctactgtttaccggccatctcaaatgccgtctgcgcatggacaaacttcaactgaaagggatgagctacagtatgtgtacaggaaagttcaagattgttaaagaaatcgcagagactcagcacggcaccatcgtgattagagtccagtatgagggtgatgggtctccatgcaagatccccttcgaaattatggacttggagaaaaggcatgtgctcggccggctgataacggtcaacccgatcgtggctgaaaaggattcccctgttaatattgaggccgaacccccatttggagacagctacatcatcattggcgtggagcctgggcagttaaaactgaactggttcaagaagggatcgtctataggtcaaatgtttgagaccacaatgcgaggcgctaaacgcatggccatcctaggggatactgcatgggacttcggatccctcggcggtgtatttacctcaattgggaaggccctgcaccaggtcttcggcgctatctacggagcggcatttagtggcgtgagctggacaatgaaaattcttatcggggttataatcacttggattggaatgaactccagatctaccagcttgtcagtgagtctggtcctcgtgggcgtagtgacgctgtatcttggtgccatggttcaggctgattccgggtgtgtcgtgagctggaagaacaaagaactgaagtgcggatctggcatcttcattacagacaatgtgcacacctggactgagcagtacaagtttcaacccgaatcaccaagtaaattggccagcgcaatccagaaggcccatgaggaaggtatatgtggcattaggtccgtcacacggctcgagaacctgatgtggaaacagatcacccccgagttaaatcacattctgtctgaaaacgaggttaagctaactatcatgaccggggatataaaaggaatcatgcaggctggcaagcgctcgctcagacctcaaccaacagaactgaaatatagctggaagacgtgggggaaggccaaaatgctttccaccgagtcacataatcagactttcttgattgacggaccggaaacagcagagtgccccaacaccaatagggcgtggaacagtctggaggtggaagattacggctttggtgtgttcacaactaatatctggctcaagctgcgtgagaaacaggacgtattttgtgactctaagttaatgagcgctgccgtcaaagataaccgggcagtgcacgccgacatggggtattggattgaatccgctctgaatgatacctggaagatggagaaggcctcattcatcgaggttaaaagctgccactggcctaagtctcatacgctttggtccaacggagtgttggaaagtgagatgataattcccaagaatttcgcaggccccgtcagccagcacaattaccgacctggttatcatacacaaaccgctggcccatggcacctcgggaagctggaaatggactttgatttctgtgagggaactaccgtggttgtgacagaagactgcggcaacagagggccctctctaaggactaccacagcctccggaaaactgatcacggagtggtgctgtcgctcatgcaccctcccgcctctgcggtacagaggcgaggatggttgttggtacgggatggaaatcaggccacttaaggagaaggaagagaatttggtaaacagtctggtcactgcgggacatggccagattgacaattttagcttaggtgtgctcggcatggccctgttccttgaagagatgctgcgcacacgagtggggaccaaacacgctatcttgctcgtcgcagtttcgtttgtgactctgattacaggaaacatgtccttccgggatctaggccgtgtaatggtgatggtcggggccaccatgacggacgatataggaatgggcgtgacttatctggctctcctggccgcatttaaggttagacccaccttcgcggccggtcttttgctgaggaaattaacatctaaggagctcatgatggctaccatcggggtggccctgcttagccagtcaactattcctgaaacaatcctggagctaaccgacgcactcgctctgggaatgatggccttgaaaattgtcaagaatatggaaaagtaccaactggcagtgacaatcatggccataagttgcgttcccaacgctgtgatcttacagaatgcgtggaaagtctcctgtactattctcgccgcagtatctgtgagcccactgcttctgacctcctcacagcagaaggctgattggatccctttggccctcacgattaaaggcctgaaccccacagccatctttctaaccactctgagccgcaccagtaagaaacggtcttggccacttaatgaggctataatggcagttggcatggtgtccattctcgccagctcgctgttgaagaacgacatcccgatgacagggcctctggtcgcgggaggtttactcactgtgtgctatgtactgaccggcagatcagctgaccttgaactggagagggccgcagatgtgaaatgggaggaccaagccgaaatctctgggagttcccccattttgagcataacgatctctgaggatggaagcatgtccattaagaatgaagaggaggaacagacactcaccatcctgattcgaactggcctactggtcatctcaggtgttttcccagtgagtatacccatcacagctgcagcctggtacctttgggaggtgaagaaacagcgcgcgggggtcctctgggacgtgcctagcccaccccctgttggaaaggctgaactggaggaaggcgcctatcggattaaacagagaggcatcttggggtactctcaaattggagctggtgtatataaggagggcacctttcacactatgtggcatgtgacaagaggggcagtcttaatgcaccgtggaaaacgcatcgagccgtcctgggcagatgtgaagaaggacctggtttcatacggcggtgggtggaaactcgaaggagagtggaaggaaggcgaggaagtgcaggtcctggcccttgagccaggcaaaaacccccgggcagtgcagaccaagcctgggatattcaaaacgaatactggaaccattggtgctgtaagtctggattttagcccaggcacatccgggtctcccatcgtcgacagaaagggaaaggtggttggcttgtacggtaacggggtggtcaccaggtcgggagcctatgtgagcgcgatcgcccagacagataaatcaattgaggacaaccctgaaatcgaggatgacatattccgaaagaaacggctaactattatggatctgcatccgggcgcaggcaagaccaaacgctacctccccgctatcgttagagaagccattaagagggggctgcggacgcttatcttagctccaacacgagtggtcgcagccgagatggaagaggccctgagaggactccctatacgctatcaaactcccgctattagggcggagcacaccggtcgtgaaatcgtggacttgatgtgtcatgcaacattcaccatgcggctgctctccccagtaagagtgcctaattacaacctgatcattatggacgaggcccactttactgatcccgctagtatcgccgcaaggggctatatttctacccgcgttgaaatgggggaggccgctggaatattcatgacagcgacgccaccgggcagccgagacccttttccccagtccaatgccccaatcatggatgaggaaagagagattcccgaacggtcatggaactctggtcacgagtgggtcactgacttcaaggggaaaaccgtgtggtttgtgcctagcatcaaggcaggaaatgatatcgctgcctgccttaggaaaaacggcaagaaagtcattcagctgagtcgcaagacattcgactccgaatacgtaaagacccgtgcaaatgattgggactttgtggttactacagatataagcgagatgggcgccaacttcaaagctgagagagtgatcgacccacggaggtgtatgaagcccgtcattttgaccgatggggaggaacgcgtgatcctagccggacctatgccggttacgcattcttcagcggcacaacgaagaggtcggattggcaggaatcccaaaaacgaaaatgaccagtatatctacatgggggagcccctggaaaacgacgaggattgcgcccactggaaggaggctaaaatgctcttagacaatataaacactcctgaaggaatcattccctccatgtttgagccagaacgcgagaaggtggatgccatcgacggcgaatacagactgaggggtgaggctcggaaaacattcgtcgatcttatgcgtcgcggggacctgcctgtgtggctcgcatataaggtagccgctgagggcattaattacgccgatcgaagatggtgttttgacggaatcaagaacaaccagatattggaagagaatgtggaagttgagatttggaccaaagagggcgaaaggaagaaactgaagccccggtggctcgatgcacgcatctatagtgacccactggcgcttaaagagttcaaggagttcgccgctgggagaaagagcctaaccctgaacttgattactgagatgggaaggttacctacatttatgacccagaaagcccggaatgcactggataacctcgctgtcctgcatacagccgaagccggtggaaaggcatacaatcacgctctttcggagctgccggagactctcgaaacgttgctgctactgaccctccttgcgacagtgactgggggaatcttcctgtttttaatgtctggcaaaggtatagggaagatgaccttgggcatgtgctgcatcattacagcctccatcctgctctggtatgcacaaattcagccccactggatcgctgccagcataattctggagttctttcttatcgtgctgctcatcccagaacctgagaaacagcgaaccccacaggacaaccaattgacttacgtcgttattgccatcctgacggtggtagcagctaccatggccaatgaaatgggattcttagagaagacaaagaaagatctaggcctggggtcaataactacccaggagagtgaatctaacattctcgacatcgaccttagaccagcgtccgcttggacactgtatgccgtggcaaccacttttgtcacacctatgttgcgccatagcattgaaaattcaagtgtgaacgttagcctgacggccatcgctaatcaggcaaccgtgctcatgggactgggtaagggctggcccctttccaaaatggatataggggtcccgctcctggccatcggatgttactctcaggtaaacccaattactttgacagcggctctgttactactggtggcccactacgcaatcattggccctggtctccaagccaaggctaccagggaagcccagaaacgggcagctgccgggatcatgaagaatcccaccgttgacggcattacagtgatcgatcttgagccaataccctatgaccctaagttcgaaaaacagctgggacaggtcatgttgctgattctctgcgtgactcaagtcctgatgatgcgtacgacctgggcgctttgtgaggccttaacactggcaactggcccgatcagcaccctctgggaggggaaccccggaagattttggaatacaaccatcgctgtgtccatggccaacattttcaggggctcatacttggccggtgctgggctgctattttctataatgaagaatactacgaacacacgccggggaaccggcaacatcggtgaaactctgggcgagaaatggaagagtcgactcaatgcccttgggaaatcggagttccagatttataagaaaagcggaatccaggaggttgatagaaccctggccaaggagggcattaagagaggggaaacagaccatcacgcggtgtcccgcggatctgctaaattgcggtggtttgtagagagaaacatggtgactccagaaggcaaggtcgttgatctgggttgcgggcgtggaggctggtcatactattgtggtggcctcaaaaatgtgagggaggtcaaggggctgaccaaaggaggccctgggcatgaagaaccaatccctatgagcacatacggatggaacttagtgcggcttcaatccggcgtagacgtgttcttcacgccacccgagaagtgcgataccctgctctgtgacataggtgaaagttctcctaatccaactatcgaggcagggcgcacactacgagttctgaacttggtggaaaattggctgaacaataacacccagttttgcattaaggtcctcaatccctatatgccgagcgtgatcgagaaaatggaaactcttcagagaaagtacggaggcgccctggtcaggaaccctttgtcaagaaattccacacacgagatgtactgggtgagtaacgctaccggcaatattgttagctctgtaaacatgatctcccgcatgctgataaacagattcacgatgaaacacaagaaagccacctatgagccagatgtggacctcgggtcaggaacaaggaatattggtatcgaaagcgaggtccccaacttagatatcattggcaagcgaatagaaaagatcaaacaggagcatgaaacttcgtggcactacgaccaagaccatccttataagacctgggcataccacgggtcttatgagacaaaacagactggaagtgcctccagcatggtgaatggcgttgtgcggctgcttaccaagccatgggatgtcgtgcccatggtaacacagatggctatgaccgacactacgccgtttggtcagcaacgtgtgttcaaagagaaggttgatacaagaacccaggaacctaaggaggggactaaaaagctgatgaaaattaccgcggaatggctatggaaggagctcggcaaaaagaaaatcccccgcatgtgtacaagggaggaatttacgcggaaggtcagatcaaacgccgcactgggcgctattttcaccgacgagaataagtggaaatccgcccgcgaagcagtggaggatggcaggttttgggaattggtggaccgagagcggaacctgcacctcgaggggaagtgcgaaacttgtgtctacaatatgatgggaaaaagagagaagaaacttggtgagttcggcaaggccaaggggtctagggctatctggtatatgtggctgggagcccgctttttagagttcgaagcgctgggctttttgaacgaggatcattggttcagccgtggtaatagtctctccggggttgagggagaaggcctgcaccggctaggctacatacttagagacgtgagcaaaaaggaagggggagcaatgtacgccgatgacacagctggttgggataccaggatcactctggaagacctcaaaaacgaggaaatgattacaaatcatatgaagggcgagcacaaaaagctggccgaggcaatctttaagttgacctatcagaacaaagtagtgcgcgtccagcgaccaacacctcgggggactgtgatggacattatctctagaagggatcaacgcggatcaggccaggttggtacctacgggctgaatacgttcaccaacatggaagctcagctcattagacaaatggagggagaaggcatattcaagagtatccagcatcttacagtgactgaggagattgccgtccagaattggctggctcgggtgggcagggaacgtttaacccgaatggccatctccggggacgattgcgtagttaaacccatcgacgatcgctttgcaaacgcgctgacagccttgaacgacatgggaaaggtgagaaaagatattcagcaatgggagccaagccggggttggaatgactggactcaggtccccttctgctctcaccactttcatgaactcgtgatgaaggatggcagggtgctggtcgttccttgtcgcaaccaggacgagctaatagggagagctcggatctcgcagggagccggctggtcacttaaggaaaccgcatgcctgggtaaaagctatgctcaaatgtggacgctcatgtacttccacaggcgagatctgcgtttggccgcaaatgccatttgttccgcggtgccaagtcattgggtaccgacatctagaaccacttggagcatccacgctaagcacgagtggatgacaaccgaggacatgttagccgtgtggaaccgcgtctggattcaggaaaatccctggatggaggataaaactcctgtggaatcctgggaggaagttccatatctggggaagcgggaggaccagtggtgcggatcactcatcggccttaccagtagggcaacatgggccaaaaacatacagacggctatcaatcaagtgagatctctgattggcaacgaggggtacaccgactatatgcccagcatgaagcgctttcggagggaagaggaagaggccggagtcctatggtga

SEQ ID NO: 14372 - RNA, 9876 nt, synthetic construct
  misc_feature 1..9876: note = derived and/or modified CDS sequence (opt3) from DENV-2__FJ850088__SS-prME
  source 1..9876: mol_type = other RNA
accgccggcgtgatcgtcatgctgattcccacagttatggctttccacctcactacgagaaacggggagcctcatatgatagtgggaaggcaggaaaagggtaaaagccttctgtttaagaccgaggacggcgtaaatatgtgcacattgatggcaatcgatttaggggaactgtgtgaggacactattacctacaaatgcccactactccggcaaaacgaaccggaggatatcgactgttggtgcaattccacatctacctgggtgacttatggaacatgtaccacgactggcgagcaccgccgagaaaagcgttcagtcgccctggtgccccatgttggtatggggcttgagaccagaacagaaacttggatgagtagcgagggagcgtggaaacacgtgcagaggattgagacctggatcctgcggcatcctggcttcacaatgatggctgccatattggcatacaccatcggcacgactcactttcagcgcgccctcattttcatcctgctgacagctgtcgcaccatccatgaccatgagatgcattgggatctctaacagggattttgtggaaggagtatcgggtggctcatgggttgacatagtgctcgagcacgggagctgtgtcactacaatggccaagaataagcccaccttagatttcgaactgattaaaacggaggctaagcagcctgccacccttcggaaatattgcgtggaagcgaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgcaatgtttacatgcaaaaagaatatggaaggaaaagttgtgcagcctgagaacctcgaatacaccatcgtaatcactccacacagcggtgaggagcatgccgtgggcaatgacacggggaagcacggaaaagaagtcaagattacaccgcagtcctcaataaccgaggctgaactgactggctatggtaccgtgacaatggagtgtagtcccaggaccgggcttgatttcaacgaaatggttctgttgcaaatggaggacaaagcctggctcgtgcaccggcagtggtttctggatttacctctgccatggctccccggcgcagacactcagggaagcaattggatccagaaggagacacttgtcacgttcaagaaccctcatgctaaaaagcaagacgtggtagttctgggctctcaggaaggggccatgcacaccgcgttgactggagccacagagattcagatgtcctcaggtaatctactgtttaccggccatctcaaatgccgtctgcgcatggataagcttcaactgaaagggatgagctacagtatgtgtacaggaaagttcaagatcgtgaaagaaatagcagagactcagcacggcaccattgtcatcagagtgcagtatgagggtgacgggtctccatgcaagatccccttcgaaattatggatttggagaaaaggcatgtcctcggccggctgatcacggtgaacccgattgttaccgaaaaggactcccctgtgaacatagaggctgaacccccatttggagatagctacatcattgtaggcgtcgagcctgggcagttaaaactgaattggttcaagaagggatcgtctatcggtcaaatgtttgagacaactatgcgaggcgccaaacgcatggctatcctaggggacaccgcctgggatttcggatccctcggcggtgtgtttacatcaattgggaaggcactgcaccaggttttcggcgccatatacggagctgcgtttaacggcgtgagttggactatgaaaatccttattggggtcatcattacctggatcggaatgaatagcagatccacgtctttgagcgtgtcactggtactcgtgggcgttgtcacactgtatcttggtgcaatggtgcaggccgacagtgggtgtgtggtctcctggaagaacaaagaactgaagtgcggaagcggcatattcatcaccgataatgttcacacttggacagagcagtacaagtttcaacccgaatctccatcaaaattggctagtgccattcagaaggcacatgaggaaggtatctgtggcattaggagcgtgacccggctcgagaacctgatgtggaaacagatcactcccgagttaaatcacatactgtccgaaaacgaggtgaagctaaccattatgacaggggacatcaaaggaattatgcaggccggcaagcgctctctcagacctcaaccaacggaactgaaatattcgtggaagacctgggggaaggctaaaatgcttccgactgagagccataatcagacattcttgatcgatggacccgaaaccgccgagtgccctaacgcaaatagggcgtggaactccctggaggtagaagactacggctttggtgtcttcacaactaatatatggctcaagctgcgtgagaaacaggacgtgttttgtgattcaaagttaatgagtgctgccatcaaagacaaccgggcagttcacgccgatatggggtattggattgaatctgctctgaatgacacctggaagatggagaaggccagcttcatcgaggtgaaatcctgccactggccaaagtcacatacgctttggagcaacggagtcttggaatctgagatgattatccccaaaaacttcgcaggccctgtgtcccagcacaattaccgaccaggttatcatacacaaaccgctggcccctggcacctcgggaagctggaaatggattttgacttctgtgagggaactaccgttgtggtaacagaagattgcggcaacagagggccgagtctaaggactaccacagccagcggaaaactgataacggagtggtgctgtcgctcttgcaccctccctccactgcggtacagaggcgaggacggttgttggtacgggatggaaattaggccccttaaggagaaggaagagaatttggtcaactccctggtgactgcgggacatggccagatcgataatttttcattaggtgtgctcggcatggccctgttccttgaagagatgctgcgcacacgagtcgggaccaaacacgctatcttgctcgttgcagtgagtctggtaactctaattacaggaaacatgagctttcgggacctgggccgtgtgatggtcatggtgggggccaccatgacggatgacatcggaatgggcgttacttatctcgctctgcttgccgcattcaaggtgagacctacctttgcggccggtttgctgttaaggaaactcacatcgaaggagctgatgatggctaccattggggtcgcccttctgtcccagtctactatacccgaaacaatcctagagctcaccgatgcactggctttgggaatgatggccctgaaagtggttaagaatatggaaaagtaccaattagcagtgacaattatggccatcagctgcgtcccaaacgctgtaattctccagaatgcgtggaaagtgtcatgtactatcctggccgcagttagtgtgtcccctcttctgttgacctctagccagcagaaggctgactggatacccctcgccctgacgatcaaaggcctaaacccaacagccattttcctgaccactctttcccgcacctcaaagaaacggagctggccgctcaatgaggctgtcatggcagtgggcatggtaagtatcctggcctcttccttgctgaagaacgacattcctatgacagggcccttagtggcgggaggtctcctgactgtctgctatgttcttaccggcagaagcgctgatctggaattggagagggccgcagacgtgaaatgggaggatcaagccgaaatctcggggtcatctccaatactcagtattacgatctccgaggacggaagcatgtctatcaagaatgaagaggaggaacagacactgaccattctaatacgaactggcctgcttgtgatcagcggtgtctttcccgtgtccattcctatcacagctgcagcctggtacctctgggaggttaagaaacagcgcgcgggggtactgtgggatgtgccatcaccccctccggtcgaaaaggctgagttggaagacggagcctatcggattaaacagagaggcatcttaggctacagtcaaataggggcaggagtgtataaggagggtaccttccacactatgtggcatgttacaaggggcgccgtgctgatgcaccgtgggaaacgcatcgagccaagctgggctgatgtcaagaaggacctcgtgtcttacggaggcggttggaaactggaaggggagtggaaggaaggagaggaagtacaggtccttgccctggagcccggcaaaaaccctcgggcagtgcagaccaagccaggcatttttaaaacgaatactgggaccatcggagctgtttccttggatttctcacccggtacaagtggcagccctattgtggacagaaaggggaaggtcgtgggactatacggcaacggtgttgtgaccaggtccggggcctatgtctctgcgatcgcccagacagagaaatcgatagaagataacccggagattgaagacgatatctttcgaaagaaacggctgactatcatggacctccatcccggagcaggcaagaccaaacgctacctgccagctattgtgagagaggccatcaagaggggccttcggacgttaatactggctcctacacgagtagtggcagccgaaatggaggaggccctcagagggttgcccattcgctatcaaactccagctatcagggcggaacacaccggacgtgagattgttgacctgatgtgtcatgcaacattcaccatgcggctcctgagccctgtcagagtgcccaattacaaccttatcataatggatgaagcccacttcactgacccagcttcaattgccgcaaggggttatatctccacccgcgtggagatgggcgaggccgctgggatctttatgacagcgacgccgcctggaagtcgagatcccttcccacagtctaatgcccccattatggacgaagagagagaaatccctgagcggagctggaactccggccacgaatgggtcactgattttaagggtaaaaccgtatggttcgtgccatcaattaaggcagggaatgacatagctgcctgcctgaggaaaaacggaaagaaagttatccagttgtctcgcaagacatttgatagcgagtacgtgaagacccgtagtaatgactgggatttcgtcgtgactacagacatttccgagatgggcgcaaactttaaagccgaaagagttatcgatccccggaggtgtatgaagcctgtgatcctaaccgacggcgaggaacgcgtcattctggctgggccgatgccagtgacgcatagctctgccgcgcaacgaagaggacggataggtaggaatcccaaaaacgagaatgaccagtatatctacatgggcgaacctctcgagaacgatgaggactgcgcacactggaaggaagccaaaatgttactggataatattaacactcccgaggggatcattccatcaatgttcgaacctgagcgcgaaaaggtagacgctatcgatggagagtacagacttaggggcgaggcccggaaaacatttgtggacctgatgcgtcgcggtgatctccccgtttggttggcttataaggtcgcagccgaagggataaattacgctgaccgaagatggtgtttcgatggcatcaagaacaaccagattctggaggaaaatgtggaggtggagatctggaccaaagaaggagagaggaagaaactcaagccacggtggctggacgcccgcatttattccgatcctcttgcactaaaagaatttaaggagttcgcggccggcagaaagagtctgaccttgaacttaatcactgaaatggggaggctgccgacattcatgacccagaaagctcggaatgccctcgacaacctggcagtccttcatacagctgaggccggaggtaaggcatacaatcacgccctgagcgagctccccgaaactttggagacgctgctactgctcgctcttctggcgaccgttacaggcgggatatttttattcttgatgtcgggaaaaggcattggtaagatgactctggggatgtgctgcatcattaccgcctctatcctcctgtggtatgcacaaatacagccacactggatcgctgcctccattatccttgaatttttcctgattgtgctcttgatccctgagcccgaaaaacagcgaacaccacaggataaccaactgacctacgtagtgatagccattttaactgtcgtggcagctacgatggccaatgagatgggctttctagagaagaccaagaaagacctgggactcggcagcatcacaactcaggaatcagagagtaacatccttgacattgatctgagacctgcgtctgcttggaccttgtatgccgttgcaacaaccttcgtgactcccatgctgcgccattccatcgaaaatagctcagtcaacgtaagtctcacagccatagctaatcaggcaacggtgctgatggggcttggaaagggttggccgctcagcaaaatggacattggcgttccactgttggccatcgggtgttactcccaggtgaaccctattaccctgactgcggctttactactgctcgtcgcccactacgcaatcataggacccggccttcaagccaaggctacaagggaggcccagaaacgggcagctgccggtatcatgaagaatccaaccgtggatgggattaccgtcatcgacctggaacccattccttatgatccgaagtttgagaaacagttgggccaggtgatgctgctcatcctgtgcgttacacaagtgcttatgatgcgtactacgtgggcgttatgtgaggccctgaccctcgcaacaggacccatttctactttgtgggaaggcaacccagggagattctggaataccacaatcgctgtaagcatggccaacatatttaggggatcctacctggcaggcgctggtctactgttctcagtgatgaagaataccactaacacgcgccgggggacaggaaacattggcgagaccctcggtgaaaaatggaagtctcgacttaatgccctgggcaaaagtgagtttcagatctataagaaatcggggatccaggaggtcgacagaactttggccaaggaaggaattaagaggggcgagaccgatcatcacgcggttagccgcgggtccgctaaactgcggtggttcgtggaaagaaacatggtcacacctgagggaaaggtggtagacctcggctgcggtcgtgggggatggtcttactattgtggcggtctgaaaaatgtgagggaagttaagggcttaactcgggggggacccggccatgaggagcctataccaatgtcaacctacgggtggaaccttgtgcgcctgcaaagcggagtcgatgtgtttttcacaccccctgaaaaatgcgacacgctcctatgtgatatcggcgagtccagtccaaatcccaccattgaagcaggtcgaactctgagagtcttgaacctggtggagaattggctcaacaataacacacagttctgcatcaaggttcttaatccgtatatgccttctgtaattgaaaagatggagaccctgcagaggacttacgggggagccttggtgcggaacccactgagccgcaattcaacacacgagatgtactgggtctccaacgctaccggcaatatcgtgagtagcgttaacatgatatctagaatgctcatcaacaggtttacgatgaaacacaagaaagccacctatgaacccgacgtggatttaggctccgggacacgaaatattggaatcgagtcagaaattcctaacctggacatcataggtaagcggattgagaaaatcaagcaggaacatgagactagctggcactacgaccaagatcatccatataagacctgggcataccacggctcgtatgagacaaaacagactgggtctgccagttccatggtcaatggagtggtacgtcttctgaccaagccctgggacgtggttccgatggtcacacagatggctatgaccgatactacgcctttcggccagcaaagagtgtttaaagaaaaggtggacacacgcacccaggagcccaaagaaggtactaagaagctaatgaaaatcaccgcggagtggctctggaaggagctggggaaaaagaaaacaccaaggatgtgtacgcgggaagagttcaccagaaaggtccgcagcaacgccgcattgggagctatttttactgatgaaaataaatggaagtcagccagggaggcagttgaagacggccgattctgggagctggtggatcgggagagaaacctccaccttgaaggcaagtgcgagacatgtgtatacaatatgatggggaaaagggaaaagaaactgggagagtttggtaaggccaaaggctcccgcgctatatggtatatgtggttaggggcccgtttcctggaatttgaggcgttgggattcctcaacgaggaccattggttttctcggggcaatagcctgagtggtgtggaaggggagggactacacagacttggctacatcctgagggatgtctcccgcaaggaaggcggggcaatgtacgccgacgataccgctggatgggacactcgaattacactcgaggacctgaagaacgaagagatggtgaccaatcatatgaaaggtgagcacaagaaattggccgaagcaatcttcaagctgacatatcagaacaaagttgtgcgggtccagagacctactcccaggggcaccgtgatggatattatcagccgcagagaccaacgggggtctggacaggtaggcacgtacggtctcaatacctttacaaacatggaggctcagcttataaggcaaatggaaggggagggaatcttcaagtcaattcagcatctgactgttaccgaggaaatcgccgtgcagaattggttagctcgtgtcggccgagagcgcctgacaagaatggccattagtggcgatgactgcgtggtgaagccaatcgatgaccggttcgcaaacgcgttgactgccctcaacgatatggggaaagtcaggaaggacattcagcaatgggaaccctcccgcggatggaatgattggacccaggttcctttttgcagccaccacttccatgagctggtgatgaaagacggtagagtactagtggtcccatgtcggaaccaggatgaacttataggcagggctcgaatctctcagggggccggatggtcgctgaaggagacggcatgcctcggcaaatcatatgctcaaatgtggacactgatgtactttcaccgtagagacttgcgcttagccgcaaatgccatttgtagcgcggtgccgtcccattgggttcccaccagtcggactacatggtctatccacgctaagcacgagtggatgaccactgaagatatgctggccgtgtggaacagggtctggatccaggagaatccttggatggaagacaagaccccagtggagagctgggaagaggtaccctatctcggtaaaagagaggaccagtggtgcgggtcccttattggactgacatcacgcgcaacgtgggccaagaacatacagaccgctatcaatcaagttcggagtctaattggcaacgaagagtacactgattatatgccttctatgaaaaggttccgaagagaagaggaagaggccggcgtgctgtggtga

SEQ ID NO: 14373 - RNA, 9876 nt, synthetic construct
  misc_feature 1..9876: note = derived and/or modified CDS sequence (opt3) from DENV-2__FJ850091__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatggatttaggggaactgtgtgaggacactatcacctacaaatgcccactactccggcaaaacgaaccggaggatattgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggatcgagacctggattctgcggcatcctggcttcacaatcatggccgcaatattggcctacaccatcggcacgactcactttcagcgcgctctcattttcatcctgctgacagcagtggccccatccatgaccatgagatgcattgggatctctaacagggattttgtcgaaggagtgtcgggtggctcatgggtagacatagttctcgagcacgggagctgtgtgactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatttgcaagcattctatggtcgatagaggctggggtaacgggtgtggactattcggcaagggcgggatcgtgacctgcgccatgtttacatgcaaaaagaatatggaaggaaaaatcgtgcagcctgagaacctcgaatacaccattgtcataactccacacagcggtgaggagcatgctgttggcaatgacacggggaagcacggaaaagaaatcaagattacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatccagaaggagacgcttgtcaccttcaagaaccctcatgccaaaaagcaagacgtggttgtgctgggctctcaggaaggggcgatgcacactgccttgacaggagcaaccgagatacagatgtcctcaggtaatctactgtttacaggccatctcaaatgccgtctgcgcatggataagcttcaactgaaagggatgagctacagtatgtgtactggaaagttcaagattgtcaaagaaatcgctgagacccagcacggcacgatcgtgattagagtacagtatgagggtgacgggtctccatgcaagatccccttcgaaattaccgatttggagaaaaggcatgttctcggccggctgataacagtgaacccgatcgtcactgaaaaggactcccctgtgaacattgaggccgaacccccatttggagatagctacatcatcgtcggcgtggagcctgggcagttaaaactgaattggttcaagaagggatcgtctattggtcaaatgtttgagaccacaatgcgaggcgctaaacgcatggccatactaggggacactgcatgggatttcggatccctcggcggtgtttttacctcaatcgggaaggccctgcaccaggtgttcggcgctatttacggagcggcatttagtggcgtaagctggacgatgaaaatccttattggggtcatcataacatggatcggaatgaactccagatctaccagcttgtcagtgagtctggttctcgtgggcgtcgtgactctgtatcttggtgccatggtacaggctgactccgggtgtattgtgagctggaagaataaagaactgaagtgcggatctggcatcttcattacagataacgttcacacctggactgagcagtacaagtttcaacccgaatcaccaagtaaattggccagcgcaatccagaaggcccatgaggaaggtatatgtggcattaggtccgtcacccggctcgagaatctgatgtggaaacagatcacacccgagttaaaccacattctgtctgaaaatgaggtgaagctaacgatcatgaccggggacataaaaggaatcatgcaggctggcaagcgctcgctcagacctcaaccaactgaactgaaatatagctggaagacatgggggaaggccaaaatgctttccaccgagtcacataaccagacattcttgattgatggaccggaaactgcagagtgccccaataccaacagggcgtggaatagtctggaggtggaagactacggctttggtgtcttcacgacaaacatctggctcaagctgcgtgagaaacaggacgttttttgtgattctaagttaatgagcgctgccattaaagacaatcgggcagtgcacgccgatatggggtattggatcgaatccgctctgaacgacacctggaagatggagaaggcctcattcatagaggtgaaaagctgccactggcctaagtctcatactctttggtccaatggagtattggaaagtgagatgattatcccaaaaaacttcgcaggccccgtcagccagcacaactaccgacctggttatcatacccaaacagctggcccatggcacctcgggaagctggaaatggattttgacttctgtgagggaactaccgtggttgtgacagaagattgcggcaatagagggccctctctaaggacgaccactgcctccggaaaactgatcacagagtggtgctgtcgctcatgcaccctcccgcctctgcggtacagaggcgaggacggttgttggtacgggatggaaattaggccacttaaggagaaggaagagaacttggtcaatagtctggtgactgcgggacatggccagatcgataactttagcttaggtgttctcggcatggccctgttccttgaagagatgctgcgcacacgagtggggaccaaacacgctattttgctcgtagcactgtcgtttgtcacgctaataactggaaatatgtccttccgggacctgggccgtgtgatggtgatggtcggggccaccatgacagatgacatcggaatgggcgttacctatctcgctctgcttgccgcatttaaggtgagacccactttcgcggccggtttgctgttaaggaaactcacatctaaggagctgatgatggctaccattgggatcgcccttctgagccagtcaacactacctgaaactattctcgagctgaccgatgcattggctctgggaatgatggccttaaaaatcgtacgcaacatggaaaagtaccaactcgcagtgacgataatggccatcagttgcgtccccaatgctgtgattctgcagaacgcgtggaaggtttcctgtacaatccttgccgcagtgtctgtcagcccactgttgctcacctcctcacagcagaaagctgactggattcctctggccctaactatcaagggcctgaatcccaccgccatatttcttacaactctcagccggaccagtaaaaagagatcttggccactgaacgaggctattatggcagtgggcatggtttccatcttggccagctcgctgttaaaaaatgacatcccgatgacggggcctctcgtggcgggaggtctgcttacagtctgctatgtactgaccggcagggctgccgatttggaactcgagcgagcagccgacgtgaagtgggaggatcaagctgaaatttcagggtctagtcccatactgtccatcactattagcgaggacggatctatgagcatcaaaaacgaagaggaggaacagacactaaccattctgatccgcactggccttctcgttatatccggtgtgttcccagtctcaatccccattacagcagccgcgtggtacctgtgggaggtgaagaagcagcgggctggggtattgtgggatgtgcctagtccaccccctgtcggaaaagccgaattagaggacggcgcatatagaatcaagcagaggggcattctggggtacagccaaatcggagccggtgtttataaagaaggcacctttcacacgatgtggcatgtgactcgtggggctgtgctcatgcaccgcggaaagcggatagagccgtcttgggccgatgtcaaaaaggacctgatttcctacggcggtgggtggaagcttgagggagaatggaaagagggcgaagaggtgcaggttctggcattggaaccaggcaagaatcccagagctgtacagaccaaacctgggatcttcaagacaaacaccggaacaatcggtgccgtgtcactagattttagtccaggcactagcgggtcccccattgtcgacaggaaaggaaaggtggttggcctgtacggtaatggggtggtcacccgatctggagcgtatgtgtcggccatcgcacagacggagaagagcatagaggataaccctgaaattgaggacgatatcttccggaaaaagcgcctcacaattatggacctgcatccgggcgctggcaaaactaagagataccttcccgccatcgtaagggaagctataaaacgggggttacgaaccctgattctcgcaccaacaagagtcgtggccgccgagatggaagaggctttgcgcggactgcctatcaggtatcaaacccccgcgatccgtgcagagcacactggtcgggaaattgttgacctcatgtgtcatgccaccttcacaatgagactgctttcaccagtgagggtccctaactacaatctgatcattatggatgaggctcactttacggaccccgcctccatagcagcccgcggctatatcagtactcgagtggaaatgggggaggctgcgggaattttcatgaccgccacaccaccgggctctagagatccttttccccagagcaacgcaccaatcatggacgaggaacgggagatccccgaaaggtcctggaattcaggtcacgagtgggttaccgatttcaaggggaagactgtgtggtttgtcccttctattaaagctggaaacgacatagccgcatgcttgcgcaagaatggcaaaaaggtgatccagctaagccgtaaaacattcgatagtgaatacgccaagaccagagctaacgactgggattttgtagtgacgactgacatttccgagatgggcgccaatttcaaggcggagcgggttatcgatccaaggcgctgtatgaaacccgtcattctgacagacggggaagagcgagtgatcctcgcaggacctatgccggtgacccatagctctgccgctcaaagacggggtaggataggccgcaacccaaagaatgaaaacgaccagtatatctacatgggggagcccttagaaaatgatgaggactgcgcccactggaaagaggctaagatgctgcttgataacattaatacccctgaaggaatcattccctcaatgtttgagccagaaagagagaaagtcgacgcaatcgatggcgaatacaggctgcggggtgaggcccgtaagactttcgtagacctcatgcgccgaggggatttgcctgtgtggctggcttataaagttgccgcagagggcataaactacgcggacagaaagtggtgttttgatggaattaagaataaccagatcctcgaagagaacgtggaagtcgagatttggacaaaagagggcgaaaggaagaaactgaagccccggtggcttgacgcccgcatctattccgatccactagctctgaaagagttcaaggaattcgccgcagggagaaagagtttgaccttaaatctgataacagagatgggaaggctccctacttttatgacgcagaaagctcggaacgccctggacaatcttgcagtgctgcataccgccgaagttggtggcaaggcttacacacacgcgctcagcgagttgccggagactctggaaaccctactgctccttacactgttagccgcagtgaccgggggaatcttcttgtttctgatgtcgggcaaaggtattgggaagatgactctcggcatgtgctgcatcattacggcttctatcctgctttggtatgcccaaatacagccccactggattgccgcatccatcatcctggagttctttctcattgtcttgctgatcccagaacctgagaaacagcgaaccccccaggataaccaattaacatacgtggtaatagctattctaactgtggttgccgcgaccatggctaatgaaatgggattcctggagaagacaaagaaagacctcggctttgggagcatcaccactcaggagtcagaaagtaacattcttgacatcgatctgagaccagcctctgcatggacattgtatgccgtcgctacgaccttcgtgactcctatgctgcgccattccatagagaatagctcagtgaacgtcagtctcacagcaatcgccaatcaggcgaccgttctgatgggacttggtaagggctggcccctcagcaaaatggacattggggtgccgctgttggctatcggatgttactcccaggtaaacccaattaccctgacagccgcattactactgctcgtggcccactacgctatcattggccctggtcttcaagccaaggcaactagggaagctcagaaacgggccgcggccgggatcatgaagaatcccacggtcgatggcataaccgtgattgacctggagccaatcccctatgatcctaagtttgaaaaacagttgggacaggttatgctgctcatcctgtgcgtgacacaagtccttatgatgcgtactacctgggcattatgtgaggctctgacactcgccaccggcccgatttctactttgtgggaggggaaccccggaagattctggaatacgacaatagcagtaagcatggctaacatctttaggggctcctacctggccggtgccgggctactgttctcaattatgaagaataccactaacacccgccggggaacaggcaatgtgggtgaaactctcggcgagaaatggaagtctcgacttaacgcgctggggaaaagtgaatttcagatctataagaaatcgggaattcaggaggttgacagaaccttggctaaggagggcatcaagaggggggaaacagatcatcacgcagtgagccgcggatccgccaaactgcggtggttcgtcgagagaaacatggtgacgccagaaggcaaggtcgtggacctcggttgcgggcgtggaggctggtcttactattgtggtggcctgaaaaatgttagggaggtgaaggggttaaccaaaggaggccctgggcatgaagagcccatacctatgtcaacttacggatggaaccttgtacggctgcaaagcggcgtggatgtcttctttacaccacccgagaagtgcgacaccctcctatgtgatatcggtgaatccagtcctaatccaactattgaggctgggcgcacactgcgagttttgaacctggtggaaaattggctcaacaataacacccagttctgcatcaaggtccttaatccctatatgccgtctgtgattgagaaaatggaaacgctgcagagaaagtacggaggcgccttggtaaggaaccctctgagccggaattcaacccacgagatgtactgggtgtccaacgcaacaggcaatatcgttagtagcgtgaacatgatatctcgcatgctcattaatagatttactatgaaacacaagaaagccacctatgagccagacgtcgatttagggtccggaacaaggaacatcggtatcgaatcagagattcccaacctggacataatcggcaagcgaattgaaaagatcaaacaggagcatgaaactagctggcactacgaccaagatcatccttataagacctgggcttaccacgggtcgtatgagacaaaacagaccggatctgcgagttccatggtgaatggcgtcgtgcggcttctgactaagccatgggacgttgtacccatggtgacgcagatggccatgacagataccactccgttcggtcagcaacgtgtctttaaagagaaggtggacaccagaacacaggaacctaaggaggggacgaaaaagctaatgaaaattaccgcagaatggctctggaaggagctgggaaaagagaagactccccgcatgtgtacaagggaagagttcacccggaaagttagaagcaacgctgccttgggcgcagtgtttactgatgaaaataagtggaagtcagcccgcgaggctgtcgaagacggcaggttctgggagctggtggatcgagagcggaacctccaccttgaagggaaatgcgagacatgtgtatacaatatgatgggaaagagagaaaaaaagctgggtgagtttggcaaagccaaggggtccagggcgatctggtatatgtggttaggagcacgcttcctggaatttgaggccttgggcttcctcaacgaggaccattggttttctcgtggtaatagcctgagtggggtggaaggagagggcctacaccggcttggctacatactgagagaagttgggaagaaagagggaggtgctatgtacgccgatgacaccgcaggctgggatacaaggatcactctcgaagacctgaagaacgaggagatggtcaccaatcatatgaaaggggaacacaagaaattggctgaggccattttcaagctgacgtatcagaacaaggtggtgcgcgtccagcgaccaacccctcggggaacagttatggacatcatttccagaaaagatcaaaggggcagcggtcaggtggggacttacggactcaataccttcacaaacatggaagctcagcttatccgccaaatggagggcgagggcatttttaagtctatacagcatctgactgccaccgaagagatcgcagtacagaattggttagcgagagtggggcgggaaaggctgtcacgtatggccattagtggagacgattgcgtcgtgaaacccatcgacgatcgattcgcttccgccttgacggcactcaacgacatgggtaaggttcgcaaagatatccagcaatgggagccaagcagaggctggaatgactggacacaggtgcccttttgctctcaccacttccatgaactggtcatgaaggatgggcgggtgctagtagttccttgtaggaaccaggacgagcttattggacgcgctagaatatcgcagggcgccggttggtcactgaaggagaccgcatgcctcgggaaaagctatgcccaaatgtggactctgatgtactttcaccggagggatttgcgattagcggctaacgccatctgttccgcagtgccaagtcattgggtcccgacatctcgtaccacttggagcattcacgccaagcacgaatggatgaccacagaggacatgctggctgtgtggaatagagtgtggatccaggaaaacccctggatggaggataaaacgcctgtcgaatcctgggaggaggttccatatctcggaaagcgcgaagaccagtggtgcggctcacttattggcctgaccagtcgggccacttgggcaaaaaatatccagacagctataaaccaagtgaggtctctaatcgggaatgagggatacaccgactatatgcccagcatgaagagattccgccgggaagaggaagaggccggtgtactgtggtga

SEQ ID NO: 14374 - RNA, 9876 nt, synthetic construct
  misc_feature 1..9876: note = derived and/or modified CDS sequence (opt3) from DENV-2__GQ199890__SS-prME
  source 1..9876: mol_type = other RNA
accgccggcgtgatcgtcatgctgattcccactgctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccattactccggcaaaacgaaccggaggatatcgactgttggtgcaattccacatctacctgggttacttatggaacatgtaccacgattggcgagcaccgccgagaaaagcgttcagtggcgctggtcccccatgtgggtatggggcttgagactagaaccgaaacatggatgagtagcgagggagcttggaaacacgttcagaggatcgagacttggatactgcggcatcctggcttcaccatcatggccgcaattttggcctacacaatcggcaccacgcactttcagcgcgctctcattttcatcctgctgactgcagtggccccatccatgacaatgagatgcatagggatttctaacagggattttgtcgaaggagtgtcgggtggctcatgggtagacatcgttctcgagcacgggagctgtgtgaccactatggctaagaataagcccacattagatttcgaactgattaaaaccgaggccaagcagcctgcgacgcttcggaaatattgcatcgaagcaaagttgaccaacacaactaccgagagtcgctgtccaacacaaggagagccctccctgaatgaagaacaggacaaacgatttatctgcaagcattctatggtcgatagaggctggggtaacgggtgtggactattcggcaagggcgggattgtgacttgcgccatgtttacctgcaaaaagaatatggaaggaaaaatagtgcagcctgagaacctcgaatacacaatcgtcattaccccacacagcggtgaggagagggctgttggcaatgacactgggaagcatggaaaagaaatcaagataacgccgcagtcctcaacaaccgaggccgaactgactggctatggtaccgtgacaatggagtgtagtccccggaccgggcttgatttcaacgaaatggtactgttgcaaatggaggacaaagcatggctcgtgcaccgtcagtggtttctggatttacctctgccatggctccccggcgctgacactcagggaagcaattggattcagaaggagacacttgtcacgttcaagaaccctcacgccaaaaagcaagacgtggttgtgctgggctctcaggaaggggcgatgcataccgccttgactggagcaacagagatccagatgtcctcaggtaatctactgtttaccggccacctcaaatgccgcctgagaatggataaacttcaactgaaagggatgagctacagtatgtgtacaggaaagttcaagatcgtcaaagaaattgctgagactcagcatggcaccatcgtgattagggtacagtatgagggtgacgggtctccatgcaagatacccttcgaaatcacggatttggagaaacggcacgttctcggccgactgattaccgtgaacccgatcgtcacagaaaaggactcccctgtgaacatcgaggccgaacccccatttggagatagctacattatagtcggcgtggagcctgggcagttaaaactgaattggttcaagaagggatcgtctatcggtcaaatgtttgagactaccatgcgcggcgctaaaagaatggccattctaggggacacagcatgggatttcggatccctcggcggtgtttttacttcaatcgggaaggccctgcatcaggtgttcggcgctatttacggagcggcatttagtggcgtaagctggaccatgaaaatccttataggggtcatcattacgtggatcggaatgaactccaggtctactagcttgtcagtgagtctggttctcgtgggcgtcgtgaccctgtatcttggtgccatggtacaggctgactccgggtgtattgtgagctggaagaataaagaactgaagtgcggatctggcatcttcataactgataacgttcacacatggaccgagcagtacaagtttcaacccgaatcaccaagtaaattggccagcgcaattcagaaggcccacgaggaaggtatctgtggcattcggtccgtcactcgcctcgagaatctgatgtggaaacagatcacccccgagttaaaccatatactgtctgaaaatgaggtgaagctaacaatcatgacgggggacattaaaggaatcatgcaggctggcaagagatcgctcaggcctcaaccaaccgaactgaaatatagctggaagacttgggggaaggccaaaatgctttccacagagtcacacaaccagaccttcttgattgatggaccggaaacagcagagtgccccaatactaaccgtgcgtggaatagtctggaggtggaagactacggctttggtgtcttcaccacgaacatctggctcaagctgcgggagaaacaggacgtattttgtgattctaagttaatgagcgctgccataaaagacaatcgagcagtgcatgccgatatggggtattggattgaatccgctctgaacgacacatggaagatggagaaggcctcattcatcgaggtgaaaagctgccactggcctaagtctcacaccctttggtccaatggagtattggaaagtgagatgatcattcccaagaatttcgcaggccccgtcagccagcataactacagacctggttatcacactcaaaccgctggcccatggcatctcgggaagctggaaatggattttgacttctgtgagggaacaactgtggttgtgaccgaagattgcggcaatagggggccctctctacgcacaacgaccgcctccggaaaactgatcactgagtggtgctgtcggtcatgcacactcccgcctctgagatacaggggcgaggacggttgttggtacgggatggaaattcgcccacttaaggagaaggaagagaacttggtcaatagtctggtgaccgcgggacacggccagatagataactttagcttaggtgttctcggcatggccctgttccttgaagagatgctgcgaactcgggtggggacaaaacatgctatcttgctcgtagcactgtcgtttgtcaccctaattacgggaaatatgtccttccgtgacctgggcagagtgatggtgatggtcggggccactatgaccgatgacatcggaatgggcgttacatatctcgctctgcttgccgcatttaaggtgaggcccaccttcgcggccggtttgctgttacgcaaactcacttctaaggagctgatgatggctacaattgggatcgcccttctgagccagtcaaccctacctgaaacaatactcgagctgactgatgcattggctctgggaatgatggccttaaaaatcgtacggaacatggaaaagtaccaactcgcagtgaccattatggccatcagttgcgtccccaatgctgtgattctgcagaacgcgtggaaggtttcctgtacgatccttgccgcagtgtctgtcagcccactgttgctcacatcctcacagcagaaagctgactggatacctctggccctaaccattaagggcctgaatcccactgccatctttcttaccacactcagcagaacaagtaaaaagaggtcttggccactgaacgaggctatcatggcagtgggcatggtttccattttggccagctcgctgctaaagaatgacataccgatgaccgggcctctcgtggcgggaggtctgcttacggtctgctatgtactgacaggccgatcagctgatttggaactcgagcgcgccgcagacgtgaagtgggaggatcaagccgaaatctctgggagttcccccattctgagcatcaccatttctgaggacggaagcatgtccatcaaaaacgaagaggaggaacagactctaacaatactgatccggaccggccttctcgttatttcaggtgtgttcccagtcagtatccccattactgctgcagcctggtacctgtgggaggtgaagaagcagagagcgggggtattgtgggatgtgcctagcccaccccctgtcggaaaagctgaattagaggacggcgcctataggatcaagcagcgtggcatactggggtactctcaaattggagccggtgtttataaagaaggcacatttcacaccatgtggcacgtgacgcgcggggcagtgctcatgcatcggggaaagagaatcgagccgtcctgggctgatgtcaaaaaggacctgatctcatacggcggtgggtggaaacttgagggagaatggaaagagggcgaagaggtgcaggttctggccttggaaccaggcaagaatcccagggcagtacagactaaacctgggattttcaagaccaacacaggaaccatcggtgctgtgagtctagattttagcccaggcacatccgggtctcccatagtcgaccgaaaaggaaaggtggttggcctgtacggtaatggggtggtcactcggtcgggagcctatgtgagcgcgattgcccagaccgagaagtcaatcgaggataaccctgaaattgaggacgatatcttccgcaaaaagagactcacgataatggacctgcacccgggcgcaggcaaaacaaagaggtaccttcccgctattgtacgggaagccatcaaacgagggttaagaactctgatcctcgctccaacccgcgtcgtggcagccgagatggaagaggccttgaggggactgcctattcgttatcaaacacccgctatccgggcggagcataccggtagagaaattgttgacctcatgtgtcacgcaactttcaccatgaggctgctttccccagtgcgcgtccctaactacaatctgataatcatggatgaggcccattttacagaccccgctagtattgccgcacgaggctatatctctacgagagtggaaatgggggaggccgctggaatcttcatgactgcgaccccaccgggcagccgggatccttttccccagtccaacgccccaattatggacgaggaaagggagatacccgaacgctcatggaactctggtcacgagtgggttacagatttcaaggggaagaccgtgtggtttgtccctagcatcaaagcaggaaacgacattgctgcctgcttgcgtaagaatggcaaaaaggtgatccagctaagtagaaaaactttcgattccgaatacgtaaagacacgggcaaacgactgggattttgtggttaccacggacattagcgagatgggcgccaatttcaaggctgagagggtcatcgatccacgccgatgtatgaaacccgtgatactgactgacggggaagagagagtgatcctcgccggacctatgccggtcacacactcttcagcggcacaacggaggggtcgcattggcagaaacccaaagaatgaaaacgaccagtatatctacatgggggagcccttagaaaatgatgaggactgcgcccattggaaagaggctaagatgctgcttgataacattaatacccctgaaggaatcataccctccatgtttgagccagaaagggagaaagtagacgccattgatggcgaataccggctgcgtggtgaggctcgcaagaccttcgtggacctcatgcgaagaggggatttgcctgtttggctggcatataaagtggccgctgagggcatcaactacgccgacaggaagtggtgttttgatggaattaagaataaccagatcctcgaagagaacgtcgaagtggagatatggactaaagagggcgaacggaagaaactgaagccccgctggcttgacgcaagaatctatagtgatccactagcgctgaaagagttcaaggagttcgccgctgggagaaagagcttgacattaaatctgattaccgagatgggacggctccctacatttatgactcagaaagcccgaaacgcactggacaatcttgctgttctgcacacggccgaagtgggtggcaaggcatacacccatgccctctcggagttgccggagacactggaaactctactgctccttaccctgttagctacaatcaccgggggaattttcttgtttctgatgtctggcaaaggtatcgggaagatgactctcggcatgtgctgcataattacggcgtccatcctgctttggtatgcccaaatccagccccactggattgcagctagcatcatactggagttctttctcattgtcttgctgatcccagaacctgagaaacagagaaccccacaggataaccaattaacatacgtggtaattgccatcctaactgtggttgccgcaaccatggctaatgaaatgggattcctggagaagacaaagaaagacctcggctttgggaccataactacacaggagtcagaaagtaacatccttgacattgatctgcgcccagcctctgcgtggacgttgtatgctgtcgccaccactttcgtgacacctatgctgaggcactccatcgagaatagctcagtgaacgtcagtctcaccgcaattgccaatcaggctaccgttctgatgggacttggtaagggctggcccctcagcaaaatggacatcggggtgccgctgttggcaattggatgttactcccaggtaaacccaatcacactgactgccgcgttactactgctcgtggctcattacgccataattggccctggtcttcaagcaaaggccacgcgggaagctcagaaacgtgccgcagctgggatcatgaagaatcccaccgtcgatggcatcacagtgattgacctggagccaataccctatgatcctaagtttgaaaaacagttgggacaggttatgctgctcatcctgtgcgtgactcaagtccttatgatgagaaccacatgggccttatgtgaggcgctgaccctcgccactggcccgatttctacgttgtgggaggggaaccccggaaggttctggaatacaaccatcgcagtaagcatggctaacatttttcgcggctcctacctggccggtgcagggctactgttctcaatcatgaagaatactaccaacacacggcgaggaactggcaatgtgggtgaaaccctcggcgagaaatggaagtctagacttaacgctctggggaaaagtgaatttcagatatataagaaatcgggaatccaggaggttgacaggacattggccaaggagggcattaagcgcggggaaacggatcaccatgccgtgagccggggatccgcgaaactgagatggttcgtcgagcgtaacatggtgaccccagaaggcaaggtcgtggacctcggttgcgggaggggaggctggtcttactattgtggtggcctgaaaaatgttcgggaggtgaaggggttaactaaaggaggccctgggcacgaagaacccatccctatgtcaacatacggatggaaccttgtacgcctgcaaagcggcgtggatgtcttctttaccccacccgagaagtgcgacactctcctatgtgatattggtgaatccagtcctaatccaacaatcgaggctgggcgaaccctgagagttttgaacctggtggaaaattggctcaacaataacacgcagttctgcataaaggtccttaatccctatatgccgtctgtgattgagaaaatggaaaccctgcagaggaagtacggaggcgcattggtacggaaccctctgagccgcaattcaacacatgagatgtactgggtgtccaacgccactggcaatatcgttagtagcgtgaacatgatctctagaatgctcattaataggtttaccatgaaacacaagaaagctacatatgagccagacgtcgatttagggtccggaactcgaaacataggtatcgaatcagagattcccaacctggacatcattggcaagcggatcgaaaagataaaacaggagcacgaaaccagctggcattacgaccaagatcacccttataagacatgggcctaccatgggtcgtatgagaccaaacagactggatctgcaagttccatggtgaatggcgtcgtgcgtcttctgacgaagccatgggacgttgtacccatggtgacacagatggccatgaccgatactaccccgttcggtcagcaaagagtctttaaagagaaggtggacacacgcacgcaggaacctaaggaggggaccaaaaagctaatgaaaatcactgctgaatggctctggaaggagctgggaaaagagaagacacccaggatgtgtacccgggaagagttcactagaaaagttcgcagcaacgcggccttgggcgcaatttttacagatgaaaataagtggaagtcagctagggaggccgtggaagacggccgattctgggagctggtcgatcgggagagaaacctccaccttgaagggaaatgcgagacctgtgtgtacaatatgatgggaaagagggagaaaaagctgggtgagtttggcaaagcaaaggggtcccgcgccatctggtatatgtggttaggagctcgtttcctggaatttgaggccttgggcttcctcaacgaggaccactggttttctcggggtaatagcctgagtggggtagaaggagagggcctacatagacttggctacattctgagggaagtggggaagaaagagggaggtgcgatgtacgcagatgacacagccggctgggatactcgcatcaccctcgaagacctgaagaacgaggagatggttacgaatcacatgaaaggggaacataagaaattggctgaggccattttcaagctgacctatcagaacaaggtcgtgcgagtgcagcggccaacacctagaggaactgtcatggacataatctccaggaaagatcaacgcggcagcggtcaggttgggacctacggactcaatacattcactaacatggaagcacagcttattagacaaatggagggcgagggcatctttaagtctatccagcacctgaccgctacggaagagattgccgtgcagaattggttagctcgggtagggagggaacgtctgtcacgaatggccataagtggagacgattgcgtggtcaaacccatcgacgatcgcttcgcatccgcgttgacagccctcaacgacatgggtaaggtgagaaaagatattcagcaatgggagccaagccggggctggaatgactggacccaggttcccttttgctctcatcacttccacgaactggtgatgaaggatgggagggtcctagtggtaccttgtcgcaaccaggacgagcttatcggaagggctcggatttcgcagggcgccggttggtcactgaaggagactgcatgcctcgggaaaagctatgctcaaatgtggacactgatgtactttcataggcgagatttgcgtttagccgcaaacgccatctgttccgcggttccaagtcactgggtgccgacctctagaactacctggagcatacatgctaagcacgaatggatgacaacggaggacatgctggccgtctggaatcgcgtgtggatccaggaaaacccctggatggaggataaaacccctgtggaatcctgggaggaggtcccatatctcggaaagcgggaagaccagtggtgcggctcacttattggcctgacaagtagggcaacatgggccaaaaatatccagaccgctattaaccaagttagatctctaatcgggaatgagggatacactgactatatgcccagcatgaagcgcttccggaaggaagaggaagaggccggtgtgctgtggtga

SEQ ID NO: 14375 - RNA, 9876 nt, synthetic construct
  misc_feature 1..9876: note = derived and/or modified CDS sequence (opt3) from DENV-2__GQ868549__SS-prME
  source 1..9876: mol_type = other RNA
accgcaggcgtgatcgtaatgctgattcccacagctatggcattccacctcactacgaggaacggggagcctcatatgatagttggaaggcaggaaaagggtaaaagccttctgtttaagaccgaggacggcgtgaatatgtgcacattgatggcaatcgatttaggggaactgtgtgaggacactattacctacaaatgcccactactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagacccggacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataaacttcaactgaaagggatgagctacagtatgtgtactggaaagttcaagatcgtcaaagaaatcgctgagacccagcacggcacgattgtgatcagagtacagtatgagggtgacgggtctccatgcaagattcccttcgaaataaccgatttggagaaaaggcatgttctcggccggctgatcacagtgaacccgattgtcactgaaaaggactcccctgtgaacatcgaggccgaacccccatttggagatagctacatcattgtcggcgtggagcctgggcagttaaaactgaattggttcaagaagggatcgtctataggtcaaatgtttgagaccacaatgcgaggcgctaaacgcatggccatcctaggggacactgcatgggatttcggatccctcggcggtgtttttacctcaattgggaaggccctgcaccaggtgttcggcgctatctacggagcggcatttagtggcgtaagctggacgatgaaaattcttatcggggtcataatcacatggattggaatgaactccagatctaccagcttgtcagtgagtctggttctcgtgggcgtcgtgactctgtatcttggtgccatggtacaggctgactccgggtgtatcgtgagctggaagaataaagaactgaagtgcggatctggcattttcatcacagataacgttcacacctggactgagcagtacaagtttcaacccgaatcaccaagtaaattggccagcgcaatacagaaggcccatgaggaaggtatttgtggcatcaggtccgtcacccggctcgagaatctgatgtggaaacagattacacccgagttaaaccacatcctgtctgaaaatgaggtgaagctaacgataatgaccggggacatcaaaggaattatgcaggctggcaagcgctcgctcagacctcaaccaactgaactgaaatatagctggaagacatgggggaaggccaaaatgctttccaccgagtcacataaccagacattcttgatcgatggaccggaaactgcagagtgccccaataccaacagggcgtggaatagtctggaggtggaagactacggctttggtgtcttcacgacaaacatttggctcaagctgcgtgagaaacaggacgtattttgtgattctaagttaatgagcgctgccatcaaagacaatcgggcagtgcacgccgatatggggtattggatagaatccgctctgaacgacacctggaagatggagaaggcctcattcattgaggtgaaaagctgccactggcctaagtctcatactctttggtccaatggagtattggaaagtgagatgatcatccccaagaatttcgcaggccccgtcagccagcacaactaccgacctggttatcatacccaaacagctggcccatggcacctcgggaagctggaaatggattttgacttctgtgagggaactaccgtggttgtgacagaagattgcggcaatagagggccctctctaaggacgaccactgcctccggaaaactgattacagagtggtgctgtcgctcatgcaccctcccgcctctgcggtacagaggcgaggacggttgttggtacgggatggaaatcaggccacttaaggagaaggaagagaacttggtcaatagtctggtgactgcgggacatggccagattgataactttagcttaggtgttctcggcatggccctgttccttgaagagatgctgcgcacacgagtggggaccaaacacgctatattgctcgtagcactgtcgtttgtcacgctaatcactggaaatatgtccttccgggacctgggccgtgtgatggtgatggtcggggccaccatgacagatgacattggaatgggcgttacctatctcgctctgcttgccgcatttaaggtgagacccactttcgcggccggtttgctgttaaggaaactcacatctaaggagctgatgatggctaccatcgggattgcccttctgagccagtcaacactacctgaaactatcctcgagctgaccgatgcattggctctgggaatgatggccttaaaaatagtacgcaacatggaaaagtaccaactcgcagtgacgatcatggccattagttgcgtccccaatgctgtgatcctgcagaacgcgtggaaggtttcctgtacaattcttgccgcagtgtctgtcagcccactgttgctcacctcctcacagcagaaagctgactggatccctctggccctaactataaagggcctgaatcccaccgccatttttcttacaactctcagccggaccagtaaaaagagatcttggccactgaacgaggctatcatggcagtgggcatggtttccatcttggccagctcgctgctaaagaatgacattccgatgacggggcctctcgtggcgggaggtctgcttacagtctgctatgtactgaccggcaggtcagctgatttggaactcgagcgagccgcagacgtgaagtgggaggatcaagccgaaatatctgggagttcccccatcctgagcattactatctctgaggacggaagcatgtccattaaaaacgaagaggaggaacagacactaaccatcctgatacgcactggccttctcgttatctcaggtgtgttcccagtcagtattcccatcacagctgcagcctggtacctgtgggaggtgaagaagcagcgggcgggggtattgtgggatgtgcctagcccaccccctgtcggaaaagctgaattagaggacggcgcctatagaattaagcagaggggcatcctggggtactctcaaataggagccggtgtttataaagaaggcacctttcacacgatgtggcatgtgactcgtggggcagtgctcatgcaccgcggaaagcggattgagccgtcctgggctgatgtcaaaaaggacctgatctcatacggcggtgggtggaaacttgagggagaatggaaagagggcgaagaggtgcaggttctggccttggaaccaggcaagaatcccagagcagtacagaccaaacctgggatcttcaagacaaacaccggaacaattggtgctgtgagtctagattttagcccaggcacttccgggtctcccatcgtcgacaggaaaggaaaggtggttggcctgtacggtaatggggtggtcacccgatcgggagcctatgtgagcgcgatagcccagacggagaagtcaattgaggataaccctgaaatcgaggacgatattttccggaaaaagcgcctcacaatcatggacctgcatccgggcgcaggcaaaactaagagataccttcccgctatagtaagggaagccattaaacgggggttacgaaccctgatcctcgctccaacaagagtcgtggcagccgagatggaagaggccttgcgcggactgcctatcaggtatcaaacccccgctattcgtgcggagcacactggtcgggaaatcgttgacctcatgtgtcatgcaaccttcacaatgagactgctttccccagtgagggtccctaactacaatctgattataatggatgaggcccactttacggaccccgctagtatcgccgcacgcggctatatttctactcgagtggaaatgggggaggccgctggaatcttcatgaccgcgacaccaccgggcagcagagatccttttccccagtccaacgccccaatcatggacgaggaacgggagattcccgaaaggtcatggaactctggtcacgagtgggttaccgatttcaaggggaagactgtgtggtttgtccctagcataaaagcaggaaacgacatcgctgcctgcttgcgcaagaatggcaaaaaggtgattcagctaagtcgtaaaacattcgattccgaatacgtaaagaccagagcaaacgactgggattttgtggttacgactgacatcagcgagatgggcgccaatttcaaggctgagcgggtcattgatccaaggcgctgtatgaaacccgtgatcctgacagacggggaagaacgagtgatactcgccggacctatgccggtcacccattcttcagcggcacaaagacggggtaggatcggccgcaacccaaagaatgaaaacgaccagtatatttacatgggggagcccttagaaaatgatgaggactgcgcccactggaaagaggctaagatgctgcttgataacatcaatacccctgaaggaattatcccctccatgtttgagccagaaagagagaaagtagacgccatagatggcgaatacaggctgcggggtgaggctcgtaagactttcgtggacctcatgcgccgaggggatttgcctgtttggctggcatataaagtggccgctgagggcattaactacgccgacagaaagtggtgttttgatggaatcaagaataaccagattctcgaagagaacgtcgaagtggagatctggacaaaagagggcgaaaggaagaaactgaagccccggtggcttgacgcacgcatatatagtgatccactagcgctgaaagagttcaaggagttcgccgctgggagaaagagcttgaccttaaatctgatcacagagatgggaaggctccctacttttatgacgcagaaagcccggaacgcactggacaatcttgctgttctgcataccgccgaagtgggtggcaaggcatacacacacgccctctcggagttgccggagactctggaaaccctactgctccttacactgttagctgcggtcaccgggggaattttcttgtttctgatgtctggcaaaggtatcgggaagatgactctcggcatgtgctgcattatcacggcctccatactgctttggtatgcacaaattcagccccactggatcgctgccagcatcattctggagttctttctcatcgtgttgctgataccagaacctgagaaacagcgaaccccacaggataaccaattaacatacgtagtgattgccatcctaactgttgtcgcagctaccatggccaatgaaatgggattcctggagaagacaaagaaagacctcggctttgggtcaattaccactcaggagagtgaatctaacatccttgacatagatctgagaccagcgtccgcttggacattgtatgccgtggcaacgaccttcgtgactcctatgctgcgccatagcatcgaaaattcaagtgtcaacgttagcctcacagccattgctaatcaggcaaccgtgctgatgggacttggtaagggctggcccctctccaaaatggacatcggggtaccgctgttggccattggatgttactctcaggtgaacccaatcaccctgacagcggctttactactgctcgtcgcccactacgcaattatcggccctggtcttcaagccaaggctactagggaagcccagaaacgggcagctgccgggataatgaagaatcccacggtggatggcattaccgttatcgacctggagccaatcccctatgatcctaagtttgaaaaacagttgggacaggtgatgctgctcattctgtgcgtcacacaagtacttatgatgcgtactacctgggcgttatgtgaggccctgacactcgcaaccggcccgataagcactttgtgggaggggaaccccggaagattctggaatacgacaatcgctgtgtccatggccaacatttttaggggctcatacctggccggtgctgggctactgttctctatcatgaagaataccactaacacccgccggggaacaggcaatgttggtgaaactctcggcgagaaatggaagagtcgacttaacgccctggggaaatcggaatttcagatttataagaaaagcggaatccaggaggtggacagaaccttggccaaggagggcataaagagaggggaaacagatcatcacgcggtctcccgcggatctgctaaactgcggtggttcgtggagagaaacatggtcacgccagaaggcaaggtggttgacctcggttgcgggcgtggaggctggtcatactattgtggtggcctgaaaaatgtgagggaggtaaaggggttaaccaaaggaggccctgggcatgaggaacccatccctatgagcacttacggatggaaccttgtgcggctgcaatccggcgtcgatgttttctttacaccacccgagaagtgcgacaccctcctatgtgatattggtgaaagttctcctaatccaactatcgaggcagggcgcacactgcgagtgttgaacctggtcgaaaattggctcaacaataacacccagttctgcattaaggtgcttaatccctatatgccgagcgtaatcgagaaaatggaaacgctgcagagaaagtacggaggcgccttggtgaggaaccctctgtcaagaaattccacccacgagatgtactgggttagtaacgctacaggcaatatagtgagctctgtcaacatgatttcccgcatgctcatcaatagatttactatgaaacacaagaaagccacctatgagccagacgtggatttagggtcaggaacaaggaacatcggtattgaaagcgagatacccaacctggacatcattggcaagcgaatcgaaaagattaaacaggagcatgaaacttcgtggcactacgaccaagatcatccttataagacctgggcataccacgggtcttatgagacaaaacagaccggaagtgcctccagcatggtcaatggcgtggttcggcttctgactaagccatgggacgtagtgcccatggtcacgcagatggctatgacagataccactccgttcggtcagcaacgtgtgtttaaagagaaggttgacaccagaacacaggaacctaaggaggggacgaaaaagctaatgaaaatcaccgcggaatggctctggaaggagctgggaaaagagaagactccccgcatgtgtacaagggaagagttcacccggaaagtgagatcaaacgccgcattgggcgctgtctttactgatgaaaataagtggaagtccgcccgcgaggcagtggaagacggcaggttctgggagctggtagatcgagagcggaacctccaccttgaagggaaatgcgagacatgtgtgtacaatatgatgggaaagagagagaaaaagctgggtgagtttggcaaagccaaggggtctagggctatatggtatatgtggttaggagcccgcttcctggaatttgaggcgttgggcttcctcaacgaggaccattggtttagccgtggtaatagtctgtccggggttgaaggagagggcctacaccggcttggctacatcctgagagaagtcgggaagaaagagggaggtgcaatgtacgccgatgacaccgctggctgggatacaaggattactctcgaagacctgaagaacgaggagatggtgaccaatcatatgaaaggggaacacaagaaattggccgaggcaatcttcaagctgacgtatcagaacaaggtggtccgcgttcagcgaccaacccctcggggaacagtgatggacattatcagcagaaaagatcaaaggggctctggtcaggtagggacttacggactcaataccttcacaaacatggaagctcagcttattcgccaaatggagggcgagggcatatttaagtcaatccagcatctgactgccaccgaagagattgctgtgcagaattggttagccagagtcgggcgggaaaggctgagtcgtatggcaatctccggagacgattgcgtggttaaacccatcgacgatcgattcgcgagcgccttgacggctctcaacgacatgggtaaggtgcgcaaagatattcagcaatgggagccatctagaggctggaatgactggacacaggtccccttttgctcgcaccacttccatgaactggtgatgaaggatgggcgggtcttagttgtgccttgtaggaaccaggacgagcttataggacgcgccagaatctcacagggcgcaggttggagcctgaaggagaccgcttgcctcgggaaatcctatgcccaaatgtggactctgatgtactttcaccggagggatttgcgattagcagccaacgcgatttgtagtgctgtcccatctcattgggtgccgacaagccgtaccacttggtccatccacgccaagcacgaatggatgaccacagaggacatgctggcagtgtggaatagagtctggattcaggaaaacccctggatggaggataaaacgcctgttgaatcatgggaggaggtgccatatctcggaaagcgcgaagaccagtggtgcggcagtcttatcggcctgacctctcgggccacttgggctaaaaatatacagacagccatcaaccaagtaaggagcctaatggggaatgagggatacaccgactatatgccctccatgaagagattccgccgggaagaggaagaggccggtgtgctgtggtga

SEQ ID NO: 14376 - RNA, 9876 nt, synthetic construct
  misc_feature 1..9876: note = derived and/or modified CDS sequence (opt3) from DENV-2__GQ868551__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataagcttcaactgaaagggatgagctacagtatgtgtactggaaagttcaagatcgtcaaagaaatcgctgagacccagcacggcacgattgtgatcagagtacagtatgagggtgacgggtctccatgcaagattcccttcgaaataaccgatttggagaaaaggcatgttctcggccggctgatcacagtgaacccgattgtcactgaaaaggactcccctgtgaacatcgaggccgaacccccatttggagatagctacatcattgtcggcgtggagcctgggcagttaaaactgaattggttcaagaagggatcgtctataggtcaaatgtttgagaccacaatgcgaggcgctaaacgcatggccatcctaggggacactgcatgggatttcggatccctcggcggtgtttttacctcaattgggaaggccctgcaccaggtgttcggcgctatctacggagcggcatttagtggcgtaagctggacgatgaaaattcttatcggggtcataatcacatggattggaatgaactccagatctaccagcttgtcagtgagtctggttctcgtgggcgtcgtgactctgtatcttggtgccatggtacaggctgactccgggtgtatcgtgagctggaagaataaagaactgaagtgcggatctggcattttcatcacagataacgttcacacctggactgagcagtacaagtttcaacccgaatcaccaagtaaattggccagcgcaatacagaaggcccatgaggaaggtatttgtggcatcaggtccgtcacccggctcgagaatctgatgtggaaacagattacacccgagttaaaccacatcctgtctgaaaatgaggtgaagctaacgataatgaccggggacatcaaaggaattatgcaggctggcaagcgctcgctcagacctcaaccaactgaactgaaatatagctggaagacatgggggaaggtgaaaatgctttccaccgagtcacataaccagacattcttgatcgatggaccggaaactgccgagtgccccaataccaacagggcatggaatagtctggaggtcgaagactacggctttggtgttttcacgacaaacatttggctcaagctgcgtgagaaacaggacgtgttttgtgattctaagttaatgagcgcggctatcaaagacaatcgggccgtgcacgcagatatggggtattggatagaatccgccctgaacgacacctggaagatggagaaggcttcattcattgaggtaaaaagctgccactggcctaagtctcatactctttggtccaatggagtcttggaaagtgagatgatcatcccaaaaaacttcgccggccccgtgagccagcacaactaccgacctggttatcatacccaaacagcaggcccatggcacctcgggaagctggaaatggattttgacttctgtgagggaactaccgttgtggtcacagaagattgcggcaatagagggccctctctaaggacgaccactgcttccggaaaactgattacagagtggtgctgtcgctcatgcaccctcccgcctctgcggtacagaggcgaggacggttgttggtacgggatggaaatcaggccacttaaggagaaggaagagaacttggtgaatagtctggttactgccggacatggccagattgataactttagcttaggtgtgctcggcatggcgctgttccttgaagagatgctgcgcacacgagtagggaccaaacacgccatattgctcgtcgctctgtcgtttgtgacgctaatcactggaaatatgtccttccgggacctgggccgtgtgatggtcatggttggggcaaccatgacagatgacattggaatgggcgtgacctatctcgccctgcttgctgcctttaaggtaagacccactttcgcagcgggtttgctgttaaggaaactcacatctaaggagctgatgatggccaccatcgggattgctcttctgagccagtcaacactacctgaaactatcctcgagctgaccgatgccttggcactgggaatgatggctttaaaaatagtgcgcaacatggaaaagtaccaactcgccgtcacgatcatggcaattagttgcgtgcccaatgccgttatcctgcagaacgcttggaaggtgtcctgtacaattcttgcggccgtctctgtgagcccactgttgctcacctcctcacagcagaaagcagactggatccctctggctctaactataaagggcctgaatcccaccgccatttttcttacaactctcagccggaccagtaaaaagagatcttggccactgaacgaggccatcatggctgttggcatggtgtccatcttggcaagctcgctgttaaaaaatgacattccgatgacggggcctctcgtcgccggaggtctgcttacagtatgctatgtgctgaccggcaggtcagcggatttggaactcgagcgagctgccgacgttaagtgggaggatcaagcagaaatatctgggagttcccccatcctgagcattactatctctgaggacggaagcatgtccattaaaaacgaagaggaggaacagacactaaccatcctgatacgcactggccttctcgtgatctcaggtgtcttcccagtgagtattcccatcacagccgctgcatggtacctgtgggaggtaaagaagcagcgggccggggtgttgtgggatgtccctagcccaccccctgttggaaaagcggaattagaggacggcgcttatagaattaagcagaggggcatcctggggtactctcaaataggagccggtgtgtataaagaaggcacctttcacacgatgtggcatgtgactcgtggggcagtcctcatgcaccgcggaaagcggattgagccgtcctgggccgatgtgaaaaaggacctgatctcatacggcggtgggtggaagcttgagggagaatggaaagagggcgaagaggttcaggtactggctttggaaccaggcaagaatcccagagccgtgcagaccaaacctgggatcttcaagacaaacaccggaacaattggtgcagtcagtctagattttagcccaggcacttccgggtctcccatcgtggacaggaaaggaaaggttgtgggcctgtacggtaatggggtcgtgacccgatcgggagcttatgtaagcgccatagcgcagacggagaagtcaattgaggataaccctgaaatcgaggacgatattttccggaaaaagcgcctcacaatcatggacctgcatccgggcgccggcaaaactaagagataccttcccgcaatagtcagggaagctattaaacgggggttacgaaccctgatcctcgccccaacaagagtggttgctgcagagatggaagaggccttgcgcggactgcctatcaggtatcaaacccccgccattcgtgctgagcacactggtcgggaaatcgtggacctcatgtgtcatgcgaccttcacaatgagactgctttccccagtcagggtgcctaactacaatctgattataatggatgaggcacactttacggaccccgccagtatcgctgcccgcggctatatttctactcgagttgaaatgggggaggcagccggaatcttcatgaccgctacaccaccgggcagcagagatccttttccccagtccaacgcgccaatcatggacgaggaacgggagattcccgaaaggtcatggaattctggtcacgagtgggtgaccgatttcaaggggaagactgtctggtttgtgcctagcataaaagccggaaacgacatcgcagcttgcttgcgcaagaatggcaaaaaggtaattcagctaagtcgtaaaacattcgattccgaatacgtgaagaccagagccaacgactgggattttgttgtcacgactgacatcagcgagatgggcgcaaatttcaaggccgagcgggtgattgatccaaggcgctgtatgaaacccgtgatcctgacagacggggaagagcgagtcatactcgctggacctatgccggtaacccattcttcagccgcgcaaagacggggtaggatcggccgcaacccaaagaatgaaaacgaccagtatatttacatgggggagcccttagaaaatgatgaggactgcgcacactggaaagaggccaagatgctgcttgataacatcaatacccctgaaggaattatcccctccatgtttgagccagaaagagagaaagtggacgctatagatggcgaatacaggctgcggggtgaggcccgtaagactttcgttgacctcatgcgccgaggggatttgcctgtgtggctggcttataaagtcgcagccgagggcattaactacgctgacagaaagtggtgttttgatggaatcaagaataaccagattctcgaagagaacgtggaagttgagatctggacaaaagagggcgaaaggaagaaactgaagccccggtggcttgacgcccgcatatatagtgatccactagcactgaaagagttcaaggaattcgcggccgggagaaagagcttgaccttaaatctgatcacagagatgggaaggctccctacttttatgacgcagaaagctcggaacgccctggacaatcttgcagtgctgcataccgctgaagtcggtggcaaggcctacacacacgcactctcggagttgccggagactctggaaaccctactgctccttacactgttagccgctgtgaccgggggaattttcttgtttctgatgtctggcaaaggtatcgggaagatgactctcggcatgtgctgcattatcacggcgtccatactgctttggtatgcccaaattcagccccactggatcgcagctagcatcattctggagttctttctcatcgtattgctgataccagaacctgagaaacagcgaaccccccaggataaccaattaacatacgtggttattgccatcctaactgtcgtggccgcaaccatggctaatgaaatgggattcctggagaagacaaagaaagacctcggctttgggtcaattaccactcaggagagtgaatctaacatccttgacatagatctgagaccagcctccgcgtggacattgtatgctgtggccacgaccttcgtcactcctatgctgcgccatagcatcgagaattcaagtgttaacgtgagcctcacagcaattgccaatcaggctaccgtactgatgggacttggtaagggctggcccctctccaaaatggacatcggggtgccgctgttggcaattggatgttactctcaggtcaacccaatcaccctgacagccgcgttactactgctcgtggctcactacgccattatcggccctggtcttcaagcaaaggccactagggaagctcagaaacgggccgcagctgggataatgaagaatcccacggttgatggcattaccgtgatcgacctggagccaatcccctatgatcctaagtttgaaaaacagttgggacaggtcatgctgctcattctgtgcgtaacacaagtgcttatgatgcgtactacctgggccttatgtgaggcgctgacactcgccaccggcccgataagcactttgtgggaggggaaccccggaagattctggaatacgacaatcgcagtttccatggctaacatttttaggggctcatacctggccggtgcagggctactgttctctatcatgaagaataccactaacacccgccggggaacaggcaatgtgggtgaaactctcggcgagaaatggaagagtcgacttaacgctctggggaaatcggaatttcagatttataagaaaagcggaatccaggaggtcgacagaaccttggccaaggagggcataaagaggggggaaacagatcatcacgccgtgtcccgcggatctgcgaaactgcggtggttcgtcgagagaaacatggtgacgccagaaggcaaggttgtggacctcggttgcgggcgtggaggctggtcatactattgtggtggcctgaaaaatgtaagggaggtgaaggggttaaccaaaggaggccctgggcatgaagagcccatccctatgagcacttacggatggaaccttgtccggctgcaatccggcgttgatgtgttctttacaccacccgagaagtgcgacaccctcctatgtgatattggtgaaagttctcctaatccaactatcgaggctgggcgcacactgcgagtcttgaacctggtggaaaattggctcaacaataacacccagttctgcattaaggtacttaatccctatatgccgagcgtgatcgagaaaatggaaacgctgcagagaaagtacggaggcgcattggttaggaaccctctgtcacggaattccacccacgagatgtactgggtgagtaacgccacaggcaatatagtcagctctgtgaacatgatttcccgcatgctcatcaatagatttactatgaaacacaagaaagctacctatgagccagacgtcgatttagggtcaggaacaaggaacatcggtattgaaagcgagatacccaacctggacatcattggcaagcgaatcgaaaagattaaacaggagcatgaaacttcgtggcactacgaccaagatcatccttataagacctgggcctaccacgggtcttatgagacaaaacagaccggaagtgcatccagcatggtgaatggcgttgtacggcttctgactaagccatgggacgtggtccccatggtgacgcagatggccatgacagataccactccgttcggtcagcaacgtgtttttaaagagaaggtggacaccagaacacaggaacctaaggaggggacgaaaaagctaatgaaaatcaccgctgaatggctctggaaggagctgggaaaagagaagactccccgcatgtgtacaagggaagagttcacccggaaagtcagatcaaacgcggccttgggcgcagtgtttactgatgaaaataagtggaagtccgctcgcgaggccgtagaagacggcaggttctgggagctggtggatcgagagcggaacctccaccttgaagggaaatgcgagacatgtgtttacaatatgatgggaaagagagaaaaaaagctgggtgagtttggcaaagcaaaggggtctagggccatatggtatatgtggttaggagctcgcttcctggaatttgaggccttgggcttcctcaacgaggaccattggtttagccgtggtaatagtctgtccggggtcgaaggagagggcctacaccggcttggctacatcctgagagaagtggggaagaaagagggaggtgcgatgtacgcagatgacaccgccggctgggatacaaggattactctcgaagacctgaagaacgaggagatggtgaccaatcatatgaaaggggaacacaagaaattggctgaggccatcttcaagctgacgtatcagaacaaggtcgttcgcgtgcagcgaccaacccctcggggaacagtaatggacattatcagcagaaaagatcaaaggggctctggtcaggtggggacttacggactcaataccttcacaaacatggaagcacagcttattcgccaaatggagggcgagggcatatttaagtcaatccagcatctgactgctaccgaagagattgccgtccagaattggttagctagagtggggcgggaaaggctgagtcgtatggccatctccggagacgattgcgttgtgaaacccatcgacgatcgattcgcaagcgcgttgacggccctcaacgacatgggtaaggtccgcaaagatattcagcaatgggagccatctagaggctggaatgactggacacaggtgcccttttgctcgcaccacttccatgaactggtaatgaaggatgggcgggttctagtggtcccttgtaggaaccaggacgagcttataggacgcgctagaatctcacagggcgccggttggagcctgaaggagaccgcatgcctcgggaaatcctatgctcaaatgtggactctgatgtactttcaccggagggatttgcgattagccgcaaacgccatttgtagtgcggtgccatctcattgggtgccgacaagccgtaccacttggtccatccacgctaagcacgaatggatgaccacagaggacatgctggccgtctggaatagagtttggattcaggaaaacccctggatggaggataaaacgcctgtggaatcatgggaggaggtaccatatctcggaaagcgcgaagaccagtggtgcggcagtcttatcggcctgacctctcgggcaacttgggccaaaaatatacagacagctatcaaccaagtgaggagcctaatggggaatgagggatacaccgactatatgccctccatgaagagattccgccgggaagaggaagaggccggtgtcctgtggtga

SEQ ID NO: 14377 - RNA, 9876 nt, synthetic construct
  misc_feature 1..9876: note = derived and/or modified CDS sequence (opt3) from DENV-2__HM181971__SS-prME
  source 1..9876: mol_type = other RNA
accgcaggcgtgatcgtaatgctgattcccacagctatggcattccacctcactacgaggaacggggagcctcatatgatagttggaaggcaggaaaagggtaaaagccttctgtttaagaccgaggacggcgtgaatatgtgcacattgatggcaatcgatttaggggaactgtgtgaggacactattacctacaaatgcccactactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagacccggacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataaacttcaactgaaagggatgagctacagtatgtgtactggaaagttcaagatcgtcaaagaaatcgctgagacccagcacggcacgattgtgatcagagtacagtatgagggtgacgggtctccatgcaagattcccttcgaaataaccgatttggagaaaaggcatgttctcggccggctgatcacagtgaacccgattgtcactgaaaaggactcccctgtgaacatcgaggccgaacccccatttggagatagctacatcattgtcggcgtggagcctgggcagttaaaactgaattggttcaagaagggatcgtctataggtcaaatgtttgagaccacaatgcgaggcgctaaacgcatggccatcctaggggacactgcatgggatttcggatccctcggcggtgtttttacctcaattgggaaggccctgcaccaggtgttcggcgctatctacggagcggcatttagtggcgtaagctggacgatgaaaattcttatcggggtcataatcacatggattggaatgaactccagatctaccagcttgtcagtgagtctggttctcgtgggcgtcgtgactctgtatcttggtgccatggtacaggctgactccgggtgtatcgtgagctggaagaataaagaactgaagtgcggatctggcattttcatcacagataacgttcacacctggactgagcagtacaagtttcaacccgaatcaccaagtaaattggccagcgcaatacagaaggcccatgaggaaggtatttgtggcatcaggtccgtcacccggctcgagaatctgatgtggaaacagattacacccgagttaaaccacatcctgtctgaaaatgaggtgaagctaacgataatgaccggggacatcaaaggaattatgcaggctggcaagcgctcgctcagacctcaaccaactgaactgaaatatagctggaagacatgggggaaggccaaaatgctttccaccgagtcacataaccagacattcttgatcgatggaccggaaactgcagagtgccccaataccaacagggcgtggaatagtctggaggtggaagactacggctttggtgtcttcacgacaaacatttggctcaagctgcgtgagaaacaggacgtattttgtgattctaagttaatgagcgctgccatcaaagacaatcgggcagtgcacgccgatatggggtattggatagaatccgctctgaacgacacctggaagatggagaaggcctcattcattgaggtgaaaagctgccactggcctaagtctcatactctttggtccaatggagtattggaaagtgagatgatcatccccaagaatttcgcaggccccgtcagccagcacaactaccgacctggttatcatacccaaacagctggcccatggcacctcgggaagctggaaattgattttgacttctgtgagggaactaccgtggttgtgacagaagattgcggcaatagagggccctctctaaggacgaccactgcctccggaaaactgatcacagagtggtgctgtcgctcatgcaccctcccgcctctgcggtacagaggcgaggacggttgttggtacgggatggaaattaggccacttaaggagaaggaagagaacttggtcaatagtctggtgactgcgggacatggccagatagataactttagcttaggtgttctcggcatggccctgttccttgaagagatgctgcgcacacgagtggggaccaaacacgctatcttgctcgtagcactgtcgtttgtcacgctaattactggaaatatgtccttccgggacctgggccgtgtgatggtgatggtcggggccaccatgacagatgacatcggaatgggcgttacctatctcgctctgcttgccgcatttaaggtgagacccactttcgcggccggtttgctgttaaggaaactcacatctaaggagctgatgatggctaccattgggatcgcccttctgagccagtcaacactacctgaaactatactcgagctgaccgatgcattggctctgggaatgatggccttaaaaatcgtacgcaacatggaaaagtaccaactcgcagtgacgattatggccatcagttgcgtccccaatgctgtgattctgcagaacgcgtggaaggtttcctgtacaatccttgccgcagtgtctgtcagcccactgttgctcacctcctcacagcagaaagctgactggatacctctggccctaactattaagggcctgaatcccaccgccatctttcttacaactctcagccggaccagtaaaaagagatcttggccactgaacgaggctatcatggcagtgggcatggtttccattttggccagctcgctgctaaagaatgacataccgatgacggggcctctcgtggcgggaggtctgcttacagtctgctatgtactgaccggcaggtcagctgatttggaactcgagcgagccgcagacgtgaagtgggaggatcaagccgaaatctctgggagttcccccattctgagcatcactatttctgaggacggaagcatgtccatcaaaaacgaagaggaggaacagacactaaccatactgatccgcactggccttctcgttatttcaggtgtgttcccagtcagtatccccattacagctgcagcctggtacctgtgggaggtgaagaagcagcgggcgggggtattgtgggatgtgcctagcccaccccctgtcggaaaagctgaattagaggacggcgcctatagaatcaagcagaggggcatactggggtactctcaaattggagccggtgtttataaagaaggcacctttcacacgatgtggcatgtgactcgtggggcagtgctcatgcaccgcggaaagcggatcgagccgtcctgggctgatgtcaaaaaggacctgatctcatacggcggtgggtggaaacttgagggagaatggaaagagggcgaagaggtgcaggttctggccttggaaccaggcaagaatcccagagcagtacagaccaaacctgggattttcaagacaaacaccggaacaatcggtgctgtgagtctagattttagcccaggcacttccgggtctcccatagtcgacaggaaaggaaaggtggttggcctgtacggtaatggggtggtcacccgatcgggagcctatgtgagcgcgattgcccagacggagaagtcaatcgaggataaccctgaaattgaggacgatatcttccggaaaaagcgcctcacaataatggacctgcatccgggcgcaggcaaaactaagagataccttcccgctattgtaagggaagccatcaaacgggggttacgaaccctgatcctcgctccaacaagagtcgtggcagccgagatggaagaggccttgcgcggactgcctattaggtatcaaacccccgctatccgtgcggagcacactggtcgggaaattgttgacctcatgtgtcatgcaaccttcacaatgagactgctttccccagtgagggtccctaactacaatctgataatcatggatgaggcccactttacggaccccgctagtattgccgcacgcggctatatctctactcgagtggaaatgggggaggccgctggaatcttcatgaccgcgacaccaccgggcagcagagatccttttccccagtccaacgccccaattatggacgaggaacgggagatacccgaaaggtcatggaactctggtcacgagtgggttaccgatttcaaggggaagactgtgtggtttgtccctagcatcaaagcaggaaacgacattgctgcctgcttgcgcaagaatggcaaaaaggtgatccagctaagtcgtaaaacattcgattccgaatacgtaaagaccagagcaaacgactgggattttgtggttacgactgacattagcgagatgggcgccaatttcaaggctgagcgggtcatcgatccaaggcgctgtatgaaacccgtgatactgacagacggggaagaacgagtgatcctcgccggacctatgccggtcacccattcttcagcggcacaaagacggggtaggattggccgcaacccaaagaatgaaaacgaccagtatatctacatgggggagcccttagaaaatgatgaggactgcgcccactggaaagaggctaagatgctgcttgataacattaatacccctgaaggaatcataccctccatgtttgagccagaaagagagaaagtagacgccattgatggcgaatacaggctgcggggtgaggctcgtaagactttcgtggacctcatgcgccgaggggatttgcctgtttggctggcatataaagtggccgctgagggcatcaactacgccgacagaaagtggtgttttgatggaattaagaataaccagatcctcgaagagaacgtcgaagtggagatatggacaaaagagggcgaaaggaagaaactgaagccccggtggcttgacgcacgcatctatagtgatccactagcgctgaaagagttcaaggagttcgccgctgggagaaagagcttgaccttaaatctgattacagagatgggaaggctccctacttttatgacgcagaaagcccggaacgcactggacaatcttgctgttctgcataccgccgaagtgggtggcaaggcatacacacacgccctctcggagttgccggagactctggaaaccctactgctccttacactgttagctgcggtcaccgggggaatcttcttgtttctgatgtctggcaaaggtattgggaagatgactctcggcatgtgctgcatcataacggcctccattctgctttggtatgcacaaatccagccccactggatcgctgccagcattatcctggagttctttctcatagtgttgctgattccagaacctgagaaacagcgaaccccacaggataaccaattaacatacgtagtgatcgccattctaactgttgtcgcagctaccatggccaatgaaatgggattcctggagaagacaaagaaagacctcggctttgggtcaatcaccactcaggagagtgaatctaacatacttgacatcgatctgagaccagcgtccgcttggacattgtatgccgtggcaacgaccttcgtgactcctatgctgcgccatagcattgaaaattcaagtgtcaacgttagcctcacagccatcgctaatcaggcaaccgtgctgatgggacttggtaagggctggcccctctccaaaatggacattggggtaccgctgttggccatcggatgttactctcaggtgaacccaattaccctgacagcggctttactactgctcgtcgcccactacgcaatcataggccctggtcttcaagccaaggctactagggaagcccagaaacgggcagctgccgggattatgaagaatcccacggtggatggcatcaccgttatcgacctggagccaattccctatgatcctaagtttgaaaaacagttgggacaggtgatgctgctcatactgtgcgtcacacaagtacttatgatgcgtactacctgggcgttatgtgaggccctgacactcgcaaccggcccgatcagcactttgtgggaggggaaccccggaagattctggaatacgacaattgctgtgtccatggccaacatctttaggggctcatacctggccggtgctgggctactgttctctattatgaagaataccactaacacccgccggggaacaggcaatgttggtgaaactctcggcgagaaatggaagagtcgacttaacgccctggggaaatcggaatttcagatctataagaaaagcggaatacaggaggtggacagaaccttggccaaggagggcatcaagagaggggaaacagatcatcacgcggtctcccgcggatctgctaaactgcggtggttcgtggagagaaacatggtcacgccagaaggcaaggtggttgacctcggttgcgggcgtggaggctggtcatactattgtggtggcctgaaaaatgtgagggaggtaaaggggttaaccaaaggaggccctgggcatgaggaacccattcctatgagcacttacggatggaaccttgtgcggctgcaatccggcgtcgatgttttctttacaccacccgagaagtgcgacaccctcctatgtgatatcggtgaaagttctcctaatccaactattgaggcagggcgcacactgcgagtgttgaacctggtcgaaaattggctcaacaataacacccagttctgcatcaaggtgcttaatccctatatgccgagcgtaatagagaaaatggaaacgctgcagagaaagtacggaggcgccttggtgaggaaccctctgtcaagaaattccacccacgagatgtactgggttagtaacgctacaggcaatattgtgagctctgtcaacatgatctcccgcatgctcatcaatagatttactatgaaacacaagaaagccacctatgagccagacgtggatttagggtcaggaacaaggaacattggtatagaaagcgagatccccaacctggacattatcggcaagcgaattgaaaagatcaaacaggagcatgaaacttcgtggcactacgaccaagatcatccttataagacctgggcataccacgggtcttatgagacaaaacagaccggaagtgcctccagcatggtcaatggcgtggttcggcttctgactaagccatgggacgtagtgcccatggtcacgcagatggctatgacagataccactccgttcggtcagcaacgtgtgtttaaagagaaggttgacaccagaacacaggaacctaaggaggggacgaaaaagctaatgaaaataaccgcggaatggctctggaaggagctgggaaaagagaagactccccgcatgtgtacaagggaagagttcacccggaaagtgagatcaaacgccgcattgggcgctgtctttactgatgaaaataagtggaagtccgcccgcgaggcagtggaagacggcaggttctgggagctggtagatcgagagcggaacctccaccttgaagggaaatgcgagacatgtgtgtacaatatgatgggaaagagagagaaaaagctgggtgagtttggcaaagccaaggggtctagggctatctggtatatgtggttaggagcccgcttcctggaatttgaggcgttgggcttcctcaacgaggaccattggtttagccgtggtaatagtctgtccggggttgaaggagagggcctacaccggcttggctacattctgagagaagtcgggaagaaagagggaggtgcaatgtacgccgatgacaccgctggctgggatacaaggatcactctcgaagacctgaagaacgaggagatggtgaccaatcatatgaaaggggaacacaagaaattggccgaggcaattttcaagctgacgtatcagaacaaggtggtccgcgttcagcgaccaacccctcggggaacagtgatggacatcattagcagaaaagatcaaaggggctctggtcaggtagggacttacggactcaataccttcacaaacatggaagctcagcttatacgccaaatggagggcgagggcatctttaagtcaattcagcatctgactgccaccgaagagatcgctgtgcagaattggttagccagagtcgggcgggaaaggctgagtcgtatggcaatctccggagacgattgcgtggttaaacccattgacgatcgattcgcgagcgccttgacggctctcaacgacatgggtaaggtgcgcaaagatatacagcaatgggagccatctagaggctggaatgactggacacaggtccccttttgctcgcaccacttccatgaactggtgatgaaggatgggcgggtcttagttgtgccttgtaggaaccaggacgagcttatcggacgcgccagaatttcacagggcgcaggttggagcctgaaggagaccgcttgcctcgggaaatcctatgcccaaatgtggactctgatgtactttcaccggagggatttgcgattagcagccaacgcgatctgtagtgctgtcccatctcattgggtgccgacaagccgtaccacttggtccattcacgccaagcacgaatggatgaccacagaggacatgctggcagtgtggaatagagtctggatccaggaaaacccctggatggaggataaaacgcctgttgaatcatgggaggaggtgccatatctcggaaagcgcgaagaccagtggtgcggcagtcttataggcctgacctctcgggccacttgggctaaaaatatccagacagccattaaccaagtaaggagcctaatggggaatgagggatacaccgactatatgccctccatgaagagattccgccgggaagaggaagaggccggtgtgctgtggtga

SEQ ID NO: 14378 - RNA, 9876 nt, synthetic construct
  misc_feature 1..9876: note = derived and/or modified CDS sequence (opt3) from DENV-2__GU131881__SS-prME
  source 1..9876: mol_type = other RNA
accgcaggcgtgatcgtaatgctgattcccacagctatggcattccacctcactacgaggaacggggagcctcatatgatagttggaaggcaggaaaagggtaaaagccttctgtttaagaccgaggacggcgtgaatatgtgcacattgatggcaatcgatttaggggaactgtgtgaggacactattacctacaaatgcccactactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataaacttcaactgaaagggatgagctacagtatgtgtactggaaagttcaagatcgtcaaagaaatcgctgagacccagcacggcacgattgtgatcagagtacagtatgagggtgacgggtctccatgcaagattcccttcgaaataaccgatttggagaaaaggcatgttctcggccggctgatcacagtgaacccgattgtcactgaaaaggactcccctgtgaacatcgaggccgaacccccatttggagatagctacatcattgtcggcgtggagcctgggcagttaaaactgaattggttcaagaagggatcgtctataggtcaaatgtttgagaccacaatgcgaggcgctaaacgcatggccatcctaggggacactgcatgggatttcggatccctcggcggtgtttttacctcaattgggaaggccctgcaccaggtgttcggcgctatctacggagcggcatttagtggcgtaagctggacgatgaaaattcttatcggggtcataatcacatggattggaatgaactccagatctaccagcttgtcagtgagtctggttctcgtgggcgtcgtgactctgtatcttggtgccatggtacaggctgactccgggtgtatcgtgagctggaagaataaagaactgaagtgcggatctggcattttcatcacagataacgttcacacctggactgagcagtacaagtttcaacccgaatcaccaagtaaattggccagcgcaatacagaaggcccatgaggaaggtatttgtggcatcaggtccgtcacccggctcgagaatctgatgtggaaacagattacacccgagttaaaccacatcctgtctgaaaatgaggtgaagctaacgataatgaccggggacatcaaaggaattatgcaggctggcaagcgctcgctcagacctcaaccaactgaactgaaatatagctggaagacatgggggaaggccaaaatgctttccaccgagtcacataaccagacattcttgatcgatggaccggaaactgcagagtgccccaataccaacagggcgtggaatagtctggaggtggaagactacggctttggtgtcttcacgacaaacatttggctcaagctgcgtgagaaacaggacgtattttgtgattctaagttaatgagcgctgccatcaaaaataaccgggcagtgcacgccgacatggggtattggatagaatccgctctgaatgatacctggaagatggagaaggcctcattcattgaggtgaaaagctgccactggcctaagtctcatactctttggtccaacggagtattggaaagtgagatgatcatccccaagaacttcgcaggccccgtcagccagcacaattaccgacctggttatcatacccaaacagctggcccatggcacctcgggaagctggaaatggactttgatttctgtgagggaactaccgtggttgtgacagaagactgcggcaacagagggccctctctaaggacgaccactgcctccggaaaactgattacagagtggtgctgtcgctcatgcaccctcccgcctctgcggtacagaggcgaggatggttgttggtacgggatggaaatcaggccacttaaggagaaggaagagaatttggtcaacagtctggtgactgcgggacatggccagattgacaattttagcttaggtgttctcggcatggccctgttccttgaagagatgctgcgcacacgagtggggaccaaacacgctatattgctcgtagcactgtcgtttgtcacgctaatcactggaaacatgtccttccgggatctgggccgtgtgatggtgatggtcggggccaccatgacagacgatattggaatgggcgttacctatctcgctctgcttgccgcatttaaggtgagacccactttcgcggccggtttgctgttaaggaaactcacatctaaggagctgatgatggctaccatcgggattgcccttctgagccagtcaacactacctgaaactatcctcgagctgaccgacgcattggctctgggaatgatggccttaaaaatagtacgcaatatggaaaagtaccaactcgcagtgacgatcatggccattagttgcgtccccaacgctgtgatcctgcagaatgcgtggaaggtttcctgtacaattcttgccgcagtgtctgtcagcccactgttgctcacctcctcacagcagaaagctgattggatccctctggccctaactataaagggcctgaaccccaccgccatttttcttacaactctcagccggaccagtaaaaagagatcttggccactgaatgaggctatcatggcagtgggcatggtttccatcttggccagctcgctgctaaagaacgacattccgatgacggggcctctcgtggcgggaggtctgcttacagtctgctatgtactgaccggcaggtcagctgacttggaactcgagcgagccgcagatgtgaagtgggaggaccaagccgaaatatctgggagttcccccatcctgagcattactatctctgaggatggaagcatgtccattaaaaatgaagaggaggaacagacactaaccatcctgatacgcactggccttctcgttatctcaggtgtgttcccagtcagtattcccatcacagctgcagcctggtacctgtgggaggtgaagaagcagcgggcgggggtattgtgggacgtgcctagcccaccccctgtcggaaaagctgaattagaggatggcgcctatagaattaagcagaggggcatcctggggtactctcaaataggagccggtgtttataaagaaggcacctttcacacgatgtggcatgtgactcgtggggcagtgctcatgcaccgcggaaagcggattgagccgtcctgggctgacgtcaaaaaggatctgatctcatacggcggtgggtggaaacttgagggagaatggaaagagggcgaagaggtgcaggttctggccttggaaccaggcaagaaccccagagcagtacagaccaaacctgggatcttcaagacaaataccggaacaattggtgctgtgagtctagactttagcccaggcacttccgggtctcccatcgtcgataggaaaggaaaggtggttggcctgtacggtaacggggtggtcacccgatcgggagcctatgtgagcgcgatagcccagacggagaagtcaattgaggacaaccctgaaatcgaggatgacattttccggaaaaagcgcctcacaatcatggatctgcatccgggcgcaggcaaaactaagagataccttcccgctatagtaagggaagccattaaacgggggttacgaaccctgatcctcgctccaacaagagtcgtggcagccgagatggaagaggccttgcgcggactgcctatcaggtatcaaacccccgctattcgtgcggagcacactggtcgggaaatcgttgacctcatgtgtcatgcaaccttcacaatgagactgctttccccagtgagggtccctaattacaacctgattataatggacgaggcccactttacggatcccgctagtatcgccgcacgcggctatatttctactcgagtggaaatgggggaggccgctggaatcttcatgaccgcgacaccaccgggcagcagagacccttttccccagtccaatgccccaatcatggatgaggaacgggagattcccgaaaggtcatggaactctggtcacgagtgggttaccgacttcaaggggaagactgtgtggtttgtccctagcataaaagcaggaaatgatatcgctgcctgcttgcgcaagaacggcaaaaaggtgattcagctaagtcgtaaaacattcgactccgaatacgtaaagaccagagcaaatgattgggactttgtggttacgactgatatcagcgagatgggcgccaacttcaaggctgagcgggtcattgacccaaggcgctgtatgaaacccgtgatcctgacagatggggaagaacgagtgatactcgccggacctatgccggtcacccattcttcagcggcacaaagacggggtaggatcggccgcaatccaaagaacgaaaatgaccagtatatttacatgggggagcccttagaaaacgacgaggattgcgcccactggaaagaggctaagatgctgcttgacaatatcaacacccctgaaggaattatcccctccatgtttgagccagaaagagagaaagtagatgccatagacggcgaatacaggctgcggggtgaggctcgtaagactttcgtggatctcatgcgccgaggggacttgcctgtttggctggcatataaagtggccgctgagggcattaattacgccgatagaaagtggtgttttgacggaatcaagaacaaccagattctcgaagagaatgtcgaagtggagatctggacaaaagagggcgaaaggaagaaactgaagccccggtggcttgatgcacgcatatatagtgacccactagcgctgaaagagttcaaggagttcgccgctgggagaaagagcttgaccttaaacctgatcacagagatgggaaggctccctacttttatgacgcagaaagcccggaatgcactggataaccttgctgttctgcataccgccgaagtgggtggcaaggcatacacacacgccctctcggagttgccggagactctggaaaccctactgctccttacactgttagctgcggtcaccgggggaattttcttgtttctgatgtctggcaaaggtatcgggaagatgactctcggcatgtgctgcattatcacggcctccatactgctttggtatgcacaaattcagccccactggatcgctgccagcatcattctggagttctttctcatcgtgttgctgataccagaacctgagaaacagcgaaccccacaggacaatcaattaacatacgtagtgattgccatcctaactgttgtcgcagctaccatggccaacgaaatgggattcctggagaagacaaagaaagatctcggctttgggtcaattaccactcaggagagtgaatctaatatccttgacatagacctgagaccagcgtccgcttggacattgtatgccgtggcaacgaccttcgtgactcctatgctgcgccatagcatcgagaactcaagtgtcaatgttagcctcacagccattgctaaccaggcaaccgtgctgatgggacttggtaagggctggcccctctccaaaatggatatcggggtaccgctgttggccattggatgttactctcaggtgaatccaatcaccctgacagcggctttactactgctcgtcgcccactacgcaattatcggccctggtcttcaagccaaggctactagggaagcccagaaacgggcagctgccgggataatgaagaaccccacggtggacggcattaccgttatcgatctggagccaatcccctatgaccctaagtttgaaaaacagttgggacaggtgatgctgctcattctgtgcgtcacacaagtacttatgatgcgtactacctgggcgttatgtgaggccctgacactcgcaaccggcccgataagcactttgtgggaggggaatcccggaagattctggaacacgacaatcgctgtgtccatggccaatatttttaggggctcatacctggccggtgctgggctactgttctctatcatgaagaacaccactaatacccgccggggaacaggcaacgttggtgaaactctcggcgagaaatggaagagtcgacttaacgccctggggaaatcggaatttcagatttataagaaaagcggaatccaggaggtggatagaaccttggccaaggagggcataaagagaggggaaacagaccatcacgcggtctcccgcggatctgctaaactgcggtggttcgtggagagaaatatggtcacgccagaaggcaaggtggttgatctcggttgcgggcgtggaggctggtcatactattgtggtggcctgaaaaacgtgagggaggtaaaggggttaaccaaaggaggccctgggcatgaggaacccatccctatgagcacttacggatggaatcttgtgcggctgcaatccggcgtcgacgttttctttacaccacccgagaagtgcgataccctcctatgtgacattggtgaaagttctcctaacccaactatcgaggcagggcgcacactgcgagtgttgaatctggtcgaaaactggctcaataacaatacccagttctgcattaaggtgcttaacccctatatgccgagcgtaatcgagaaaatggaaacgctgcagagaaagtacggaggcgccttggtgaggaatcctctgtcacggaactccacccacgagatgtactgggttagtaatgctacaggcaacatagtgagctctgtcaatatgatttcccgcatgctcatcaacagatttactatgaaacacaagaaagccacctatgagccagatgtggacttagggtcaggaacaaggaacatcggtattgaaagcgagatacccaatctggatatcattggcaagcgaatcgaaaagattaaacaggagcatgaaacttcgtggcactacgaccaagaccatccttataagacctgggcataccacgggtcttatgagacaaaacagaccggaagtgcctccagcatggtcaacggcgtggttcggcttctgactaagccatgggatgtagtgcccatggtcacgcagatggctatgacagacaccactccgttcggtcagcaacgtgtgtttaaagagaaggttgataccagaacacaggaacctaaggaggggacgaaaaagctaatgaaaatcaccgcggaatggctctggaaggagctgggaaaagagaagactccccgcatgtgtacaagggaagagttcacccggaaagtgagatcaaatgccgcattgggcgctgtctttactgacgaaaacaagtggaagtccgcccgcgaggcagtggaagatggcaggttctgggagctggtagaccgagagcggaatctccaccttgaagggaaatgcgagacatgtgtgtacaacatgatgggaaagagagagaaaaagctgggtgagtttggcaaagccaaggggtctagggctatatggtatatgtggttaggagcccgcttcctggaatttgaggcgttgggcttcctcaatgaggatcattggtttagccgtggtaacagtctgtccggggttgaaggagagggcctacaccggcttggctacatcctgagagaagtcgggaagaaagagggaggtgcaatgtacgccgacgataccgctggctgggacacaaggattactctcgaagatctgaagaatgaggagatggtgaccaaccatatgaaaggggaacacaagaaattggccgaggcaatcttcaagctgacgtatcagaataaggtggtccgcgttcagcgaccaacccctcggggaacagtgatggacattatcagcagaaaagaccaaaggggctctggtcaggtagggacttacggactcaacaccttcacaaatatggaagctcagcttattcgccaaatggagggcgagggcatatttaagtcaatccagcatctgactgccaccgaagagattgctgtgcagaactggttagccagagtcgggcgggaaaggctgagtcgtatggcaatctccggagatgactgcgtggttaaacccatcgatgaccgattcgcgagcgccttgacggctctcaatgatatgggtaaggtgcgcaaagacattcagcaatgggagccatctagaggctggaacgattggacacaggtccccttttgctcgcaccacttccatgaactggtgatgaaggacgggcgggtcttagttgtgccttgtaggaaccaggatgagcttataggacgcgccagaatctcacagggcgcaggttggagcctgaaggagaccgcttgcctcgggaaatcctatgcccaaatgtggactctgatgtactttcaccggagggacttgcgattagcagccaatgcgatttgtagtgctgtcccatctcattgggtgccgacaagccgtaccacttggtccatccacgccaagcacgaatggatgaccacagaggatatgctggcagtgtggaacagagtctggattcaggaaaatccctggatggaggacaaaacgcctgttgaatcatgggaggaggtgccatatctcggaaagcgcgaagatcagtggtgcggcagtcttatcggcctgacctctcgggccacttgggctaaaaacatacagacagccatcaatcaagtaaggagcctaattgggaacgagggatacaccgactatatgccctccatgaagagattccgccgggaagaggaagaggccggtgtgctgtggtga

SEQ ID NO: 14379 - RNA, 9876 nt, synthetic construct
  misc_feature 1..9876: note = derived and/or modified CDS sequence (opt3) from DENV-2__FJ898461__SS-prME
  source 1..9876: mol_type = other RNA
accgccggcgtgatagtcatgctgattcccacagctatggctttccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttcagactaccgttcgaggcgctaaacgcatggccattctaggggacacagcatgggatttcggatccctcggcggtgtgtttacttcaatcgggaaggccctgcaccaggtattcggcgctatttacggagcggcatttagtggcgtcagctggaccatgaaaatccttataggggtgatcattacgtggatcggaatgaactccagatctactagcttgtcagttagtctggtgctcgtcggcgtggtaaccctgtatcttggtgccatggtgcaggctgactccgggtgtgttgtcagctggaagaataaagagctgaagtgcggatctggcattttcatcactgataacgtgcacacatggaccgaacaatacaagtttcagcccgagtcaccaagtaaattggccagcgcaatacagaaggcccatgaagagggtatttgtggcatcaggtccgtgactcggctcgaaaatctgatgtggaaacagattacccccgagttaaaccacatcctgtctgagaatgaagtcaagctaacaataatgacgggggacatcaaaggaattatgcaagctggcaagcgctcgctcagacctcagccaaccgagctgaaatatagctggaagacttgggggaaggccaaaatgctttccacagaatcacataaccagaccttcttgatcgatggaccggagacagcagaatgccccaatactaacagggcgtggaatagtctggaggttgaggactacggctttggtgtgttcaccacgaacatttggctcaagctgcgtgaaaaacaggacgtgttttgtgattctaagttaatgagcgctgccatcaaagacaatcgggcagtacacgccgatatggggtattggatagagtccgctctgaacgacacatggaagatggaaaaggcctcattcattgaggtcaaaagctgccactggcctaagtctcataccctttggtccaatggagtgttggagagtgaaatgatcatccccaagaatttcgcaggccccgttagccaacacaactaccgacctggttatcatactcagaccgctggcccatggcacctcgggaagctggagatggattttgacctatgtgaaggaacaactgtggtcgtgaccgaggattgcggcaatagagggccctctctgaggacaacgaccgcctccggaaaactcattactgaatggtgctgtcgctcatgcacactgccgcctcttcggtacagaggcgaggacggttgttggtacgggatggagatcaggccattgaaggaaaaggaggaaaacctggttaatagtttagtgaccgcgggacatggccagattgataacttcagcctcggtgtactgggcatggccctttttctggaggaaatgttgcgcactcgaatagggacaaaacacgctatcctcctggtcgtggtgtcgttcgtcaccctaattacgggaaatatgtcctttcgggacctgggccgtgttatggtgatggtaggggcaactatgaccgatgacatcggaatgggcgtgacatatctcgccctgcttgctgccttcaaggtcagacccacctttgcagcgggtttgctgttaaggaaactcacttctaaggagctgatgatggccacaattgggatcgcacttctgagccaatcaaccatacctgagacaatcctagaactcactgatgccctggcattgggaatgatggtgctgaaaattgttcgcaacatggagaagtaccagttagctgtgaccatcatggccattagttgcgtccccaatgcagtgatcctccagaacgcctggaaggtttcctgtacgatactggctgcggtgtctgtcagcccacttctgttgacatcctcacagcaaaaagccgactggattcctctcgcactgaccatcaagggcctaaatcccactgctatcttcctgaccacacttagccggacaagtaaaaagagatcttggccactcaacgaagccattatggccgtaggcatggtgtccatactggctagctcgttgctgaaaaatgacatcccgatgaccgggcctttagttgcaggaggtctcctgacggtgtgctatgtccttacaggcaggtcagccgatctggagttggaacgagcggctgacgtgaagtgggaggatcaggccgagatttctgggagttcccccatcctcagcattaccatctctgaagacggaagcatgtccatcaaaaacgaggaagaggagcagactctgacaatcctaattcgcaccggcctgcttgtaatctcaggtgtgtttccagtcagtattcccatcactgcagccgcttggtacctctgggaagttaagaagcagcgggcaggggtgctgtgggatgtgcctagcccaccccctgtcgagaaagccgaattggaggacggagcgtatagaataaagcaaaggggcattttaggctactctcagatcggggctggagtgtataaagaaggtacattccacaccatgtggcatgttacgcgtggcgccgtactgatgcaccgcgggaagcggatcgagccgtcctgggcagatgtgaaaaaggacctcatttcatacggaggcggttggaagctggagggggaatggaaagagggagaagaggtccaggtgcttgccctggaaccaggcaagaatcccagagctgttcagactaaacctggcatctttaagaccaacacagggaccataggagccgtgagtttggatttcagcccaggtacatccggctctcccattgtcgacaggaaagggaaggtggtaggactatacggcaatggtgtcgtgactcgatcgggggcatatgttagcgctatcgcccaaaccgagaagtcaattgaggataaccctgaaatcgaggacgatatatttcggaaaaagcgcctgacgattatggacctccatccgggagcgggcaaaacaaagagatacctgcccgccatcgtgagggaagcaatcaaacggggccttcgaactttaattctggctccaaccagagtcgtggccgctgagatggaagaggcactccgcgggttgcctatcaggtatcagacacccgccattaagaccgagcacactggacgtgaaatagttgacctgatgtgtcatgccaccttcacaatgcggctcctgtccccagtgagagtccctaactacaatcttatcattatggatgaggctcacttcacggaccccgcgagtatcgcagccaggggttatatctctactcgcgtggaaatgggcgaggctgccgggatttttatgaccgcaacaccaccgggaagccgagatcctttcccccagtccaacgccccaataatggacgaggaaagagagatccccgaacggtcatggaactctggccacgagtgggtaaccgattttaagggtaaaactgtgtggttcgttcctagcattaaggctgggaacgacatcgcggcctgcctgaggaaaaatggaaagaaagtcattcaattgagtcgcaagacatttgattccgaatacgtgaagacccgtgcaaacgactgggatttcgtggtcacgactgacatcagcgagatgggcgctaattttaaagccgagagagtaatagatccacggaggtgtatgaagcccgtgatcctaacagacggcgaagaacgcgttattctggcagggcctatgccggtgacccattcttcagccgctcagcgaagaggacggatcggtaggaaccccaaaaatgaaaacgaccagtatatttacatgggcgagcccctcgaaaatgatgaggactgcgcccactggaaggaggcgaaaatgttactggataacatcaatacccctgaagggataattccctccatgttcgagccagaacgcgagaaggtcgacgcaatcgatggagaatacagacttaggggcgaggcccggaaaacttttgtggacctgatgcgtcgcggtgatctccctgtttggttggcttataaggtggccgctgaggggattaactacgcagaccgaaagtggtgtttcgatggcatcaaaaataaccagatactggaagagaacatggaagtcgagatctggacaaaggagggagaaaggaaaaagctcaaacccagatggctggacgcccggatttatagtgatccacttgctctaaaggagtttaaggagttcgccgcaggccgcaaaagcctgaccttgaatttaatcacagagatggggagactgcctactttcatgacgcaaaaggcgaggaacgccctcgacaatctggctgtgcttcataccgccgaagcaggaggtcgggcttacaaccacgccctgtcggagctcccggagacattggaaactctgctactgctcacccttctggcaacagtaaccggcgggatatttttattcttgatgtctggaaaaggcatcggtaagatgactctggggatgtgctgcataattacggcctccatcctcctgtggtatgctcagatccagccccactggattgcggccagcatcatacttgagtttttcctgattgtgctcttgatcccagaacctgagaaacagcgaaccccacaagataatcagctgacatacgttgtcattgcaatcttaactgtggtggctgccaccatggccaacgaaatgggctttctagagaagacaaagaaagacctgggactcggctcaataaccactcaggagccagaaagtaatatccttgacattgatctgagacctgcatctgcttggacattgtatgccgtcgcgacgaccttcgttactcccatgctgcgccattccatcgagaacagctcagtgaatgtaagtctcacagctattgccaaccaggcaaccgtgctgatggggcttggaaagggttggccgctcagcaaaatggacatcggcgtcccactgttggccattgggtgttactcccaagtgaatcctatcaccctgacagctgcattactactgctcgttgcccactacgcgataattggacccggccttcaggctaaggccactagggaagcacagaaacgggccgctgccggtatcatgaagaacccaacggtggatgggatcaccgtcattgacctggagcccataccttatgatccgaagtttgaaaaacagttgggccaagtaatgctgctcatcctgtgcgtgacacaggttcttatgatgcgtactacctgggcattatgtgaggctctgacactcgccaccggacccatttctactttgtgggagggcaatccagggagattctggaacacgacaatcgcggtgagcatggccaatatttttaggggatcctacctggcaggcgctggtctactgttctcaatcatgaagaacaccactaatacccgccgggggacaggaaacataggcgaaactctcggtgagaaatggaagtctcgacttaacgccctgggcaaaagtgaatttcagatctataagaaatcggggattcaagaggtcgacagaaccttggcaaaggagggaatcaagaggggcgaaacagatcatcacgctgtgagccgcgggtccgccaaactgcggtggttcgtcgagagaaatatggtgacgcctgaaggaaaggttgtggacctcggctgcggtcgtgggggatggtcttactattgtggcggtctgaaaaacgtaagggaggtgaagggcttaaccaaagggggacccggccatgaagaacctattccaatgtcaacttacgggtggaatcttgtccggctgcagagcggagttgatgtgtttttcacaccccctgagaagtgcgacaccctcctatgtgatatcggcgaatccagtccaaaccccactatagaggccggtcgcacactgcgagtcttgaatctggtggaaaactggctcaataacaatacccagttctgcattaaggtacttaacccgtatatgccttctgtgatcgagaaaatggaaacgctgcagagaaagtacgggggagcgttggttaggaatccactgagccggaactcaacccacgagatgtactgggtgtccaatgctacaggcaacatcgtcagtagcgtgaatatgatttctcgcatgctcataaacagatttactatgaaacacaagaaagcaacctatgagcccgacgtcgatttaggctccgggacaaggaacatcggaattgaatcagagatccctaatctggacattatcggtaagcgaatagaaaagatcaaacaagagcatgaaactagctggcactacgaccaggatcatccatataagacctgggcctaccacggctcgtatgagacaaaacagaccgggtctgctagttccatggtgaacggagttgtacggcttctgactaagccctgggacgtggtcccgatggtgacgcagatggccatgacagataccactcctttcggccaacagcgtgtttttaaagagaaggtggacaccagaacacaggaacccaaggagggtacgaaaaagctaatgaaaattaccgcagaatggctctggaaggagctggggaaaaagaaaactccacgcatgtgtacaagggaggagttcacccggaaggtcagaagcaatgccgctttgggagcgatctttactgatgagaacaagtggaaatcagcccgcgaagcagtggaggacggcaggttctgggaactggtagatcgagagcggaatctccaccttgagggcaagtgcgaaacatgtgtgtacaacatgatggggaaaagagagaagaaactgggagaatttggtaaggctaagggctccagggccatttggtatatgtggttaggggcacgcttcctggagtttgaagccttgggattcctcaatgaggaccattggttttctcgtggcaacagcctgagtggtgttgagggggaaggactacaccggcttggctacatcctgagagatgtcggcaaaaaggaagggggagctatgtacgccgacgataccgcgggttgggacacaaggattactctcgaagacctgaaaaatgaggaaatggtgaccaaccatatgaagggcgagcacaaaaagttggcagaggccatattcaagctgacgtatcagaataaagtggtccgcgttcaacgacctaccccacgggggacagtgatggatatcatttccagaagggaccagcgcggaagcggccaggtaggtacttacgggctcaacacctttacaaatatggaagctcaacttatcagacagatggagggagaaggcatcttcaagtctattcagcatctgactgccaccgaggagatagcagtgcagaactggttagctcggctgggcagggaacgtttgtcacgaatggccatcagtggggatgactgcgtcgtgaaaccaattgatgaccgcttcgcttccgccctcacggcactgaatgatatgggaaaggttagaaaagacatccaacagtgggagcccagccggggttggaacgattggacacaggtgcctttttgctctcaccacttccatgagctagtcatgaaggacggcagggtgcttgtagttccatgtcgcaaccaggatgagctgattgggagagcgcggatctcgcaaggagccggctggtcactcaaggaaaccgcttgcctgggtaaaagctatgcccagatgtggactttgatgtactttcacaggcgagacttacgtctggcagctaatgccatatgttccgcagtgccgagtcattgggtccccacatctagaaccacttggagcatccacgccaagcacgagtggatgaccacagaggatatgctcgcggtgtggaaccgcgtgtggattcaggaaaatccttggatggaggacaaaacgccagtcgaatcctgggaggaagttccctatcttgggaagcgggaggaccagtggtgcggatcactgatcggcctaaccagtagggctacttgggccaaaaacattcaaacagcaatcaatcaggtgagatctctgataggcaacgaggaatacaccgattatatgcctagcatgaagcgcttccggagggaggaagaggaagccggggtactctggtga

SEQ ID NO: 14380 - RNA, 9876 nt, synthetic construct
  misc_feature 1..9876: note = derived and/or modified CDS sequence (opt3) from DENV-2__FJ024473__SS-prME
  source 1..9876: mol_type = other RNA
accgccggcgtgatcgtcatgctgattccaacagctatggcattccacctcactacgagaaatggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggacttctaacagggattttgtcgaaggagtgtcgggtggctcatgggtagacatagttctcgagcacgggagctgtgtgacaaccatggctaagaataagcccacgttagatttcgaactgattaaaaccgaggccaagcagcctgcgacacttcggaaatattgcatcgaagcaaagttgactaacaccacaactgagagtcgctgtccaacccaaggagagccctccctgaatgaagaacaggacaaacgatttatttgcaagcattctatggtcgatagaggctggggtaacgggtgtggactattcggcaagggcgggatcgtgacatgcgccatgtttacctgcaaaaagaatatggaaggaaaagtggtccagcctgagaacctcgaatacactatcgttattacgccacacagcggtgaggagcatgctgtgggcgacgatacagggaagcacggaaaagaaataaagatcaccccgcagtcctcaattactgaggccgaactgaccggctatggtacagtaaccatggagtgtagtcccaggactgggcttgacttcaatgaaatggtgctgttgcaaatggaggataaagcatggctcgtccaccggcagtggtttctggacttacctctgccatggctccccggcgctgacacacagggaagcaactggatccagaaggagacgcttgtgaccttcaagaatcctcatgccaaaaagcaagatgttgtggtcctgggctctcaggaaggggcgatgcacactgccttgacaggagcaaccgagatacagatgtcctcaggtaacctactgtttacaggccatctcaaatgccgtctgcgcatggacaaacttcaactgaaagggatgagctacagtatgtgtactggaaagttcaagattgtgaaagaaatcgctgagacccagcacggcacgatcgtaattagagttcagtatgagggtgatgggtctccatgcaagatccccttcgaaattaccgacttggagaaaaggcatgtgctcggccggctgataacagtcaatccgatcgtgattgaaaaggattcccctgtcaacatcgaggccgaacccccatttggagacagctacatcattataggcgtggagcctgggcagttaaaactgaactggttcaagaagggatcgtctatcggtcaaatgtttgagactaccatgcgaggcgctaaacgcatggccattctaggggatacagcatgggacttcggatccctcggcggtgtttttacttcaatcgggaaggccctgcaccaggtgttcggcgctatttacggagcggcatttagtggcgtaagctggaccatgaaaatccttataggggtcgtgatcacgtggattggaatgaactccagatctacgagcttgtcagttagtctggtgctcgtcggcgtggtaaccctgtatcttggtgccatggtgcaggctgattccgggtgtgttgtcagctggaagaacaaagaactgaagtgcggatctggcatcttcattactgacaatgtgcacacatggaccgagcagtacaagtttcaacccgaatcaccaagtaaattggccagcgcaatccagaaggcccatgaggaaggtatatgtggcattaggtccgtgactcggctcgagaacctgatgtggaaacagatcacccccgagttaaatcacattctgtctgaaaacgaggtcaagctaacaatcatgacgggggataccaaaggaataatgcaggctggcaagcgctatctcagacctcaaccaactgaactgaaatactcgtggaagacatgggggaaggccaaaatgcttagcaccgagtcccataatcagacattcttgatcgacggaccggaaactgcagagtgccccaacaccaatagggcgtggaactcactggaggttgaagactatggctttggtgtgttcacgacaaatatttggctcaagctgcgtgagaaacaggatgtgttttgtgacagtaagttaatgtctgctgccatcaaagataaccgggcagtacacgccgacatggggtactggattgaaagcgctctgaatgatacctggaagatggagaaggcctccttcatcgaggtcaaatcatgccactggcctaagagccatactctttggtctaacggagtgttggaatccgagatgataattcccaagaatttcgcaggccccgttagtcagcacaactatcgacctggttaccatacccaaacagctggcccatggcacctcgggaagctggaaatggactttgatttctgtgagggaactaccgtggtcgtgacagaagactgcggcaacagagggcccagcctaaggacgaccactgcctctggaaaactgatcacagagtggtgctgtcgctcctgcaccctcccgcctctgcggtacagaggcgaggatggttgttggtatgggatggaaatcaggccacttaaggagaaggaagagaatttggttaactcactggtgactgcgggacatggccagattgacaattttagtttaggtgtactcggcatggccctgttccttgaagagatgctgcgcacacgagtcgggaccaaacacgctatcttgctcgtggcagtgagctttgtcacgctgattactggaaacatgtcgttccgggatctaggccgtgttatggtgatggtaggggccaccatgacagacgatataggaatgggcgtgacctacctggctctcctggccgcatttaaggtcagacccactttcgcggccggtcttttgctgaggaaattaacatccaaggagctcatgatggctaccatcgggattacactgctttctcagagcactatccctgaaaccattctggagctaacggacgccctcgcactgggaatgatggtgttgaaaatcgttcgcaatatggaaaagtatcaactggctgtgacaataatggccatctcatgcgtccccaacgcagtgattttacggaatgcctggaaggttagttgtaccatcctcgctgcggtgtccgtctctccactgcttctgactagctcccagcagaaagccgactggattcctttggcactcaccatcaagggcctgaaccccacagctatatttctaactaccctgtcaagaacgagcaaaaagaggagttggccacttaatgaggccattatggccgtaggcatggtgtctatcctcgcttccagcctgttgaaaaacgatatcccgatgacagggcctctggttgcaggaggtttactcaccgtgtgctacgtcctgactggccgatcggccgaccttgaactggagcgcgcggctgatgtgaagtgggaggaccaggccgaaatttcagggtctagtcccatattgtccatcacaattagcgaggatggatctatgagcatcaaaaatgaagaggaggaaaccactctcacaattctgatccggaccggcctactggtaatatccggtgtgttcccagtctcaatccccattacggcagccgcttggtatctttgggaggttaagaagcaaagagcaggggtgctctgggacgtgcctagtccacccctggtcggaaaagccgaattggaggatggcgcgtacaggatcaagcagcgtggcattttagggtatagccagatcggagctggtgtgtacaaagaaggcacttttcacaccatgtggcatgttacacgcggggccgtactgatgcaccggggaaagagaatagagccttcttgggcagacgtgaaaaaggatctcatttcctacggcggtgggtggaagctggagggagaatggaaagagggcgaagaggtccaggtgcttgccctggaaccgggcaagaacccaagggctgttcaaaccaaacccgggatcttcaagacaaatactggaaccatcggtgccgtgtcattggactttagtcctggcacgagcgggtccccaattgtcgatcgaaaaggaaaggtggtaggcctatatggtaacggggtcgtgacacggtctggagcatacgtttcggctatcgcccagactgaaaagagcatagaggacaatcccgaaattgaggatgacatcttccgcaaaaagagactgaccattatggacctccatcctggcgcgggcaaaacaaagaggtatctgccggccatcgtgcgggaagcaataaaacgagggcttagaaccttaattctggctcccactcgcgtcgtggccgctgagatggaagaggcactcaggggattgccaatccgttaccagacccctgccatcaaggccgagcacacaggtcgggaaattgttgatctgatgtgtcatgctacgttcactatgagactcctgtcacccgtgagggtcccaaactataaccttatcattatggacgaggcgcactttaccgatcctgcatccatagccgctcgcggctacatcagtacacgagtggaaatgggggaggccgcaggaattttcatgaccgccactcccccaggctctagagacccgtttcctcagagcaatgctcccatcatggatgaggaacgggagatcccagaaaggtcctggaactcaggtcacgagtgggtaacagacttcaaggggaaaaccgtgtggtttgttccctctattaaggcgggaaatgatatagccgcatgcctgcgcaaaaacggcaagaaagtcatccaattgagccgtaagacgttcgacagtgaatatgtgaagactagagctaatgattgggactttgtggtcacaaccgatatttccgagatgggcgccaacttcaaagcagagcgggtaatcgaccctaggcgctgtatgaagccagtgattctaaccgacggggaagaacgagttatcctggccggacccatgcctgtgactcatagctctgctgcccagagacggggtaggataggccgcaatccgaaaaacgaaaatgatcagtacatctacatgggggagccactcgaaaacgacgaggattgcgcgcactggaaggaggcaaaaatgttactggacaatattaacacacccgaaggaatcattccttcaatgtttgagcccgaaagagagaaggtcgatgccgtggacggcgaatataggcttcggggtgaggctcgtaaaaccttcgttgatctgatgcgccgaggggacctcccagtgtggttggcctacaaggtcgctgcagagggcatcaattatgccgatagaaagtggtgttttgacggaattaaaaacaatcaaatactggaagagaacgtggaagtagagatctggacaaaggagggcgaaaggaaaaagctcaaacctcggtggctggatgctcgcatttactccgacccccttgccctaaaggagttcaaggagttcgcagcggggagaaaaagtctgactttgaacttaatcacggagatgggaaggctgccaacctttatgacacagaaggcccggaatgctctcgataacctggccgtgcttcatactgcagaagctggtggccgagcctataatcacgcactgagcgagctccctgagaccttggaaacactgctactgctcacccttctggccactgttacaggcgggatattcttatttttgatgtcggggaaaggtatcgggaagatgaccctgggcatgtgctgcattatcacagcttctgtcctcctgtggtacgcgcagattcagccgcactggatcgccgcatccataattcttgagttctttctgatcgtgctcttgatccccgaaccagagaaacaaagaactcctcaggacaaccagctgacctatgtggtcattgctatcttaacagttgtggccgccaccatggcaaatgaaatgggattcctagagaagactaagaaagacctgggcctcgggagcataacaacgcaggagtcagaaagtaacattcttgatatcgacctgcgccccgcttctgcctggaccttgtacgcggtagctactacatttgtgaccccaatgctgaggcattccattgagaatagctcagtcaacgtgagtctcaccgccatcgcaaatcaagccacagttctgatgggacttggtaagggctggcctctcagcaaaatggatataggggtgcccctgttggctatcggatgttactcccaggtcaacccgattactctgacggcagccttactactgctcgtagcgcactatgctatcattggcccaggtcttcaggccaaggcaacccgggaagcccagaaacgtgctgccgcagggatcatgaagaatcctacagtggacggcattactgttatcgatctggagcccataccatacgaccccaagttcgaaaaacaattgggacaggtgatgctgctcattctgtgcgtcacccaggtgcttatgatgagaacaacctgggctttatgtgaggccctgactctcgcgacgggccctatctctacattgtgggaggggaacccgggaaggttttggaataccactatcgccgtcagcatggcaaacattttccgcggctcctatctggctggtgccgggctactgttttcaataatgaagaataccacaaacactcggcgaggaaccggcaatatcggtgaaacactcggcgagaaatggaagtctagacttaacgcactggggaaaagtgagttccagatttacaagaaatcgggaatccaagaggtggataggacgttggctaaggagggcattaagcgcggggaaaccgaccatcacgccgttagccggggatccgccaaactgagatggtttgtggagcgtaacatggtaactcccgaaggcaaggtggtcgatctcggttgcgggaggggaggctggtcttattactgtggtggcctgaaaaatgttcgggaggtgaaggggttaacaaaaggaggcccagggcatgaggaacctatccccatgtcaacctatggatggaaccttgtccgcctgcagagcggcgtggacgtattcttcactcctccagagaagtgcgatacactcctatgtgacataggtgaatccagtcccaatcctaccatcgaggcggggcgaacgctgagagtgttgaacctggttgaaaattggctcaacaataacacccagttttgcattaaggtgcttaatccatacatgccctctgtcatcgagaaaatggaaacactgcaaaggaagtacggaggcgctttggtgcggaacccgctgagccgcaattcaactcacgagatgtattgggtctccaacgcaaccggcaatattgtgagtagcgttaacatgatctctagaatgctcataaataggttcacaatgaaacacaagaaagccacttacgaggctgatgtagacttagggtccggaacccgaaacattggtatcgaatcagagatccctaacctggacattataggcaagcggatcgaaaagattaaacaggagcatgaaacaagctggcactatgatcaggaccatccatacaagacctgggcctatcacgggtcgtacgagactaaacagacgggatctgcaagttccatggtgaatggcgtcgtgcgtcttctgacaaagccctgggatgttgtgcctatggtcacccaaatggccatgactgacaccacaccatttggtcagcagagagtgttcaaagagaaggtagatacgcgcacccaggaacccaaggaggggactaaaaagctaatgaggatcacagctgaatggctctggaaagagctgggaaagaaaaagaccccgcggatgtgtactagagaggaatttacacgcaaagtgaggagcaacgcggccttgggcgcaattttcaccgacgagaataagtggaagtcagctcgagaagccgttgaggatggccggttttgggaactggtcgacagagagaggaacctccaccttgaggggaaatgcgaaacatgtgtgtataatatgatgggaaagcgcgagaaaaagctgggtgagttcggcaaagcaaaggggtcccgtgccatctggtacatgtggttaggagctcggtttctggagttcgaagccttgggctttctcaacgaggatcattggttctctagaggtaatagcctgagtggggtggagggagaaggcctacacaggcttggctacatactgcgcgacgtcgggaagaaagagggaggtgcgatgtatgcagatgacactgccggctgggacacccgaatcacgctcgaagatctgaagaacgaggaaatggttaccaatcatatgaaaggggagcacaagaaattggctgaggccatttttaagctgacataccaaaacaaggtggtacgggtgcagagacctactcccaggggaaccgtcatggacatcatttcccgcagagatcagcggggcagcggtcaggtggggacatatggactcaatactttcaccaacatggaagcacaacttatcaggcagatggagggcgaaggcattttcaaatctatacagcatctgacggctacagaggagatcgccgctcaaaattggttagcccgtgttgggcgagaacgcctgtcaagaatggcaattagtggagacgattgcgtggtcaagccaatcgacgatcggtttgcgtccgccttgaccgctctcaacgacatgggtaaagtgaggaaggatatccagcagtgggagcctagccgcggctggaatgactggactcaggtacccttctgctctcaccactttcatgaactggttatgaaagatgggagagtgctagtcgtgccatgtcggaaccaagacgagcttattggaagggcccgaatatcgcagggcgcaggttggtcactgaaggaaacagcttgcctcggaaagagctacgcccagatgtggaccctgatgtatttccaccgtagagatttgcgcttagcagccaacgcgatctgttccgctgtgcccagtcattgggtccctacttctcggaccacatggagcattcacgccaaacacgagtggatgacgaccgaggacatgctggcagtttggaatagggtgtggatccaggaaaacccatggatggaggacaagactccggtagaatcctgggaggaagtgccctacctcggaaaaagagaggatcaatggtgcggctcacttattggcctgacaagtcgcgccacctgggctaagaatatccagactgccataaaccaggtccggtctctaatcgggaatgaggaatatacagactacatgcctagcatgaaaaggtttcgaagagaggaagaggaagcaggagtgctgtggtga

SEQ ID NO: 14381 - RNA, 9876 nt, synthetic construct
  misc_feature 1..9876: note = derived and/or modified CDS sequence (opt3) from DENV-2__FJ024474__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactcaagcaaaacgaaccggaggatatcgactgttggtgcaattccacatctacctgggtaacttatggaacatgtaccacgactggcgagcaccggcgcgaaaaacgatcagtggcgctggtcccccatgtgggtatggggcttgagacccgtacagaaacttggatgagtagcgagggagcttggaagcacgttcagagaattgagacctggatcctgaggcatcctggcttcacaataatggccgcaatcttggcctacaccattggcacgactcactttcagcgggctctcatcttcattctgctgacagcagtggccccatccatgaccatgcgctgcatcgggatatctaacagagattttgtcgaaggagtgtcgggtggctcatgggtagacattgttctcgagcacgggagctgtgtgactacaatggctaagaataaacccaccttagatttcgaactgatcaagacggaggccaaacagcctgcgacccttaggaagtattgcattgaagcaaaattgacaaacactaccacagagagtcggtgtccaactcaaggagagccctccctgaatgaagagcaggacaagcgctttatctgcaagcattctatggtcgatcgaggctggggtaacgggtgtggactattcggcaaaggcgggatcgtgacctgcgccatgtttacatgcaagaaaaatatggaaggaaaggtggtccagcctgagaacctcgaatacaccattgttataactccacacagcggtgaggagcatgctgtgggcaatgacatcgggaaacacggaaaggaaattaaaatcacgccgcagtcctcaataacagaggccgaactgaccggctatggtactgtaaccatggagtgtagtcccagaacagggcttgatttcaacgaaatggtgctgttgcaaatggaggacaaggcatggctcgtccacaggcagtggtttctggatttacctctgccatggctccccggcgctgacacccagggaagcaattggattcagaaggagactcttgtgacattcaaaaaccctcatgccaagaaacaagacgttgtggtcctgggctctcaggaaggggcgatgcacacggccttgaccggagcaactgagatccagatgtcctcaggtaatctactgtttacaggccatctcaagtgccggctgcgtatggataaacttcaactgaaggggatgagctacagtatgtgtaccggaaagttcaaaatcgtgaaggaaattgctgagacacagcacggcactatcgtaattcgcgttcagtatgagggtgacgggtctccatgcaaaatacccttcgaaatcaccgatttggagaagagacatgtgctcggcaggctgattacggtcaacccgatcgtgatcgaaaaagactcccctgtcaacattgaggccgaacccccatttggagatagctacataatcattggcgtggagcctgggcagttaaagctgaattggttcaagaaaggatcgtctatcggtcaaatgtttgagaccacaatgcggggcgctaagcgaatggccattctaggggacactgcatgggatttcggatccctcggcggtgtttttacctcaatcgggaaagccctgcaccaggtgttcggcgctatatacggagcggcatttagtggcgtaagctggacaatgaagatccttattggggtcgtgatcacttggattggaatgaactcccgctctaccagcttgtcagttagtctggtgctcgtcggcgtggtaacgctgtatcttggtgccatggtgcaggctgactccgggtgtgttgtcagctggaaaaataaggaactgaagtgcggatctggcatcttcataacagataacgtgcacacctggactgagcagtacaaatttcaacccgaatcaccaagtaagttggccagcgcaattcagaaagcccatgaggaaggtatctgtggcattagatccgtgacaaggctcgagaatctgatgtggaagcagatcacccccgagttaaaccacatactgtctgaaaatgaggtcaaactaactatcatgaccggggacacaaagggaattatgcaggctggcaaacggtatctccgccctcaaccaacggaactgaagtactcgtggaagacctgggggaaagccaagatgcttagcactgagtcccataaccagacattcttgatcgatggaccggaaaccgcagagtgccccaatacaaacagagcgtggaattcactggaggttgaagactatggctttggtgtgttcactaccaacatttggctcaaactgagggagaagcaggacgtgttttgtgatagtaaattaatgtctgctgccatcaaggacaatcgtgcagtacacgccgatatggggtactggatagaaagcgctctgaacgacacgtggaagatggagaaagcctccttcattgaggtcaagtcatgccactggcctaaaagccatacactttggtctaatggagtgttggaatccgagatgatcatcccaaagaacttcgcaggccccgttagtcagcacaactatcggcctggttaccatacccaaactgctggcccatggcacctcgggaaactggaaatggattttgacttctgtgagggaaccacagtggtcgtgactgaagattgcggcaatcgagggcccagcctaagaaccacaacggcctctggaaagctgattaccgagtggtgctgtaggtcctgcactctcccgcctctgcgctaccggggcgaggacggttgttggtatgggatggaaatcagaccacttaaggagaaagaagagaacttggttaattcactggtgacagcgggacatggccagattgataactttagtttaggtgtactcggcatggccctgttccttgaagagatgctgaggacccgcgtcgggactaagcacgctatattgctcgtggcagtgagctttgtcacactgatcaccggaaatatgtcgttccgagacctaggccgggttatggtgatggtaggggccacgatgactgatgacattggaatgggcgtgacctacctggctctcctggccgcatttaaagtccgtcccacattcgcggccggtcttttgctgagaaagttaacctccaaagagctcatgatggctactatcgggattacactgctttctcagagcaccatccctgaaacaatactggagctaactgatgccctcgcactgggaatgatggtgttgaagatcgttaggaacatggaaaagtatcaactggctgtgaccattatggccatctcatgcgtccccaatgcagtgattttacgcaacgcctggaaagttagttgtacgatcctcgctgcggcctccgtgtctccactgcttctgacaagctcccagcagaaggcagactggatacctttggctctcaccattaaaggcctgaatcccactgccatctttctaaccacactgtcacggactagcaagaaaagaagttggccacttaacgaggccatcatggctgtcggcatggtatctattctcgcatccagcctgttgaagaatgacataccgatgaccgggcctctggtggccggaggtttactcacggtttgctacgtgctgacaggcaggtcggcggatcttgaactggagcgagctgccgacgtcaaatgggaggatcaggcagaaatctcagggtctagtcccattttgtccatcaccattagcgaggacggatctatgagcatcaagaacgaagaggaggaacaaatactcactatcctgattcgcacaggcctactggtgatctccggtgtattcccagtgtcaattcccatcaccgccgctgcatggtatctttgggaggtcaagaaacagcgggccggggttctctgggatgtgcctagtccaccccctgtgggaaaggcggaactggaggacggcgcttacagaataaaacagaggggcattttggggtatagccagatcggagccggtgtctacaaggaaggcacttttcacacaatgtggcatgtgacccgtggggcagttttaatgcaccgcggaaaacggatcgagccgtcttgggccgatgtaaagaaggacctgatttcctacggcggtgggtggaaactcgagggagaatggaaggagggcgaagaggtgcaagtcctggctcttgaaccaggcaaaaatcccagagccgtgcagacgaagcctgggatcttcaaaactaacaccggaacaataggtgcagtttcactggattttagtccaggcaccagcgggtcccccattgtggacaggaagggaaaggtcgtgggcttgtatggtaatggggtagtcacacgatctggagcttacgtgtcggccatcgcgcagactgagaaaagcattgaggataaccctgaaatcgaggacgatatattccggaagaaacgcctaaccattatggacctgcatccgggcgccggcaagacgaaaagatatctccccgcaatcgttagggaagctatcaagcgggggctgcgaacacttattttagccccaactagagtggtcgctgcagagatggaagaggccctgcgcggactccctatcaggtaccagacccccgccattaaggctgagcacacaggtcgtgaaatagtggacttgatgtgtcatgcgaccttcactatgcggctgctctcaccagttagagtgcctaactataatctgatcattatggatgaggcacactttaccgaccccgcctccatcgctgccaggggctacatcagtacacgcgtcgaaatgggggaggcagccggaattttcatgacggctactccaccgggctctcgagatccttttccccaaagcaacgcgccaataatggacgaggaaagagagatccccgaacggtcctggaattcaggtcacgagtgggtgaccgatttcaaagggaagacagtatggtttgtgccttctattaaagccggaaacgacatcgcagcttgccttaggaagaatggcaaaaaggttattcagctgagccgcaagaccttcgatagtgaatatgtcaaaactcgtgccaacgactgggattttgtggtgacaaccgacatctccgagatgggcgcaaatttcaaggccgagagagtcatagatccacggaggtgtatgaaacccgtaatcttgacgcatggggaagagcgcgtgattctagctggacctatgccggttactcacagctctgccgcgcagcgaagaggtcggatcggcaggaacccaaagaatgaaaacgaccaatacatttacatgggggagcccctggaaaatgacgaggattgcgcacattggaaagaggccaagatgctcttagacaacatcaatacacctgaaggaataattccctcaatgtttgagccagaacgcgagaaagtggatgctgtcgacggcgaatatagactgaggggtgaggcccggaagaccttcgtggatcttatgcgtcgcggggacctgcctgtttggctcgcttacaaggtggcagccgagggcatcaactatgctgatcgaaaatggtgttttgacggaattaagaataaccagatcttggaagagaacgtcgaagtggagatatggaccaaagagggcgaaagaaagaaactgaagcccaggtggctcgatgcccggatctactccgacccactggcacttaaggagttcaaagaattcgcggccgggcgcaagagtctaactctgaatttgattacagagatgggaagattacctacctttatgacacagaaagctaggaacgccctggataatctcgcagtactgcacactgctgaagccggtggccgggcatataaccacgcccttagcgagctgccggagacgctcgaaaccttgctgctactgacactccttgctactgtgaccgggggaatcttcctgtttttaatgtcgggcaagggtattgggaaaatgacattgggcatgtgctgcatcataaccgcgtctgttctgctctggtacgcccagattcaaccccattggatcgcagcttccatcattctggagttctttcttatcgtcctgctcataccagaacctgagaagcagcgaactccccaggacaatcagttgacgtatgtggtgattgccatcctgaccgtcgttgccgcaacaatggctaacgaaatgggattcttagagaagactaaaaaggatctaggcctggggagcattaccacacaagagtcagaaagtaatatcctcgacatagaccttagaccagcctctgcgtggaccctgtacgctgtggccactacatttgtaacgcctatgttgcgccactccatcgagaacagctcagtgaatgtcagtctgaccgcaattgccaaccaggctactgtgctcatgggactgggtaaaggctggccccttagcaagatggatatcggggttccgctcctggcaattggatgttactcccaggtgaatccaatcacattgaccgccgcgctgttactactggtcgctcattatgccattatcggccctggtctccaggcaaaagccaccagggaagctcaaaagcgggccgcagctgggataatgaagaaccccacagtagacggcattactgtgatcgatcttgagccaatcccctacgaccctaaattcgaaaagcagctgggacaggttatgttgctgattctctgcgtgacgcaggtcctgatgatgcgtaccacatgggccctttgtgaggcgttaactctggccaccggcccgatatctacactctgggaggggaatcccggaagattttggaacaccactatcgcagtgagcatggctaatattttcaggggctcctatttggccggtgcagggctgctattttcaatcatgaaaaacacgacaaatacccgccggggaactggcaacattggtgaaaccctgggcgagaagtggaaatctcgactcaacgctcttgggaagagtgaattccaaatctacaaaaagtcgggaatacaggaggtcgatagaacactggccaaggagggcatcaaaaggggggaaactgaccaccatgccgtgagccgcggatccgcgaagttgcggtggtttgttgagagaaatatggtgaccccagaaggcaaagtagtggatctgggttgcgggcgtggaggctggtcttattactgtggtggcctcaagaacgtcagggaggttaaagggctgacaaagggaggccctgggcacgaagagcccattcctatgtcaacgtatggatggaatttagtgcggcttcagagcggcgtcgacgtgttcttcaccccacccgagaagtgcgatactctgctctgtgacatcggtgaatccagtcctaacccaacaattgaggctgggcgcaccctacgagtactgaatttggtggaaaactggctgaataacaatactcaattttgcatcaaagttctcaacccctacatgccgtctgtgatagagaagatggaaacacttcagagaaaatacggaggcgcactggtcaggaatcctttgagccggaactcaacccacgagatgtattgggtgtccaatgccacgggcaacattgtcagtagcgtgaatatgatctctcgcatgctgatcaacagattcaccatgaagcataaaaaggctacatacgagccagatgttgacctcgggtccggaactaggaacattggtatagaatcagagatccccaatttagatattatcggcaagcgaattgaaaaaatcaagcaggagcacgaaaccagctggcattatgaccaggaccacccttacaaaacatgggcctatcacgggtcgtacgagactaagcaaaccggatctgcaagttccatggtaaacggcgtggtccggctgcttacaaaaccatgggatgtggttcccatggtgacccagatggccatgactgacacgacaccgtttggtcagcagcgtgtcttcaaggagaaggtggataccagaactcaagaacctaaagaggggaccaagaaactgatgcgcataacagctgaatggctatggaaggagctcggaaaaaagaaaacgcccaggatgtgtacccgggaggaatttactagaaaggtacgcagcaatgcggccctgggcgcaatcttcacagacgagaacaagtggaaatcagctagggaagccgtggaggatggccgattttgggaattggttgaccgggagagaaatctgcatctcgaggggaagtgcgaaacctgtgtctataacatgatgggaaaaagggagaagaaacttggtgaattcggcaaggcaaaggggtcccgcgccatttggtacatgtggctgggagctcgttttttagagttcgaagccctgggctttttgaatgaggatcactggttctctcggggtaacagcctcagtggggtggagggagaaggcctgcatagactaggctacatccttagggacgtggggaaaaaggagggaggtgcgatgtatgcagatgacactgccggctgggatacacgcattaccctggaagacctcaaaaatgaggaaatggtcacaaaccacatgaagggggagcataaaaagctggctgaggccatctttaagttgacttaccagaataaagttgtgcgagtacagcggccaacccctagaggaacggtgatggacattatatccaggcgcgatcagagaggcagcggtcaagtcgggacctatggactgaacacattcactaatatggaagcacagctcatccggcagatggagggcgaaggcattttcaagtctatccaacaccttaccgctacagaggagatcgccgctcagaactggctggccagggtggggcgtgaacgattatcacgcatggcaattagtggagacgattgcgttgtgaaacccatagacgatagatttgcgtccgccctgactgctttgaatgacatgggtaaggtccggaaagatatccagcagtgggagccaagcaggggctggaacgactggacccaagtgcccttctgctctcaccattttcacgaactcgtaatgaaggatgggcgcgttctggtggtcccttgtagaaaccaggacgagctaattggacgggccaggatctcgcagggcgcaggttggtcacttaaggaaacggcttgcctggggaaaagctacgcccagatgtggacactcatgtatttccatcgacgtgatctgagattggcagccaatgcgatttgttccgctgtgccaagtcactgggtgccgacctctcgcactacatggagcatccacgccaagcatgagtggatgaccactgaggacatgttagcagtctggaaccgggtttggatacaagaaaatccctggatggaggataaaacccctgtggaatcctgggaggaagtaccatacctgggaaagagggaggaccagtggtgcggctcactcatcggccttacaagtagagccacgtgggctaaaaacattcagaccgccatcaatcaggtgcgctctctgattgggaacgaggaatatactgactacatgcccagcatgaagcggtttaggcgagaggaagaggaagcaggagtcctatggtga

SEQ ID NO: 14382 - RNA, 9876 nt, synthetic construct
  misc_feature 1..9876: note = derived and/or modified CDS sequence (opt3) from DENV-2__FJ024475__SS-prME
  source 1..9876: mol_type = other RNA
accgccggcgtgatcgtcatgctgattccaactgctatggcattccacctcactacgagaaacggggagcctcatatgatagttgggaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcgacgatacggggaagcacggaaaagaaatcaagattacaccgcagtcctcaatcaccgaggccgaactgactggctatggtaccgtaacaatggagtgtagtcccaggaccgggcttgacttcaatgaaatggtgctgttgcaaatggaggataaagcatggctcgtccaccggcagtggtttctggacttacctctgccatggctccccggcgctgacactcagggaagcaactggatacagaaggagacacttgtgacgttcaagaatcctcatgccaaaaagcaagatgttgtggtcctgggctctcaggaaggggcgatgcacaccgccttgactggagcaacagagattcagatgtcctcaggtaacctactgtttaccggccatctcaaatgccgtctgcgcatggacaaacttcaactgaaagggatgagctacagtatgtgtacaggaaagttcaagatcgtgaaagaaatcgctgagactcagcacggcaccattgtaatcagagttcagtatgagggtgatgggtctccatgcaagattcccttcgaaataacggacttggagaaaaggcatgtgctcggccggctgatcaccgtcaatccgattgtgatcgaaaaggattcccctgtcaacatcgaggccgaacccccatttggagacagctacattataatcggcgtggagcctgggcagttaaaactgaactggttcaagaagggatcgtctattggtcaaatgtttgagacaactatgcgaggcgctaaacgcatggccatcctaggggataccgcatgggacttcggatccctcggcggtgtttttacatcaattgggaaggccctgcaccaggtgttcggcgctatctacggagcggcatttagtggcgtaagctggactatgaaaatacttatcggggtcgtgattacctggatcggaatgaactccagatctacgagcttgtcagttagtctggtgctcgtcggcgtggtaacactgtatcttggtgccatggtgcaggctgattccgggtgtgttgtcagctggaagaacaaagaactgaagtgcggatctggcattttcatcaccgacaatgtgcacacttggacagagcagtacaagtttcaacccgaatcaccaagtaaattggccagcgcaatacagaaggcccatgaggaaggtatttgtggcatcaggtccgtgacccggctcgagaacctgatgtggaaacagattactcccgagttaaatcacatcctgtctgaaaacgaggtcaagctaaccataatgacaggggatacgaaaggaatcatgcaggctggcaagcgctatctcagacctcaaccaaccgaactgaaatactcgtggaagacttgggggaaggccaaaatgcttagcacagagtcccataatcagaccttcttgattgacggaccggaaacagcagagtgccccaacactaatagggcgtggaactcactggaggttgaagactatggctttggtgtgttcaccacgaatatctggctcaagctgcgtgagaaacaggatgtgttttgtgacagtaagttaatgtctgctgccattaaagataaccgggcagtacacgccgacatggggtactggatcgaaagcgctctgaatgatacatggaagatggagaaggcctccttcatagaggtcaaatcatgccactggcctaagagccataccctttggtctaacggagtgttggaatccgagatgattatccccaagaatttcgcaggccccgttagtcagcacaactatcgacctggttaccatactcaaaccgctggcccatggcacctcgggaagctggaaatggactttgatttctgtgagggaacaactgtggtcgtgaccgaagactgcggcaacagagggcccagcctaaggacaacgaccgcctctggaaaactgatcactgagtggtgctgtcgctcctgcacactcccgcctctgcggtacagaggcgaggatggttgttggtatgggatggaaattaggccacttaaggagaaggaagagaatttggttaactcactggtgaccgcgggacatggccagatcgacaattttagtttaggtgtactcggcatggccctgttccttgaagagatgctgcgcactcgagtcgggacaaaacacgctattttgctcgtggcagtgagctttgtcaccctgataacgggaaacatgtcgttccgggatctaggccgtgttatggtgatggtaggggccactatgaccgacgatatcggaatgggcgtgacatacctggctctcctggccgcatttaaggtcagacccaccttcgcggccggtcttttgctgaggaaattaacttccaaggagctcatgatggctacaattgggatcaccctgctttctcagagcacaattcctgaaactatcctggagctaaccgacgccctcgcactgggaatgatggtgttgaaaatagttcgcaatatggaaaagtatcaactggctgtgacgatcatggccatttcatgcgtccccaacgcagtgatcttacggaatgcctggaaggttagttgtacaattctcgctgcggtgtccgtctctccactgcttctgaccagctcccagcagaaagccgactggatccctttggcactcactataaagggcctgaaccccaccgctatttttctaacaactctgtcaagaaccagcaaaaagaggagttggccacttaatgaggccatcatggccgtaggcatggtgtctatcctcgcttccagcctgttgaaaaacgatattccgatgacggggcctctggttgcaggaggtttactcacagtgtgctacgtcctgaccggccgatcggccgaccttgaactggagcgcgcggctgatgtgaagtgggaggaccaggccgaaatatcagggtctagtcccatcttgtccattactatcagcgaggatggatctatgagcattaaaaatgaagaggaggaaacaaccctcactatcctgatacggacaggcctactggtaatctccggtgtgttcccagtctcaattcccatcaccgcagccgcttggtatctttgggaggttaagaagcaaagagcaggggtgctctgggacgtgcctagtccaccccctgtcggaaaagccgaactggaggatggcgcgtacaggattaagcagcgtggcatcttggggtatagccagataggagctggtgtgtacaaagaaggcacgtttcacactatgtggcatgttacccgcggggccgtattaatgcaccggggaaagagaattgagccgtcttgggcagacgtgaaaaaggatctgatctcctacggcggtgggtggaagctcgagggagaatggaaagagggcgaagaggtccaggtgctggcccttgaaccaggcaagaaccccagggctgttcaaacaaaacctgggatcttcaagaccaatacaggaactattggtgccgtgtcactggactttagtccaggcaccagcgggtcccccatcgtcgatcgaaaaggaaaggtggtaggcttgtatggtaacggggtcgtgacgcggtctggagcatacgtttcggctatagcccagacagaaaagagcattgaggacaatcctgaaatcgaggatgacattttccgcaaaaagagactaactatcatggacctgcatccgggcgcgggcaaaaccaagaggtatctccccgccatagtgcgggaagcaattaaacgagggctgagaacacttatcttagctccaacccgcgtcgtggccgctgagatggaagaggcactgaggggactccctatccgttaccagactcccgccattaaggccgagcacaccggtcgggaaatcgttgatttgatgtgtcatgctacattcacgatgagactgctctcaccagtgagggtccctaactataacctgattataatggacgaggcgcactttactgatcccgcatccatcgccgctcgcggctacattagtacccgagtggaaatgggggaggccgcaggaatcttcatgacagccaccccaccgggctctagagacccttttccccagagcaatgctccaatcatggatgaggaacgggagattcccgaaaggtcctggaactcaggtcacgagtgggtaactgacttcaaggggaaaacagtgtggtttgttccttctataaaggcgggaaatgatatcgccgcatgccttcgcaaaaacggcaagaaagtcattcaactgagccgtaagaccttcgacagtgaatatgtgaagacgagagctaatgattgggactttgtggtcactacagatatctccgagatgggcgccaacttcaaagcagagcgggtaattgacccaaggcgctgtatgaagcccgtgatcttgaccgacggggaagaacgagttatactagccggacctatgccggtgacccatagctctgctgcccagagacggggtaggatcggccgcaatcccaagaatgaaaatgatcagtacatttacatgggggagcccctggaaaacgacgaggattgcgcgcactggaaggaggcaaaaatgctcttagacaatatcaacactcctgaaggaattatcccctcaatgtttgagccagaaagagagaaggtcgatgccgtggacggcgaatataggctgcggggtgaggctcgtaaaacattcgttgatcttatgcgccgaggggacctgcctgtgtggctcgcctacaaggtcgctgcagagggcataaattatgccgatagaaagtggtgttttgacggaattaaaaacaatcaaatcttggaagagaacgtggaagtagagatttggaccaaggagggcgaaaggaaaaagctgaaaccccggtggctcgatgctcgcatctactccgacccactggcccttaaggagttcaaggagttcgcagcggggagaaaaagtctaacactgaacttgataactgagatgggaaggttacctacgtttatgacccagaaggcccggaatgctctggataacctcgccgtgctgcatacagcagaagctggtggccgagcctataatcacgcacttagcgagctgccggagactctcgaaaccttgctgctactgacactccttgccaccgttactgggggaatcttcctgtttttaatgtcgggcaaaggtattgggaagatgacgttgggcatgtgctgcatcattaccgcttctgtcctgctctggtacgcgcagatccagccccactggatagccgcatccattatcctggagttctttcttatcgtgctgctcattccagaacctgagaaacaaagaacaccccaggacaaccagttgacttatgtggtcatcgctatactgaccgttgtggccgccacaatggcaaatgaaatgggattcttagagaagaccaagaaagacctaggcctggggagcattactacacaggagtcagaaagtaacatcctcgatattgaccttcgcccagcttctgcctggacgctgtacgcggtagctaccacttttgtgacacctatgttgaggcattccatcgagaatagctcagtcaacgtgagtctgaccgccatagcaaatcaagccaccgttctcatgggactgggtaagggctggccccttagcaaaatggatatcggggtgccgctcctggctattggatgttactcccaggtcaacccaatgacattgactgcagccctgttactactggtagcgcactatgctatcattggccctggtctccaggccaaggcaacgcgggaagcccagaaacgtgctgccgcagggatcatgaagaatcccaccgtggacggcattacagttatcgatcttgagccaataccctacgaccctaagttcgaaaaacaactgggacaggtgatgttgctgattctctgcgtcactcaggtgctgatgatgagaaccacatgggctctttgtgaggccttaaccctggcgactggcccgatctctacgctctgggaggggaaccccggaaggttttggaatacaaccatcgccgtcagcatggcaaacattttccgcggctcctatttggctggtgccgggctgctattttcaataatgaagaatactaccaacacacggcgaggaactggcaatatcggtgaaaccctgggcgagaaatggaagtctagactcaacgcacttgggaaaagtgagttccagatttacaagaaatcgggaatccaagaggtggataggacactggctaaggagggcattaagcgcggggaaacggaccatcacgccgttagccggggatccgccaaattgagatggtttgtggagcgtaacatggtaaccccagaaggcaaggtggtcgatctgggttgcgggaggggaggctggtcttattactgtggtggcctcaaaaatgttcgggaggtgaaggggctgactaaaggaggccctgggcatgaggaaccaatccctatgtcaacatatggatggaacttagtccgccttcagagcggcgtggacgtattcttcaccccacccgagaagtgcgatactctgctctgtgacataggtgaatccagtcctaatccaacaatcgaggcggggcgaaccctaagagtgctgaacttggttgaaaattggctgaacaataacacgcagttttgcattaaggtgctcaatccctacatgccgtctgtcatcgagaaaatggaaacccttcaaaggaagtacggaggcgctctggtgcggaaccctttgagccgcaattcaacacacgagatgtattgggtctccaacgcaactggcaatattgtgagtagcgttaacatgatctctagaatgctgataaataggttcaccatgaaacacaagaaagccacatacgagccagatgtagacctcgggtccggaactcgaaacattggtatcgaatcagagatccccaacttagacattataggcaagcggatcgaaaagattaaacaggagcatgaaaccagctggcactatgatcaggaccatccttacaagacatgggcttatcacgggtcgtacgagaccaaacagactggatctgccagttccatggtgaatggcgtcgtgcgtctgcttacgaagccatgggatgttgtgcccatggtcacacaaatggcaatgaccgacactaccccgtttggtcagcagagagtgttcaaagagaaggtagatacacgcacgcaggaacctaaggaggggaccaaaaagctgatgaggatcactgccgaatggctatggaaagagctcggaaagaaaaagacaccccggatgtgtaccagagaggaatttactcgcaaagtgaggagcaacgctgcgctgggcgccattttcacagacgagaataagtggaagtcagcacgagaagctgttgaggatggccggttttgggaattggtcgacagagagaggaacctgcacctcgaggggaaatgcgaaacctgtgtgtataatatgatgggaaagcgcgagaagaaacttggtgagttcggcaaagccaaagggtcccgtgcaatctggtacatgtggctgggagcccggtttttagagttcgaagctctgggctttttgaacgaggatcattggttctctagaggtaatagcctcagtggggtggagggagaaggcctgcacaggctaggctacatacttcgcgacgtcgggaagaaagagggaggtgccatgtatgcggatgacacagcaggctgggacactcgaatcaccctggaagatctcaagaacgaggaaatggttacgaatcatatgaaaggggagcacaagaaactggccgaggctatttttaagttgacctaccaaaacaaggtggtacgggtgcagagaccaacacctaggggaactgtcatggacatcatttcccgcagagatcagcggggcagcggtcaggtggggacctatggactgaatacattcactaacatggaagcccaactcatcaggcagatggagggcgaaggcattttcaaatctatacagcatcttaccgcaacggaggagatcgctgcccaaaattggctggctcgtgttgggcgagaacgcttatcaagaatggccattagtggagacgattgcgtggtcaagcccatcgacgatcggtttgcatccgcgctgacagccttgaacgacatgggtaaagtgaggaaggatatccagcagtgggagccaagccgcggctggaatgactggacccaggtacccttctgctctcaccactttcatgaactcgttatgaaagatgggagagtgctggtcgtgccttgtcggaaccaagacgagctaattggaagggctcgaatatcgcagggcgccggttggtcacttaaggaaactgcatgcctgggaaagagctacgctcagatgtggacactcatgtatttccaccgtagagatctgcgcttggccgcaaacgccatctgttccgcggtgccaagtcattgggtcccgacctctcggactacctggagcattcacgctaaacacgagtggatgacaacggaggacatgttagccgtttggaatagggtgtggatccaggaaaacccctggatggaggacaagacccctgtagaatcctgggaggaagtgccatacctgggaaaaagagaggatcaatggtgcggctcactcattggccttacaagtcgcgcaacatgggccaagaatatccagaccgctataaaccaggtccggtctctgatcgggaatgaggaatatactgactacatgcccagcatgaaaaggtttcgaagagaggaagaggaagccggagtgctatggtga

SEQ ID NO: 14383 - RNA, 9867 nt, synthetic construct
  misc_feature 1..9867: note = derived and/or modified CDS sequence (opt3) from DENV-2__FJ182012__SS-prME
  source 1..9867: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacaacgggaaggaaatcaaaattacgccgcagtcctcaatcacagaggccgaactgaccggatatggcactgtaaccatggagtgtagtcccaggacaggtcttgatttcaatgaaatggtgctgttgcaaatggaggacaaggcatggctcgtccaccggcagtggtttctggatttacctctgccatggctccccggggctgacacccagggcagcaactggatacagaaagagactcttgtgacattcaagaatcctcacgccaagaaacaagacgttgtggtcctgggatctcaggaaggcgcgatgcatacggccttgaccggggcaactgagattcagatgtcctcaggaaacctactgtttacaggtcacctcaagtgccgtctgcgcatggataaacttcaactgaagggcatgagctacagtatgtgtaccgggaaattcaagatcgtgaaggaaatcgctgagacacagcatggaactattgtaatcagagttcagtatgagggcgacggttctccatgcaaaattcccttcgaaataaccgatttggagaagaggcacgtgctcgggcggctgatcacggtcaacccgattgtgatcgaaaaagactcccctgtcaatatcgaggccgaacccccatttggcgatagctacattataatcggagtggagcctggccagttaaagctgaactggttcaaaaaggggtcgtctattggacaaatgtttgagaccacaatgcgaggtgctaagcgcatggccatcctaggcgacactgcatgggatttcgggtccctcggaggcgtttttacctcaattggtaaagccctgcatcaggtgttcggggctatctacggcgcggcatttagtggagtaagctggacaatgaagatacttatcggcgtcgtgattacttggatcgggatgaattccagatctaccagcttgtcagttagtctggtgctcgtcggagtggtaacgctgtatcttggcgccatggtgcaggctgactccggttgtgttgtcagctggaaaaacaaggaactgaaatgcgggtctggaattttcatcacagataatgtgcacacctggactgagcagtacaagtttcaacccgaatcaccaagtaagttggccagcgcaatacagaaagcccacgaggaaggcatttgtggtatcaggtccgtgacacggctcgagaacctgatgtggaagcagattacccccgagttaaatcatatcctgtctgaaaacgaggtcaaactaactataatgaccggcgacacaaaggggatcatgcaggctggaaaacgctatctcagacctcaaccaacggaactgaagtactcgtggaaaacctggggcaaggccaagatgcttagcactgagtcccacaatcagacattcttgattgatgggccggaaaccgcagagtgccccaacacaaatagggcgtggaactcactggaggttgaagactatggatttggcgtgttcactaccaatatctggctcaaactgcgtgagaagcaggacgtgttttgtgatagtaaattaatgtctgctgccattaaggacaaccgggcagtacatgccgatatgggttactggatcgaaagcgctctgaatgacacgtggaaaatggagaaggcctccttcatagaggtcaagtcatgccactggcctaaaagccacacactttggtctaacggggtgttggaatccgagatgattatcccaaagaacttcgcaggacccgttagtcagcataattatcgacctggctaccacacccaaactgctggtccatggcatctcggcaaactggaaatggattttgacttctgtgaggggaccacagtggtcgtgactgaagattgcggaaacagaggccccagcctaaggaccacaacggcctctgggaagctgatcaccgagtggtgctgtcgctcctgcactctcccgcctctgcggtacagaggagaggacggctgttggtatggtatggaaattaggccacttaaagagaaggaagagaatttggttaactcactggtgacagcggggcacggacagatcgataattttagtttaggcgtactcggtatggccctgttccttgaagagatgctgcgcacccgagtcggcactaagcatgctattttgctcgtggcagtgagctttgtcacactgataaccgggaacatgtcgttccgggacctaggacgtgttatggtgatggtaggcgccacgatgactgatgacatcgggatgggagtgacctacctggctctcctggccgcatttaaagtcagacccacattcgcggccggccttttgctgaggaagttaacctccaaagagctcatgatggctactattggtatcacactgctttctcagagcaccattcctgaaacaatcctggagctaactgatgccctcgcactggggatgatggtgttgaagatagttcgcaatatggaaaaatatcaactggctgtgaccatcatggccatttcatgcgtccccaacgcagtgatcttacggaatgcctggaaggttagttgtacgattctcgctgcggtgtccgtctctccactgcttctgacaagctcccagcagaaggccgactggatccctttggcactcaccataaaaggactgaaccccactgctatttttctaaccacactgtcaagaactagcaagaaaaggagttggccacttaatgaggccatcatggccgtaggcatggtgtctatcctcgcttccagcctgttgaagaacgacattccgatgaccggccctctggttgcagggggattactcacggtgtgctacgtcctgacaggtcgatcggccgatcttgaactggagcgcgcggctgacgtgaaatgggaggatcaggccgaaatatcaggctctagtcccatcttgtccattaccatcagcgaggacgggtctatgagcattaagaatgaagaggaggaacaaatcctcactatactgatccggacaggactactggtaatttccggcgtgttcccagtctcaatccccattaccgcagccgcttggtatctttgggaggttaaaaagcagagagcaggtgtgctctgggatgtgcctagtccaccccctgtcgggaaggccgaactggaggacggagcgtacaggatcaaacagcgtggcatattgggctatagccagattggggctggagtgtacaaggaaggtacttttcacacaatgtggcacgttacccgcggcgccgtattaatgcatcgggggaaaagaatcgagccgtcttgggcagatgtgaagaaagacctgatctcctacggaggcggttggaagctcgagggggaatggaaggagggagaagaggtccaagtgctggcccttgaaccaggcaaaaaccccagggctgttcagacgaagcctggcattttcaaaactaataccgggacaatcggagccgtgtcactggattttagtccaggtaccagcggctcccccatagtcgaccgaaaggggaaagtggtaggattgtatggcaacggtgtcgtgacacggtctggggcatacgtttcggctattgcccagactgagaagagcatcgaggataaccctgaaattgaggacgatatcttccgcaagaaaagactaaccataatggacctgcacccgggagcgggcaagacgaaaaggtatctccccgccattgtgcgggaagcaatcaagcgaggcctgagaacacttatcttagctccaactcgcgtcgtggccgctgagatggaagaggcactgagggggctccctattcgttaccagacccccgccatcaaagccgagcatacaggacgggaaattgttgacttgatgtgtcacgctaccttcactatgagactgctctcaccagtgagggtccctaattataacctgataatcatggatgaggcgcattttaccgaccccgcatccattgccgctcgcggttacatcagtacacgagtggaaatgggcgaggccgcagggatcttcatgacggccactccaccgggatctagagatccttttccccaaagcaatgctccaattatggacgaggaacgggagatacccgaaaggtcctggaactcaggccacgagtgggtaaccgatttcaagggtaagacagtgtggtttgttccttctatcaaagcggggaatgacattgccgcatgccttcgcaagaacggaaaaaaggtcatccagctgagccgtaaaaccttcgatagtgaatatgtgaagactagagctaatgactgggattttgtggtcacaaccgacatttccgagatgggcgccaacttcaaggcagagcgggtaatcgatccaaggcgctgtatgaaacccgtgatattgacgcacggcgaagagcgagttatcctagccgggcctatgccggtgactcatagctctgctgcccagagacggggaaggattggtcgcaatccaaagaacgaaaatgaccaatacatctacatgggcgagcccctggaaaacgacgaggattgcgcgcactggaaagaggcaaagatgctcttagacaatattaacacacctgaagggatcataccctcaatgtttgagccagaaagagagaaagtcgatgccgtggacggagaatataggctgcggggcgaggctcgtaagaccttcgttgatcttatgcgccgaggtgacctgcctgtgtggctcgcctacaaagtcgctgcagaggggattaattatgccgatagaaagtggtgttttgacggcatcaagaacaaccagattttggaagagaatgtggaagtagagatctggaccaaagagggagaaaggaagaaactgaagccccggtggctcgatgctcgcatatactccgacccactggcccttaaagagttcaaggaattcgcagcgggcagaaagagtctaactctgaacttgatcacagagatggggaggttacctacctttatgacacagaaagcccggaatgctctggataacctcgccgtgctgcatactgcagaagctggaggtcgagcctataatcacgcacttagcgagctgccggagacgctcgaaaccttgctgctactgacactccttgccactgttaccggcgggattttcctgtttttaatgtcgggaaagggcatcggtaaaatgacattggggatgtgctgcattatcaccgcttctgtcctgctctggtacgcgcagatacaaccccactggattgccgcatccatcatcctggagttctttcttattgtgctgctcatcccagaacctgagaagcagagaactccccaggacaaccagttgacgtatgtggtcatagctattctgaccgttgtggccgccacaatggcaaatgaaatgggcttcttagagaaaactaagaaggatctaggactgggcagcatcaccacacaagagtcagaaagtaacattctcgacatcgaccttcgcccagcttctgcctggaccctgtacgcggtagctactacatttgtgacgcctatgttgaggcattccatagagaatagctcagtcaacgtgagtctgaccgccatcgcaaatcaggccactgttctcatggggctgggaaaaggttggccccttagcaagatggatattggcgtgccgctcctggctatcgggtgttactcccaggtcaacccaattacattgaccgcagccctgttatctctagtagcgcactatgctatcattggacctggcctgcaggccaaagcaacccgggaagcccaaaagcgtgctgccgcaggtatcatgaaaaatcccacagtggacgggataactgttattgatctcgagccaatcccctacgaccctaagttcgaaaagcagcttggccaggtgatgctgttgatcctgtgcgtcacgcaggtgctcatgatgagaaccacatgggctctgtgtgaggcccttactttagcgaccggaccgattagcacactgtgggagggcaaccccgggaggttttggaataccactatagccgtctccatggcaaacatcttccgcggatcatatctcgctggcgccggtttgctgttttctattatgaaaaatacgacaaacacccggcgagggactggaaacatcggcgaaaccctaggtgagaagtggaaaagtagactgaatgcactcggcaagtcggaattccaaatttacaaaaagagcgggatccaggaggtggataggacacttgctaaagagggaataaagcgcggcgaaactgaccatcacgccgtttcccgggggtctgccaagctgagatggtttgtggagcgtaacatggtaaccccagaaggaaaagtggtcgatttgggctgcggtagggggggatggtcatattactgtggcggtctgaagaatgttcgggaggtgaaaggcctcacaaaggggggacctggccatgaagagcccatccctatgagcacgtatgggtggaacctggtccgcttacagtccggagtggacgtattcttcaccccacccgagaaatgcgatactcttctgtgtgacattggcgaaagttctcctaatccaacaatcgaggcgggtcgaaccctcagagtgctaaacctggttgaaaattggttgaacaataacactcaattttgcattaaggtgctgaatccctacatgccgagcgtcatcgagaagatggaaacactccagaggaaatacgggggagctcttgtgcggaaccctctgtcacgcaattccacccacgagatgtattgggtcagtaacgcaacgggcaatatagtgagctctgttaacatgatttccagaatgttgatcaacaggttcaccatgaagcacaaaaaggccacatacgagccagatgtagacctgggctcagggactcgaaatatcggaattgaaagcgagatacccaacctcgatatcattggtaaacggatcgaaaagattaagcaggagcatgaaacctcgtggcactatgaccaggaccatccttacaaaacatgggcttatcacggctcttacgagactaagcaaaccgggagtgcctccagcatggtgaatggagtcgtgcgtttactgacaaaaccatgggatgttgtgcccatggtcacccagatggcaatgactgacacgacaccgtttggccagcagagagtgttcaaggagaaagtagatacccgcactcaagaacctaaggagggtaccaagaaacttatgaggatcacagccgaatggctgtggaaggagctagggaaaaagaaaacgccccggatgtgtaccagagaggaatttactcgcaaggtgaggtcaaacgctgcgctcggagccatattcacagacgagaataaatggaagtccgcacgagaagctgttgaggatggccggttttgggaactggtcgacagagagaggaacttgcacctggagggcaagtgcgaaacctgtgtgtataatatgatggggaaacgcgagaagaaactcggagaattcggtaaggccaaaggctctcgtgcaatctggtacatgtggcttggggcccggtttctggagttcgaagctttaggatttctgaacgaggatcattggttcagcagaggcaatagtttgtccggtgtggagggggaaggactccacaggctgggctacattctacgcgacgtcggcaagaaggaggggggagccatgtatgcggatgacactgcaggttgggatacacgaatcacccttgaagacctgaaaaacgaggaaatggttacaaatcatatgaagggcgagcacaaaaagctcgccgaggctatttttaaactgacttaccagaacaaggtggtacgggtgcagagaccaacccctagggggacggtcatggacatcattagccgcagagatcagcggggatctggccaagtgggtacctatgggttgaatacattcactaacatggaagcccagctgataaggcagatggagggagaaggcatcttcaagtcaattcaacatctcaccgcaacagaggagatcgctgcccagaattggcttgctcgtgttggccgagaacgcctgagtagaatggccatctccggggacgattgcgtggtcaaacccattgacgatcggtttgcaagcgcgttaactgccctgaacgacatgggaaaggtgaggaaagatatacagcagtgggagccatctcgcggttggaacgactggacccaagtacccttctgctcgcaccactttcatgaattggttatgaaggatggcagagtgctcgtcgtgccttgtcggaatcaggacgagctgatcgggagggctcgaatttcacagggagccggctggagcctaaaagaaacggcatgccttggtaagtcctacgctcagatgtggacactgatgtatttccaccgtagagatctccgcctggccgcaaacgccatctgtagtgcggtgccatctcattgggtcccgaccagccggactacatggtccattcacgctaagcacgagtggatgaccactgaggacatgttggccgtttggaatagggtgtggatccaagaaaacccctggatggaggataaaacccctgtagaatcatgggaggaagtgccatacttagggaagagagaggaccagtggtgcggaagtctgataggcctcacatctcgcgcaacgtgggccaaaaatatccagaccgctattaaccaggtccggagccttatcggcaatgaggaatatactgactacatgccctccatgaagaggtttcgaagagaggaagaggaagccggggtgctgtggtga

SEQ ID NO: 14384 - RNA, 9876 nt, synthetic construct
  misc_feature 1..9876: note = derived and/or modified CDS sequence (opt3) from DENV-2__EU854293__SS-prME
  source 1..9876: mol_type = other RNA
accgccggcatgatcattatgctgatacccacagtgatggctttccacctcactacgagaaacggggagcctcatatgatcgtcagcaggcaggaaaagggaaaatcccttctgtttaagaccggtgacggcgttaatatgtgcacattgatggcaatggatttaggggagctgtgtgaagacactattacctacaaatgcccactactccggcaaaacgagccggaagatatcgactgttggtgcaattctacatcaacctgggtgacttatggaacatgtaccacgactggcgagcaccgccgagagaagcgtagtgtagccctggtgccccatgtcggtatggggcttgaaaccagaacagagacttggatgagctccgaaggagcgtggaaacacgctcagaggattgagacctggatcctgcggcatcctggcttcacaataatggccgcaatcttggcctacaccattggcacgactcactttcagcgcgctctcatcttcattctgctgacagcagtggccccatctatgaccatgagatgcatcgggatatcgaacagggattttgttgagggagtgtcaggtggcagctgggtcgacattgtgctcgaacacgggagttgtgtaactacaatggctaagaataagcccaccttagatttcgagctgatcaaaacggaagccaagcagtccgcgacccttcggaaatattgcattgaggcaaagttgacaaacactaccacagaatctcgctgtcctactcaaggagagccaagcctgaatgaggaacaggacaaacgatttgtttgcaagcattccatggtggatagaggctggggtaacgggtgtggactattcggcaagggcgggatcgtcacctgcgccatgtttacatgcaaaaagaatatgaaaggaaaggtggtgcagcccgagaacctcgaatacaccatcgtcattactcctcactcaggtgaggaacatgctgttggcaatgacacggggaaacacggaaaggagataaaaatcacaccacagagtagcattaccgaggccgaactgactggctatggtaccgtgacaatggagtgttctccgaggaccgggcttgatttcaacgaaatggtactgttgcaaatggagaataaggcatggctcgtgcaccggcagtggtttctggacttacccctgccttggctcccaggcgctgatactcagggatccaactggatccagaaggaaacacttgtcacgttcaaaaatccccatgccaagaaacaagacgtggttgtgctgggctcacaggagggggcgatgcacaccgccttgactggagcaacagagatacagatgagcagtggtaacctactgtttaccggccatctcaagtgccgtctgcgcatggacaaacttcaactgaaggggatgtcttactccatgtgtacaggaaagttcaaagtcgtgaaggaaattgctgagactcagcacggcaccatcgtaatcagagttcagtatgaaggtgatgggagcccttgcaaaattccattcgagatcatggacttggagaagaggcatgtgctcggccggctgattacggtcaaccccatagtgaccgaaaaagattcgccggtcaatatcgaggccgaacctccctttggagactcttacattatcatcggcgtggagccagggcagttaaagctgaactggttcaagaaaggatcctcaattggtcaaatgtttgaaacaactatgcgaggcgctaagcgcatggccatactaggggataccgcatgggacttcggaagtctcggcggtgtttttacaagcatcgggaaagccctgcaccaggtgttcggcgctatttacggagcggcattttccggcgtatcttggactatgaagatccttattggggtcatcataacctggatcggaatgaatagcagatcaacgagtttgtccgtgagcctggttctcgtgggcgtcgtgacactgtatcttggtgtaatggtgcaggccgattctgggtgtgttgtctcatggaaaaacaaggagctgaagtgcggaagtggcattttcatcaccgacaatgtgcacacttggacagagcagtacaaatttcaacctgaaagcccctccaagttggcttctgccattcagaaagcacatgaggaaggtatctgtggcataaggtcggtgacccggctcgagaacctgatgtggaagcagattactccagaattaaatcacatcctgagcgagaacgaggtcaaactaaccattatgacaggggatatcaagggaataatgcaggccggcaaacgctccctcagaccccaacctacggaactgaagtattcatggaagacctgggggaaagctaagatgcttagtactgagtctcataatcagacattcttgatcgacggaccagaaaccgccgagtgcccgaacacaaatagggcatggaacagcctggaagttgaggattacggctttggtgtgttcactaccaatatttggctcaaactgcgtgagaagcaggacgtgttttgtgactccaaattaatgtcagcggctatcaaggataaccgggccgtacacgcagacatggggtattggattgaaagcgccctgaatgatacgtggaagatcgagaaagcttctttcatagaagtcaagtcctgccactggcccaaaagtcatacactttggagcaacgaggtgttggagtctgaaatgattatccctaagaacttcgccggaccagtttcccagcacaattaccgacccggctatcatacccaaactgcaggtccttggcacctcggcaaactggagatggactttgatttctgtgaagggaccacagtggtcgtgactgaggactgcggaaacagaggcccatcactaaggaccacaacggctagtgggaagctgatcaccgaatggtgctgtcgcagctgcactctccccccgctgcggtacagaggagaggatggctgttggtacggtatggagattaggcctcttaaggaaaaagaggaaaatttggttaactcgctggtgacagccgggcatggacagatcgacaatttttccttaggcgtactcggtatggcgctgttccttgaggaaatgctgcgcacccgagtcggcactaagcacgccattttgctcgtggctgtgtcttttgtcacactgataaccgggaacatgagcttccgggatctaggacgtgttatggtgatggtaggcgcaacgatgactgacgatatcgggatgggagtgacctatctggccctcctggctgcctttaaagtcagaccaacattcgcagcgggccttttgctgaggaagttaacctcaaaagagctcatgatgactacaattggtatcgtgctgcttagtcagtccaccattcccgagacaatcctggaactaactgacgccctcgctctggggatgatggttttgaagatggtgcgcaagatggagaaataccaactggccgtcaccataatggcaatcttatgcgtgcctaatgctgttattctccagaacgcctggaaggtgtcttgtacgatcctggcagtcgtaagcgtgtcccccctttttctgacatcaagccagcagaaagccgattggattccattggctctcaccatcaagggactgaatcctactgcgatattcctaaccacactgagtcggactaacaaaaagagatcttggccccttaatgaagccattatggcagttggcatggtgtccatcctcgctagctcgctgttgaaaaacgacatcccaatgaccggcccgctggtcgccgggggattactcacggtgtgctatgtactgacaggtaggtcagccgaccttgagctggaacgagctgcagatgtgaagtgggaggaccaagccgagatttctggcagttcccctatattgagcatcaccatttctgaagatgggagcatgtccatcaagaatgaggaagaggagcagattctcactatcctgatacgcacaggactactggtcatctcaggcctttttcccgttagtatgccaattaccgcggctgcctggtacctctgggaagtgaaaaagcagcgggcaggtgtgctgtgggacgtccccagccctccacccgtggggaaagccgagttggaagatggagcttatagaatcaagcagaaaggcattttaggctactctcaaatcggggcaggagtttataaggagggtactttccacacaatgtggcatgtaaccaggggcgccgtgctgatgcacaaggggaaacgtatagaaccttcctgggcggacgtcaagaaagatctcatttcatacggaggcggttggaagctggagggggagtggaaagaaggagaggaagtgcaggttcttgctctggagccgggcaagaacccacgcgccgtgcagacgaagcccggcttgtttaaaactaatgcagggaccatcggagccgtcagtctagacttcagccctggtacatccggctctccaatcattgataagaaagggaaggtggtaggactgtacggcaacggtgtcgtgacccggtcgggggcttatgttagcgccatcgcacagacagaaaaatcaatagaggacaaccccgagattgaagatgacatcttcagaaagaggaagctcactattatggatctgcatcctggagctggcaaaaccaagcgataccttccggccatcgtgcgggaggcgataaaacgcggcttaagaacgctgattctcgcccccacaagggtcgtggcagctgaaatggaggaagccttgcgggggctgccaatccgatatcaaactcctgctatcagagcagagcacaccggacgcgagattgttgacctcatgtgtcatgccacatttaccatgaggctgctttcccccgtgcgtgtcccaaattacaacctgatcattatggacgaagcccacttcactgatcctgctagtatagcggcacggggttatatctctaccagagtggagatgggcgaagccgctgggatttttatgacagccacgcccccaggaagcagggacccgttccctcagtccaatgcacccatcatggatgaggagcgcgaaatcccagagcgatcatggtctagcggccacgaatgggtaactgactttaagggtaaaaccgtgtggttcgttcccagtattaaggccgggaacgatatagctgcgtgcttgagaaagaatggaaaaaaggtcatccagctatcccggaaaacatttgacagcgagtacgtgaagaccaggactaacgattgggacttcgtggtcacaaccgatatttctgaaatgggcgccaattttaaagcagagcgcgtaatcgaccctcgtagatgtatgaagccagtgattctgacggatggcgaggaacgggttatcctcgctgggcccatgcctgtgactcattcatccgccgcacaaaggcgcggacgaataggtagaaacccgaaaaatgagaacgaccagtatatctacatgggcgaaccattagagaatgacgaagattgcgcccactggaaggaggctaagatgctgcttgacaacattaatacacccgaggggatcattcctagtatgttcgaacccgagcgggaaaaagtcgatgccatcgacggagagtacaggctgcgcggcgaagcgagaaagacctttgtggatctcatgaggcggggtgacttgccagtttggctggcatatcgtgtggccgctgaggggataaactacgccgatcgccgatggtgtttcgacggcattaaaaataaccagatcctcgaggaaaacgtcgaggtggaaatttggaccaaggagggagagagaaaaaagctgaagcctaggtggcttgatgctcggatctatagcgaccccctagcactgaaagaattcaaggagtttgccgctggccgcaaatcgttgactttaaatctgataacagaaatggggagactcccaaccttcatgacacagaaggccagggatgcactggacaaccttgcggtactgcatactgccgaggctggaggtcgggcctacaatcacgcactctctgaattgcctgagacgctggagaccctactgctccttacactgttagctactgtgaccggcgggatctttttgttcctgatgtccggacgaggcattggtaaaatgacactcgggatgtgctgcatcattaccgccagcatcctgctttggtatgcacaaatacagccgcactggattgccgcttcaatcatcctggaatttttcctcattgttttgctgatccccgagccagaaaagcagagaactcctcaggataaccaattaacgtacgtcgtgatagcgattctaaccgtggtcgccgcaacaatggctaatgagatgggctttctggaaaagactaaaaaggacctcggacttggcagtatcaccacacagcagcccgagtctaacattctggacatcgatttgcgcccagcctccgcctggaccctgtatgcagttgctactacattcgtgacgcctatgctcaggcatagcatagagaattcaagtgtaaacgtgagcctgaccgccatcgcgaatcaggctactgtccttatggggctcggaaaaggttggcccctgtccaagatggacattggcgtgccgttgctggccatcgggtgttactctcaagttaacccaattacattaaccgcagccctatttctgctcgtggctcactacgcaatcattggacctggccttcaggccaaagcgacccgggaagctcagaagcgtgccgcagccggtatcatgaagaatcccacagtcgatgggataactgtaattgacctggatccaatcccctatgaccctaaattcgagaagcagttgggccaagtgatgctgctcgttctgtgcgtgacgcaggtccttatgatgagaaccacatgggctttatgtgaagccctgactctcgcaaccggaccgatcagcacattgtgggagggcaaccccgggaggttttggaataccactattgctgtgtccatggccaacatattccgcggatcatacctggcgggcgccggtctactgttttctatcatgaaaaatacgacaaacacccggcgagggactggaaatattggcgaaaccctcggtgagaagtggaaaagtagacttaacgcactgggcaagtcggagttccagatctataaaaagagcgggattcaagaagtcgataggacattggctaaggagggaatcaaacgcggcgaaactgaccatcacgccgtgtcccgggggtctgcaaagctgagatggttcgttgagcgtaacatggtgaccccagagggaaaagtagtggatctcggctgcggtagggggggatggtcatactattgtggcggtctgaagaatgtccgggaagttaaaggcttaacaaaggggggacctggccatgaggaacccatacctatgagcacgtacgggtggaaccttgtgcgcctgcagtccggagtcgacgtgtttttcaccccacccgagaagtgcgatactctcctatgtgacatcggcgaaagttctcctaatccaacagtagaggctggtcgaaccctgagagtgttgaacctggttgagaattggctcaacaataacactcagttttgcattaaagtgcttaatccctatatgccgagcgtcatcgaaaagatggaggccctgcagaggaaatacgggggagccttggtgcggaaccctctgtcacgcaattccacacacgaaatgtactgggtcagtaacgcgagcggcaatattgtgtcttccgttaacatgatctcaagaatgctcataaataggttcaccatgcgacacaagaaagctacgtatgagccagatgtagacttaggcagcgggacccggaacattggaatcgaatcggagatccccaacctggacattataggtaagcgtatcgagaagattaaacaagaacatgagacatcttggcactacgatcaggaccatccttataagacttgggcataccacggcagttatgaaaccaaacagacagggtccgccagctcaatggtgaatggagtcgtgagacttctgactaagccatgggatgttgtgcccatggtcacccagatggctatgacagacaccactccgtttggccaacagcgcgtgttcaaagagaaggtagatacgaggacacaggaacctaaggagggtaccaaaaagctaatgaaaatcactgccgagtggctctggaaggaactggggaaaaagaaaaccccccggatgtgtacaagagaggaatttacgcgcaaggtgaggtccaacgcagccttgggagctattttcaccgacgagaataagtggaaatctgcgcgagaggccgttgaagatagccggttttgggagctggtcgacaaggaaagaaacctccaccttgagggcaaatgcgaaacttgtgtgtacaatatgatgggcaagagggagaaaaagctgggggagttcggaaaggcaaaaggtagtcgcgctatctggtatatgtggttaggcgcccgttttctggaattcgaggcattggggtttctcaacgaagatcattggttctcccgggagaatagcctgtctggagtggaaggcgagggtctacacaagcttgggtacatactgagagacgtctcaaaaaaggagggaggcgccatgtacgctgatgacacagccggctgggacaccaggatcactctcgaagatctgaaaaacgaggaaatggttacaaatcatatggagggggaacacaagaagttggcggaggcaattttcaaactgacctatcagaacaaggtggtacgcgtgcaacgaccaacacctcggggaactgtcatggacatcattagtagaagggatcagcgcggttccggccaggtggggacctacggactcaatacgtttaccaacatggaggcccaacttatcagacagatggaaggcgagggtgttttcaaaagcattcagcatctgacagtgactgaagagatagctgtccagaattggttagcccgggtggggagggagcgtctgtctcgaatggcaatctcgggagacgattgcgtagttaagcccttggacgatcgctttgcttcagccctcaccgctctgaacgacatgggcaaagtgagaaaggatattcaacagtgggaaccaagccggggctggaatgactggacacaggtccccttctgctcccaccactttcatgagctaatcatgaaggatgggagggtgcttgtggtcccttgtcgcaaccaggacgaactgatcggaagagcccggattagtcaaggtgcaggctggtctctcagggagactgcgtgcctggggaaaagctatgcccagatgtggtccttgatgtacttccaccgacgtgatttaagactggctgccaacgcaatatgttcagctgttccaagtcattgggtgccgacctctcgcacgacatggagcatccacgccaagcacgaatggatgaccactgaggacatgctcacagtatggaatcgggtgtggattcaggagaacccctggatggaagacaaaacccctgtcgagtcctgggaagagatcccatatcttggaaagagggaagatcagtggtgcggctcactgattggtctaactagcagagcaacctgggccaaaaatatccaaacagcgataaaccaggtgcgctctctgatcgggaatgaggagtacacggactatatgccctccatgaagcggtttaggcgagaagaggaagaggctggagttctctggtga

SEQ ID NO: 14385 - RNA, 9876 nt, synthetic construct
  misc_feature 1..9876: note = derived and/or modified CDS sequence (opt3) from DENV-2__EU854294__SS-prME
  source 1..9876: mol_type = other RNA
accgccggagtgatcgtcatgctgattcccacagctatggcattccacctcactacgagaaatggggagcctcatatgatagttgggaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgatcgaaaaggactcccctgtcaacatcgaggccgaacccccatttggagatagctacattataatcggcgtggagcctgggcagttaaaactgaattggttcaagaagggatcgtctattggtcaaatgtttgagacaactatgcgaggcgctaaacgcatggccatcctaggggacaccgcatgggatttcggatccctcggcggtgtttttacatcaattgggaaggccctgcaccaggtgttcggcgctatctacggagcggcatttagtggcgtaagctggactatgaaaatacttatcggggtcgtgattacctggatcggaatgaactccagatctacgagcttgtcagttagtctggtgctcgtcggcgtggtaacactgtatcttggtgccatggtgcaggctgactccgggtgtgttgtcagctggaagaataaagaactgaagtgcggatctggcattttcatcaccgataacgtgcacacttggacagagcagtacaagtttcaacccgaatcaccaagtaaattggccagcgcaatacagaaggcccatgaggaaggtatttgtggcatcaggtccgtgacccggctcgagaatctgatgtggaaacagattactcccgagttaaaccacatcctgtctgaaaatgaggtcaagctaaccataatgacaggggacacgaaaggaatcatgcaggctggcaagcgctatctcagacctcaaccaaccgaactgaaatactcgtggaagacttgggggaaggccaaaatgcttagcacagagtcccataaccagaccttcttgattgatggaccggaaacagcagagtgccccaatactaacagggcgtggaactcactggaggttgaagactatggctttggtgtgttcaccacgaacatctggctcaagctgcgtgagaaacaggacgtgttttgtgatagtaagttaatgtctgctgccattaaagacaatcgggcagtacacgccgatatggggtactggatcgaaagcgctctgaacgacacatggaagatggagaaggcctccttcatagaggtcaaatcatgccactggcctaagagccataccctttggtctaatggagtgttggaatccgagatgattatccccaagaatttcgcaggccccgttagtcagcacaactatcgacctggttaccatactcaaaccgctggcccatggcacctcgggaagctggaaatggattttgacttctgtgagggaacaactgtggtcgtgaccgaagattgcggcaatagagggcccagcctaaggacaacgaccgcctctggaaaactgatcactgagtggtgctgtcgctcctgcacactcccgcctctgcggtacagaggcgaggacggttgttggtatgggatggaaattaggccacttaaggagaaggaagagaacttggttaattcactggtgaccgcgggacatggccagatcgataactttagtttaggtgtactcggcatggccctgttccttgaagagatgctgcgcactcgagtcgggacaaaacacgctattttgctcgtggcagtgagctttgtcaccctgataacgggaaatatgtcgttccgggacctaggccgtgttatggtgatggtaggggccactatgaccgatgacatcggaatgggcgtgacatacctggctctcctggccgcatttaaggtcagacccaccttcgcggccggtcttttgctgaggaaattaacttccaaggagctcatgatggctacaattgggatcaccctgctttctcagagcacaattcctgaaactatcctggagctaaccgatgccctcgcactgggaatgatggtgttgaaaatagttcgcaacatggaaaagtatcaactggctgtgacgatcatggccatttcatgcgtccccaatgcagtgatcttacggaacgcctggaaggttagttgtacaattctcgctgcggtgtccgtctctccactgcttctgaccagctcccagcagaaagccgactggatccctttggcactcactataaagggcctgaatcccaccgctatttttctaacaactctgtcaagaaccagcaaaaagaggagttggccacttaacgaggccatcatggccgtaggcatggtgtctatcctcgcttccagcctgttgaaaaatgacattccgatgacggggcctctggttgcaggaggtttactcacagtgtgctacgtcctgaccggccgatcggccgatcttgaactggagcgcgcggctgacgtgaagtgggaggatcaggccgaaatatcagggtctagtcccatcttgtccattactatcagcgaggacggatctatgagcattaaaaacgaagaggaggaacaaacactcaccatcctgatacggactggcctactggtaatctccggtgtgttcccagtctcaattcccatcacagcagccgcttggtatctttgggaggttaagaagcagagagcaggggtgctctgggatgtgcctagtccaccccctgtcggaaaagccgaactggaggacggcgcgtacaggattaagcagcgtggcatcttggggtatagccagataggagctggtgtgtacaaagaaggcacctttcacacgatgtggcatgttactcgcggggccgtattaatgcaccggggaaagagaattgagccgtcttgggcagatgtgaaaaaggacctgatctcctacggcggtgggtggaagctcgagggagaatggaaagagggcgaagaggtccaagtgctggcccttgaaccaggcaagaatcccagggctgttcagaccaaacctgggatcttcaagacaaacaccggaacaattggtgccgtgtcactggattttagtccaggcactagcgggtcccccatcgtcgaccgaaaaggaaaggtggtaggcttgtatggtaatggggtcgtgacccggtctggagcatacgtttcggctatagcccagacggaaaagagcattgaggataaccctgaaatcgaggacgatattttccgcaaaaagagactaacaatcatggacctgcatccgggcgcgggcaaaactaagaggtatctccccgccatagtgcgggaagcaattaaacgagggctgagaacccttatcttagctccaacacgcgtcgtggccgctgagatggaagaggcactgaggggactccctatccgttaccagacccccgccattaaggccgagcacactggtcgggaaatcgttgacttgatgtgtcatgctaccttcacaatgagactgctctcaccagtgagggtccctaactataatctgattataatggatgaggcgcactttacggaccccgcatccatcgccgctcgcggctacattagtactcgagtggaaatgggggaggccgcaggaatcttcatgaccgccacaccaccgggctctagagatccttttccccaaagcaacgctccaatcatggacgaggaacgggagattcccgaaaggtcctggaactcaggtcacgagtgggtaaccgatttcaaggggaaaactgtgtggtttgttccttctataaaggcgggaaacgacatcgccgcatgccttcgcaaaaatggcaagaaagtcattcagctgagccgtaagacattcgatagtgaatatgtgaagaccagagctaacgactgggattttgtggtcacgactgacatctccgagatgggcgccaatttcaaagcagagcgggtaattgatccaaggcgctgtatgaagcccgtgatcttgacagacggggaagaacgagttatactagccggacctatgccggtgacccatagctctgctgcccagagacggggtaggatcggccgcaaccccaagaatgaaaacgaccaatacatttacatgggggagcccctggaaaatgatgaggactgcgcgcactggaaggaggcaaaaatgctcttagataacatcaatacccctgaaggaattatcccctcaatgtttgagccagaaagagagaaggtcgacgccgtggatggcgaatataggctgcggggtgaggctcgtaaaactttcgttgaccttatgcgccgaggggatctgcctgtgtggctcgcctacaaggtcgctgcagagggcataaactatgccgacagaaagtggtgttttgatggaattaaaaataaccagatcttggaagagaacgtggaagtagagatttggacaaaggagggcgaaaggaaaaagctgaaaccccggtggctcgacgctcgcatctactccgatccactggcccttaaggagttcaaggagttcgcagcggggagaaaaagtctaaccctgaatttgataacagagatgggaaggttacctacttttatgacgcagaaggcccggaacgctctggacaatctcgccgtgctgcataccgcagaagctggtggccgagcctataaccacgcacttagcgagctgccggagacactcgaaactttgctgctactgaccctccttgccacagttaccgggggaatcttcctgtttttaatgtcgggcaaaggtattgggaagatgactttgggcatgtgctgcatcattacggcttctgtcctgctctggtacgcgcagatccaaccccactggatagccgcatccattatcctggagttctttcttatcgtgctgctcattccagaacctgagaaacagagaaccccacaggataatcagttgacatatgtggtcatcgctatactgactgttgtggccgccaccatggcaaacgaaatgggattcttagagaagacaaagaaagacctaggcctggggagcattaccactcaagagtcagaaagtaatatcctcgacattgatcttcgcccagcttctgcctggacactgtacgcggtagctacgacctttgtgactcctatgttgaggcattccatcgagaacagctcagtcaatgtgagtctgacagccatagcaaaccaggccaccgttctcatgggactgggtaagggctggccccttagcaaaatggacatcggggtgccgctcctggctattggatgttactcccaggtcaatccaatcaccttgacagcagccctgttactactggtagcgcactatgctattatcggccctggtctccaggccaaggcaactcgggaagcccaaaaacgtgctgccgcagggattatgaagaaccccacggtggatggcatcaccgttatagaccttgagccaattccctacgatcctaagttcgaaaaacagctgggacaggtgatgttgctgatcctctgcgtcacacaggtgctgatgatgagaactacctgggctctttgtgaggccttaacactggcgaccggcccgatctctactctctgggaggggaatcccggaaggttttggaacacgacaattgccgtcagcatggcaaatatattccgcggctcctatttggctggtgccgggctgctattttcaatcatgaagaacaccactaatacccggcgaggaacaggcaacattggtgaaactctgggcgagaaatggaagtctagactcaacgcacttgggaaaagtgagttccaaatctacaagaaatcgggcattcaggaggtggacaggaccctggctaaggagggcatcaagcgcggggaaacagatcatcacgccgttagccggggatccgccaaattgagatggtttgtggagcgtaatatggtaacgccagaaggcaaggtggtcgacctgggttgcgggaggggaggctggtcttattactgtggtggcctcaaaaacgttcgggaggtgaaggggctgaccaaaggaggccctgggcatgaggaaccaatacctatgtcaacttatggatggaatttagtccgccttcagagcggcgtggatgtattcttcacaccacccgagaagtgcgacaccctgctctgtgatatcggtgaatccagtcctaacccaactattgaggcggggcgaacactaagagtgctgaatttggttgaaaactggctgaataacaatacccaattttgcatcaaggtgctcaacccctacatgccgtctgtcattgagaaaatggaaacgcttcagaggaagtacggaggcgctctggtgcggaatcctttgagccgcaactcaacccacgagatgtattgggtctccaatgcaacaggcaacatcgtgagtagcgttaatatgatatctagaatgctgattaacaggttcactatgaaacacaagaaagccacctacgagccagacgtagatctcgggtccggaacacgaaacatcggtatcgaatcagagattcccaatttagacataatcggcaagcggattgaaaagatcaaacaggagcatgaaactagctggcactatgaccaggatcatccttacaagacctgggcttatcacgggtcgtacgagacaaaacaaaccggatctgccagttccatggtgaacggcgtcgtgcgtctgcttactaagccatgggacgttgtgcccatggtcacgcagatggcaatgacagataccactccgtttggtcagcagagagtgttcaaagagaaggtagacacccgcacacaagaacctaaggaggggacgaaaaagctgatgaggattaccgccgaatggctatggaaagagctcggaaagaaaaagactccccggatgtgtacaagagaggaatttacccgcaaagtgaggagcaatgctgcgctgggcgccatcttcactgatgagaacaagtggaagtcagcacgagaagctgttgaggacggccggttttgggaattggtcgatagagagaggaatctgcacctcgaggggaaatgcgaaacatgtgtgtataacatgatgggaaagcgcgagaagaaacttggtgagttcggcaaagccaaagggtcccgtgcaatatggtacatgtggctgggagcccggtttttagagttcgaagctctgggctttttgaatgaggaccattggttctctagaggtaacagcctcagtggggtggagggagaaggcctgcacaggctaggctacatccttcgcgatgtcgggaagaaagagggaggtgccatgtatgcggacgataccgcaggctgggacacacgaattactctggaagacctcaagaatgaggaaatggttaccaaccatatgaaaggggagcacaagaaactggccgaggctatctttaagttgacgtaccagaataaggtggtacgggtgcagagaccaacccctaggggaacagtcatggatattatctcccgcagagaccagcggggcagcggtcaagtggggacttatggactgaacaccttcacaaatatggaagcccagctcattaggcagatggagggcgaaggcatattcaaatctatccaacatcttactgcaaccgaggagattgctgcccagaactggctggctcgtgttgggcgagaacgcttatcaagaatggccatcagtggagatgactgcgtggtcaagcccatcgatgaccggtttgcatccgcgctgacggccttgaatgatatgggtaaagtgaggaaggacattcagcagtgggagccaagccgcggctggaacgattggacacaagtacccttctgctctcaccactttcatgaactcgttatgaaagacgggagagtgctggtcgtgccttgtcggaaccaggatgagctaataggaagggctcgaatctcgcagggcgccggttggtcacttaaggaaaccgcatgcctgggaaagagctacgctcagatgtggactctcatgtatttccaccgtagagacctgcgcttggccgcaaatgccatttgttccgcggtgccaagtcattgggtcccgacatctcggaccacttggagcatccacgctaaacacgagtggatgaccacagaggatatgttagccgtttggaacagggtgtggattcaagaaaatccctggatggaggacaagacgcctgtagaatcctgggaggaagtgccatacctgggaaaaagagaggaccagtggtgcggctcactcatcggccttaccagtcgcgcaacttgggccaagaacatacagacagctatcaatcaggtccggtctctgattgggaacgaggaatataccgattacatgcccagcatgaaaaggtttcgaagagaggaagaggaagccggagtgctatggtga

SEQ ID NO: 14386 - RNA, 9876 nt, synthetic construct
  misc_feature 1..9876: note = derived and/or modified CDS sequence (opt3) from DENV-2__FJ024477__SS-prME
  source 1..9876: mol_type = other RNA
accgcaggcgtgatcgtcatgctgattcccacagctatggcattccacctcactacgaggaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgctactcggctcgagaatctgatgtggaaacagattacccccgagttaaaccacatcctgtctgaaaatgaggtgaagctaacaataatgacgggggacatcaaaggaattatgcaggccggcaagcgctcgctcagacctcaaccaaccgaactgaaatatagctggaagacttgggggaaggcaaaaatgctttccacagagtcacataaccagaccttcttgatcgatggaccggaaacagcggagtgccccaatactaacagggcttggaatagtctggaggtggaagactacggctttggtgtcttcaccacgaacatttggctcaagctgcgtgagaaacaggacgtattttgtgattctaagttaatgagcgccgcaatcaaagacaatcgggccgtgcacgctgatatggggtattggatagaatccgccctgaacgacacatggaagatggagaaggcatcattcattgaggtgaaaagctgccactggcctaagtctcataccctttggtccaatggagtattggaaagtgagatgatcatccccaagaatttcgctggccccgtcagccagcacaactaccgacctggttatcatactcaaaccgccggcccatggcacctcgggaagctggaaatggattttgacttctgtgagggaacaactgtggttgtgaccgaagattgcggcaatagagggccctctctaaggacaacgaccgcgtccggaaaactgattactgagtggtgctgtcgctcatgcacactcccgcctctgcggtacagaggcgaggacggttgttggtacgggatggaaatcaggccacttaaggagaaggaagagaacttggtcaatagtctggtgaccgccggacatggccagattgataactttagcttaggtgttctcggcatggctctgttccttgaagagatgctgcgcactcgagtggggacaaaacacgcaatattgctcgccgctgtatcgtttgtcaccctgatcacgggaaatatgtccttccgggacctaggccgtgtgatggtgatggtcggggccactatgaccgatgacattggaatgggcgttacatatctggcactcctggcggcctttaaggtgagacccaccttcgctgccggtcttttgctgaggaaattaacttctaaggagctcatgatggcaacaatcgggattgctctgcttagccagtcaaccatccctgaaacaatactggagctaactgatgccctcgcactgggaatgatggtattgaaaatcgtgcgcaacatggaaaagtaccaactggccgtcaccattatggctatcagttgcgtgcccaatgcggttattttacagaacgcctggaaggtgtcctgtacgatcctcgcagtcgtgtctgttagcccactgcttctgacatcctcacagcagaaagctgactggatacctttggccctcaccattaagggcctgaatcccactgccatctttctaaccacactgagccggacaagtaaaaagagatcttggccacttaacgaggctatcatggcagtgggcatggtctccattctcgccagctcgctgttgaaaaatgacataccgatgaccgggcctctggtagcgggaggtttactcacggtgtgctatgttctgacaggcaggtcagctgatcttgaactggagcgagccgcagacgtgaagtgggaggatcaagccgaaatctctgggagttcccccattttgagcatcaccatttctgaggacggaagcatgtccatcaaaaacgaagaggaggaacagactctcacaatactgatccgcaccggcctactggtcatttcaggtgtgttcccagtaagtatccccattactgctgcagcctggtacctttgggaggtgaagaagcagcgggcgggggtcctctgggatgttcctagcccaccccctgtgggaaaagctgaactggaggacggcgcctatagaatcaagcagaggggcatattggggtactctcaaattggagccggtgtgtataaagaaggcacatttcacaccatgtggcatgtcacgcgtggggcagtgttaatgcaccgcggaaagcggatcgagccgtcctgggctgatgttaaaaaggacctgatctcatacggcggtgggtggaagctcgagggagaatggaaagagggcgaagaggtacaggtgctggcccttgaaccaggcaagaatcccagagcagtccagactaaacctgggattttcaagaccaacacaggaaccatcggtgctgtgagtctggattttagcccaggcacatccgggtctcccatagttgacaggaaaggaaaggtggtcggcttgtacggtaatggggtggtaactcgatcgggagcctatgtcagcgcgattgcccagaccgagaagtcaatcgaggataaccctgaaattgaggacgatatcttccggaaaaagcgcctaacgataatggacctgcatccgggcgcaggcaaaacaaagagatacctccccgctattgtgagggaagccatcaaacgggggctgcgaactcttatcttagctccaaccagagttgtggcagccgagatggaagaggccctgcgcggactccctattaggtatcaaacacccgctatcaaggcggagcacaccggtcgtgaaattgtcgacttgatgtgtcatgcaactttcaccatgcggctgctctccccagtgagagttcctaactacaatctgataatcatggatgaggcccactttacagaccccgctagtattgccgcaaggggctatatctctacgcgcgtggaaatgggggaggccgctggaatcttcatgactgcgaccccaccgggcagccgagatccttttccccagtccaacgccccaattatggacgaggaaagagagatacccgaacggtcatggaactctggtcacgagtgggtcacagatttcaaggggaaaaccgtgtggtttgtacctagcatcaaggcaggaaacgacattgctgcctgccttaggaaaaatggcaagaaagtgatccagctgagtcgcaagactttcgattccgaatacgttaagacacgtgcaaacgactgggattttgtcgtgaccacggacattagcgagatgggcgccaatttcaaagctgagagagtgatcgatccacggaggtgtatgaagcccgtcatattgactgacggggaagaacgcgtaatcctagccggacctatgccggtgacacattcttcagcggcacaacgaagaggtcggattggcaggaaccccaaaaatgaaaacgaccagtatatctacatgggggagcccctggaaaatgatgaggactgcgcccactggaaggaggctaaaatgctcttagataacattaatacccctgaaggaatcataccctccatgtttgagccagaacgcgagaaggttgacgccattgatggcgaatacagactgaggggtgaggctcggaaaaccttcgtggaccttatgcgtcgcggggatctgcctgtctggctcgcatataaggtggccgctgagggcatcaactacgccgaccgaaagtggtgttttgatggaattaaaaataaccagatcttggaagagaacgttgaagtggagatatggactaaggagggcgaaaggaaaaagctgaaacccagatggctcgacgcacggatctatagtgatccactggcgcttaaggagttcaaggagttcgccgctgggcgcaaaagcctaacactgaatttgattaccgagatgggaagattacctacatttatgactcagaaggccaggaacgcactggacaatctcgctgtcctgcatacggccgaagccggtggacgggcatacaaccacgctctttcggagctgccggagaccctcgaaacattgctgctactgactctccttgcgaccgtgacagggggaatcttcctgtttttaatgtctggcaaaggtattgggaagatgaccttgggcatgtgctgcatcataactgcctccgtactgctctggtatgcacaaattcagccccactggatcgctgccagcatcattctggagttctttcttatcgtgctgctcataccagaacctgagaaacagcgaacgccccaggataatcaattgacctacgttgtcattgccatcctgacagtggtggcagctactatggccaacgaaatgggattcttagagaagaccaagaaagacctaggcctggggtcaattacaacccaggagagtgaatctaatatcctcgacatagatcttagaccagcgtccgcttggactctgtatgccgtcgcaacaacgtttgttacccctatgttgcgccatagcatcgagaactcaagtgtgaatgtaagcctgactgccattgctaaccaggcaacagtgctcatgggactgggtaagggctggcccctttccaaaatggacatcggggtcccgctcctggccattggatgttactctcaggtgaatccaatcaccttgaccgcggctctgttactactggttgcccactacgcaattatcggccctggtctccaagccaaggctacaagggaagcccagaaacgggcagctgccgggataatgaagaaccccactgtggatggcattacggtcatcgaccttgagccaatcccctatgatcctaagttcgaaaaacagctgggacaggtaatgttgctgattctctgcgtgacccaagttctgatgatgcgtacaacttgggcgctttgtgaggccttaaccctggcaacaggcccgataagcaccctctgggaggggaatcccggaagattttggaacactacgatcgctgtgtccatggccaatattttcaggggctcatacttggccggtgctgggctgctattttctatcatgaagaacacaaccaatactcgccggggaaccggcaacattggtgaaacactgggcgagaaatggaagagtcgactcaacgcccttgggaaatcggagttccagatctataagaaaagcggaatacaggaggtcgacagaactctggccaaggagggcatcaagagaggggaaaccgatcatcacgcggtgtcccgcggatctgctaaattgcggtggtttgtcgagagaaatatggtgacaccagaaggcaaggttgtggacctgggttgcgggcgtggaggctggtcatactattgtggtggcctcaaaaacgtaagggaggtgaaggggctgacgaaaggaggccctgggcatgaagaaccaattcctatgagcacctacggatggaatttagtccggcttcaatccggcgttgatgtgttcttcactccacccgagaagtgcgacacactgctctgtgatatcggtgaaagttctcctaacccaaccattgaggcagggcgcactctacgagtcctgaatttggtggaaaactggctgaataacaatacacagttttgcatcaaggtactcaacccctatatgccgagcgtgatagagaaaatggaaacccttcagagaaagtacggaggcgccctggttaggaatcctttgtcacggaactccacgcacgagatgtactgggtgagtaatgctaccggcaacattgtcagctctgtgaatatgatctcccgcatgctgatcaacagattcacaatgaaacacaagaaagccacttatgagccagacgtcgatctcgggtcaggaaccaggaacattggtatagaaagcgagatccccaatttagacattatcggcaagcgaattgaaaagatcaaacaggagcatgaaacatcgtggcactacgaccaagatcatccttataagacttgggcataccacgggtcttatgagaccaaacagacaggaagtgcctccagcatggtgaacggcgttgtacggctgcttaccaagccatgggacgtggtccccatggtgactcagatggctatgacggatacaaccccgtttggtcagcaacgtgttttcaaagagaaggtggacactagaacccaggaacctaaggaggggacgaaaaagctgatgaaaataacagcggaatggctatggaaggagctcggcaaaaagaaaaccccacgcatgtgtactagggaggaatttacacggaaggtcagatcaaatgccgcactgggcgctatcttcaccgatgagaacaagtggaaatccgcccgcgaagcagtggaggacggcaggttttgggaattggtagatcgagagcggaatctgcacctcgaggggaagtgcgaaacttgtgtgtacaacatgatgggaaaaagagagaagaaacttggtgagttcggcaaggccaaggggtctagggctatttggtatatgtggctgggagcccgctttttagagttcgaagcgctgggctttttgaatgaggaccattggttcagccgtggtaacagtctctccggggttgagggagaaggcctgcaccggctaggctacatccttagagatgtcagcaaaaaggaagggggagcaatgtacgccgacgatacagctggttgggacaccaggattacactggaagacctcaaaaatgaggaaatggtgactaaccatatgaagggcgagcacaaaaagctggccgaggcaatctttaagttgacctatcagaataaagtggtccgcgttcagcgaccaacgcctcgggggaccgtgatggatattatatctagaagggaccaacgcggatcaggccaggtaggtacatacgggctgaacactttcaccaatatggaagctcagctcatcagacaaatggagggagaaggcattttcaagagtatccagcatcttacagccactgaggagatcgctgtgcagaactggctggcccgggtcggcagggaacgtttatcccgaatggcaattagcggggatgactgcgtggttaaacccatagatgaccgctttgcgtctgccctgaccgctttgaatgatatgggaaaggtgagaaaagacatccagcaatgggagccatcgcggggttggaacgattggacgcaggtccccttctgctcacaccactttcatgaactcgtgatgaaggacggcagggtactggttgtgccttgtcgcaaccaggatgagctaattgggagagcccggatcagccagggagcaggctggtcccttaaggaaacagcttgcctgggtaaaagttatgcccaaatgtggaccctcatgtacttccacaggcgagacctgcgtttggcagccaatgcgatttgttctgctgtcccaagccattgggtgccgacttccagaacaacctggtcaatccacgccaagcacgagtggatgactaccgaggatatgttagcagtgtggaaccgcgtctggatacaggaaaatccctggatggaggacaaaacacctgttgaaagttgggaggaagtgccatatctggggaagcgggaggaccagtggtgcggatctctcatcggccttacgagcagggccacctgggctaaaaacattcagactgccatcaatcaagtaagatccctgattggcaacgaggaatacacagattatatgccctcaatgaagcgctttcggagggaggaagaggaagcaggggtgctatggtga

SEQ ID NO: 14387 - RNA, 9876 nt, synthetic construct
  misc_feature 1..9876: note = derived and/or modified CDS sequence (opt3) from DENV-2__GQ868552__SS-prME
  source 1..9876: mol_type = other RNA
accgccggcgtgatcattatgctgatacccacagctatggctttccacctcactacgagaaacggggaacctcatatgatcgtcggaaggcaggaaaagggtaaaagccttctgtttaagaccgaggacggcgttaatatgtgcacattgatggccattgatttaggggaactgtgtgaggacactatcacctacaaatgcccacttctccggcaaaacgaaccggaggatattgactgttggtgcaattccacatctacctgggtgacttatggaacatgtaccacgactggcgagcaccgccgagaaaagcgttcagttgcgctggtgccccatgtcggtatggggcttgagaccagaacagaaacttggatgagtagcgagggagcttggaaacacgtgcagaggatcgagacctggatactgcggcatcctggcttcgccatcatggcagccattttggcttacacaatcggcaccacgcactttcagcgcgcactcattttcatcctgctgactgccgttgctccatccatgacaatgagatgcatagggatttctaacagggattttgtggaaggagtctcgggtggctcatgggtggacatcgtactcgagcacgggagctgtgttaccactatggccaagaataagcccacattagatttcgaactgattaaaaccgaggcgaagcagcctgcaacgcttcggaaatattgcatcgaagccaagttgaccaacacaactaccgagagtcgctgtccaacacaaggagagccctccctgaatgaagaacaggacaaacgatttatctgcaagcattctatggtggatagaggctggggtaacgggtgtggactattcggcaagggcgggattgtcacttgcgctatgtttacctgcaaaaagaatatggaaggaaaagtggtgctccctgagaacctggaatacacaatagtcatcaccccacacagcggtgaggagcatgccgttggcaatgacactgggaagcacggaaaagaaattaagatcacgccgcagtcctcaataacagaggcagaacttaccggctatggtactgtgaccatggagtgtagtcccaggacagggctggatttcaacgaaatggtattgctccagatggaggagaaggcttggctggtgcaccggcaatggtttttagacctgcctctcccatggcttcccggcgccgatacccagggaagcaattggattcagaaggaaactctggtcacattcaagaaccctcatgcgaaaaagcaggacgtggttgtgttgggctctcaagagggggccatgcacacggcactaaccggagctactgaaatccagatgtcctcaggtaatctgctctttacaggccatctgaaatgccgtcttcgcatggacaagctgcagttgaaagggatgagctacagtatgtgtaccggaaagttcaagatcgtcaaagagattgccgagacacaacacggcactatcgtgattagagtacagtatgaaggtgatgggtctccatgcaagatacccttcgagatcatggacctcgagaagaggcatgttctgggccggttaattaccgtgaacccgatcgtcacggagaaggattcccctgtgaacatcgaagctgagcccccatttggagacagctacattataatcggcgtcgagcctgggcagctgaaactaaattggttcaagaagggatcgtctattggtcagatgtttgaaaccacaatgcgaggcgccaaacgcatggcaatcctcggggatactgcctgggacttcggatccctgggcggtgtgtttacctcaattgggaaggcacttcaccaagttttcggcgcgatctacggagcagcctttagtggcgtgagctggacaatgaaaatattgatcggggtaattatcacttggattggaatgaactccagatctaccagcctgtcagtcagtctcgtgctggttggcgtggtcacgctttatctgggtgctatggtgcaggccgattccgggtgtgtagtgagctggaagaataaagagttgaagtgcggatctggcatcttcataacagacaacgttcacacctggactgaacagtacaagtttcagcccgagtcaccaagtaaactcgcaagcgccattcaaaaggctcatgaagagggtatctgtggcattaggtccgtcacacggctggagaatttaatgtggaaacagatcacccccgaactgaaccacatactatctgagaatgaagtgaagctcactatcatgaccggggatattaaaggaatcatgcaggccggcaagcgctcgctgagacctcagccaacagagcttaaatatagctggaagacgtgggggaaggcaaaaatgttgtccaccgaatcacataaccaaactttcctgattgacggaccggagacagcggagtgccccaataccaacagggcttggaatagtctcgaagtggaggattacggctttggtgtcttcacaactaacatctggctgaagttacgtgaaaaacaggacgtattttgtgactctaagctgatgagcgccgcaataaaagataatcgggccgtgcacgctgacatggggtattggattgagtccgcccttaacgatacctggaagatggagaaggcatcattcatcgaagtgaaaagctgccactggcctaagtctcatacgttgtggtccaatggagtactcgagagtgaaatgatcattcccaagaacttcgctggccccgtcagccagcacaactaccgacctggttatcatacacagaccgccggcccatggcacctggggaagctagagatggactttgatttctgtgaaggaactaccgtggttgtgacagaggactgcggcaatagagggccctctctgaggactaccacagcgtccggaaaactcatcacggagtggtgctgtcgctcatgcaccctgccgcctcttcggtacagaggcgaagatggttgttggtacgggatggagattaggccattgaaggaaaaggaggaaaacctggtcaatagtttagtgactgccggacatggccaaatagacaactttagcctcggtgttctgggcatcgctcttttcctggaggagatgttgcgcacacgagtggggaccaaacacgcaattctcctggtagccatctcgtttgtcactctaattacaggaaatatgtccttccgggatctgggccgtgtgatggtgatggtcggggctaccatgacggacgatatcggaatgggcgttacttatctcgccctgcttgcagcgtttaaggtgagacccaccttcgccgctggtttgctgttaaggcgcctcacatctaaagaactgatgatggccaccatagggatcgcacttctgagccagtcaactattcctgagacaatcctagaactcaccgacgctctggccttgggaatgatggtactgaagattgtgcggaacatggagaaataccagttagcagtcacaatcatggccataagttgcgtgcccaatgctgttattctcctgaacgcgtggaaggtgtcctgtactatccttgccgcagtctctgtgagcccactgttgctcacctcctcacaacagaaggctgattggatccctctggccctaacgattaaaggcctgaatcccacagccatatttcttaccactctcagcagaaccagtaagaaaaggtcttggccactgaacgaagctgttatggcagtgggcatggtctccatcttggccagctcgctgttaaagaatgacattccgatgacagggcctctcgtagcgggaggtctgcttactgtgtgctatgttctgaccggccgatcagctgacttggagctcgagcgcgccgcagatgtgaaatgggaagaccacgccgagatctctgggagttcccccattctgagcatcacgatatctgaagatggaagcatgtccatcaagaacgaggaggaagaacagacactaaccattctgatccggactggccttctcgtcatttcaggtgtgttcccagtaagtatccccataacagctgcagcctggtacctgtgggaagtgaaaaagcagagagcgggggtcttgtgggacgttcctagcccaccccctgtggagaaggctgaattagaggatggagcctataggattaaacaacgtggcatcctgggctactctcagatcggggcaggagtgtataaggagggtacctttcatactatgtggcacgtcacacgcggcgccgtgctcatgcatcgggggaaaagaattgaaccgtcctgggctgacgttaagaaagatctgatctcatacggaggcggttggaaacttgagggggaatggaaggagggagaagaggtacaggtgctggccttggagccaggcaaaaatcccagggcagtccagaccaagcctggcctattcaaaacgaacactgggaccataggagctgtgagtctggactttagcccaggtacatccggctctcccattgttgatcgaaaggggaaagtggtcggactctacggcaatggtgtggtaacccggtcgggggcctatgtcagcgcgatcgcccaaacagaaaagtcaattgagaacaaccctgaaatcgaggacgatatattccgcaagaaaagactgactattatggaccttcacccgggagcaggcaagaccaaaaggtacttacccgctatcgtgcgggaagccatcaagcgaggcctgagaacgctcattttggctccaacacgcgttgtggcagccgagatggaggaagccctgagggggctccctatccgttatcagactcccgctattcgggcggagcataccggaagagaaatagtcgatctgatgtgtcacgcaacattcaccatgaggcttctgtccccagtgcgcgttcctaattacaacttgatcattatggacgaggcccactttactgaccccgctagtatcgccgcacgaggttatatctctaccagagtggagatgggcgaagccgctgggattttcatgacagcgacgccaccgggaagccgggatccttttccccagtccaatgccccaataatggacgaggaaagggagatccccgaacgctcatggaactctggccatgagtgggtcactgatttcaaaggtaagaccgtgtggtttgtacctagcattaaggcagggaatgacatcgctgcctgcctacgtaaaaacggaaagaaagtgattcagctgagtagaaagacattcgattccgagtacgttaaaacccgggcaaatgactgggattttgtcgtgactacagacatcagcgaaatgggcgccaacttcagggctgagcgcgtgatagatccacgaagatgtatgaagcccgtcatcctcaccgacggcgaagaacgggtaattttagccgggcctatgccggtgacgcactcttcagcggcacaaaggcgcggaagaatcggtaggaatccaaagaacgaaaatgatcagtatatttacatgggcgagcccctggagaacgacgaagactgcgcccattggaaagaggctaagatgcttctggataatatcaacactcctgaagggataattccctccatgtttgagccagaacgggagaaagttgacgccatcgatggagagtaccgtctccgcggcgaagctcgaaagacattcgtggacttgatgagaaggggtgatctgcctgtctggctcgcatatcgggtggccgctgaggggattaattacgccgaccgcagatggtgttttgatggcatcaaaaacaaccagatactggaagagaatgttgaggtggaaatctggaccaaggagggagaaaggaagaaacttaaaccccggtggctagacgcacgaatttatagtgatccactggcgttgaaagagttcaaggagttcgccgctggcagaaagagcttaaccctgaacctcatcactgagatggggcgcctgcctacatttatgacccaaaaggccagggacgcacttgataatctgtcggtcctccacacagctgaggccggaggtcgggcatacaaccacgccttgtctgaactgccggagactctagaaacgctgctccttctgaccttattggctacagtgactggcgggattttcctgtttctcatgtccggaaaaggcatcggtaagatgaccctggggatgtgctgcataattacagcgagcatccttctgtggtatgcccagatccagccccattggattgcagcttcaatcatactcgagttctttttgattgtactgttaatcccagaacctgagaagcagcgtaccccacaagacaatcagctaacttacgtggttattgccatcctgacggtcgtggccgcaaccatggctaacgagatgggcttcctcgagaaaacaaagaaagatcttggactgggcagtataactacccaggagccagaatctaatatcttggacattgacctgagacctgcctccgcgtggacactctatgctgtggccaccacttttgtcacacccatgctgaggcacagcatcgagaactcaagtgttaatgtgagccttacggcaattgccaaccaggctaccgtactcatggggctgggaaagggttggccgttgtccaaaatggatatcggcgtgccactgttagcaattgggtgttactctcaagtcaatcctatcactctaacagccgcgctgctccttctggtggctcattacgccataattggacccggcttgcaggcaaaggccacccgcgaagctcagaagcgggccgcagctggtatcatgaaaaacccaaccgttgacgggatcacagtgattgatctggagcccataccttatgacccgaagttcgagaaacagctcggccaagtcatgctgcttatcttatgcgtaactcaggtgctgatgatgcgaacgacctgggccctctgtgaagcgttgacactggccactggacccattagcaccctatgggagggcaatccagggagattttggaacacaaccatcgcagtttccatggctaatattttcaggggatcatacctggccggcgcaggtctcctattttctatcatgaagaacactacgaatacacgccgggggaccggaaacataggcgaaactctgggtgagaaatggaagagtagattgaacgctctgggcaagtcggagttccagatctataaaaagagcgggattcaggaagtggatcgtaccctcgccaaagagggaatcaagaggggcgaaacagaccaccatgccgtctcccgggggtctgcgaaactgcgctggtttgtggagcgaaatatggtcactcctgaaggaaaggtggttgatttaggctgcggtagagggggatggtcatactattgtggcggtcttaaaaacgtgagggaggtaaagggcctgaccaaaggcgggcccgggcacgaggaacctattccaatgagcacatacgggtggaatctcgtgcggctacaatccggagtcgacgttttcttcacgccccctgagaaatgcgataccctgttgtgtgacatcggcgaaagttctccaaaccccactatagaggctggtcgcacactgagagtgctcaatcttgtcgaaaactggctgaataacaatacccagttttgcattaaggtgttgaacccgtatatgcctagcgtaatcgagaaaatggagactctgcagaggaagtacgggggagcactcgtgcgaaatccattatcacggaactccacacacgaaatgtactgggttagtaatgccaccggcaacatcgtgagctctgtcaatatgatttcccgtatgctgataaacagattcacgatgaaacataagaaggctacctatgagcccgatgtggaccttggctcagggacacgcaacatcggaattgaaagcgagatccctaatctggatattatcggtaaaaggatagaaaagatcaaacaagagcacgagacttcgtggcattacgaccaggaccacccatataagacctgggcctaccacggctcttatgaaacaaaacagactgggagtgcatccagcatggtcaacggagtggttcggctactcaccaagccctgggatgtagtgccgatggtcacacagatggccatgaccgacactacgccttttggccaacagagagtgttcaaggagaaagttgatacacgcacccaggaacccaaggagggtactaaaaagctgatgaaaattaccgctgagtggttgtggaaggaactggggaagaaaaagacaccaaggatgtgtacgcgagaggaatttacccggaaagtgagatcaaatgcggccctcggagcaatcttcactgacgagaacaagtggaaatccgctagggaagccgtcgaggattctcgcttttgggagcttgtggaccgtgaacggaatctgcatttagagggcaagtgcgaaacatgtgtatacaacatgatgggcaaaagagagaagaagctgggggagttcggaaaagcaaagggtagcagggccatttggtatatgtggttgggcgctcgctttctcgagttcgaggccctggggtttctaaatgaagatcactggttcagtcgaggaaactcccttagcggcgtggagggtgaagggctgcatcggctcggatacatcctgagagacgtttctaaaaaggagggcggcgcgatgtacgcagatgacaccgccgggtgggatactaggattacattggaagacctgaaaaatgaggagatggtcaccaaccacatgaagggagaacataagaaactcgctgaggccatatttaaacttacatatcagaataaagtggtgcgcgtccaaagacctactccccggggtaccgttatggacatcatttcaaggcgtgatcagcgaggcagtggacaggtgggaacgtacggcctgaacaccttcacaaatatggaagcacagttaatccgccaaatggagggtgaggggatcttcaagtccattcagcacctgactgtaaccgaagagatagctgtgcagaactggttggccagagtcggacgggaaaggctcagccgcatggctatctctggcgacgattgcgtggttaaaccactggacgatagatttgcctcggcactaacagcgcttaatgacatgggcaaggtgcggaaggatattcaacagtgggagccctcaagggggtggaacgactggactcaggtccctttctgcagccaccattttcacgaactggtgatgaaagatggacgagtactcgttgtgccatgtcgtaaccaggacgagctgatcggtagagcccgcatttcccaaggcgctgggtggagtttgaaggagaccgcctgcttaggaaaatcttatgcacagatgtggacgctgatgtacttccatcggagggatctcagacttgctgccaatgcaatctgtagcgccgtcccgtcccactgggtgcccacatcacgcaccacttggagtatacacgcgaagcatgaatggatgacaaccgaggacatgctggctgtgtggaaccgggtctggatccaggaaaatccttggatggaggataaaactccagttgaatcttgggaggaggtgccctatctaggcaagagggaagaccagtggtgcggtagcctgattgggctcacctcccgagccacatgggcaaagaacatccaaacggccattaatcaggtaagatcattgatcggaaacgaggaatacaccgactatatgcctagcatgaaacggtttaggcgcgaggaagaggaggctggcgtgctgtggtga

SEQ ID NO: 14388 - RNA, 9876 nt, synthetic construct
  misc_feature 1..9876: note = derived and/or modified CDS sequence (opt3) from DENV-2__GQ868553__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataagcttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctacaagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacaggtgacccccgagttaaaccacattctgtctgaaaatgaggtcaagctaacaatcatgacgggggacataaaaggaatcatgcaggctggcaagcgctcgctcagacctcaaccaaccgaactgaaatatagctggaagacttgggggaaggccaaaatgctttccacagagtcacataaccagaccttcttgattgatggaccggaaacagcagagtgccccaatactaacagggcgtggaatagtctggaggttgaagactacggctttggtgtgttcaccacgaacatctggctcaagctgcgtgagaaacaggacgtgttttgtgattctaagttaatgagcgctgccattaaagacaatcgggcagtacacgccgatatggggtattggatcgaatccgctctgaacgacacatggaagatggagaaggcctcattcatagaggtcaaaagctgccactggcctaagtctcataccctttggtccaatggagtgttggaaagtgagatgattatcccaaaaaacttcgcaggccccgttagccagcacaactaccgacctggttatcatactcaaaccgtgggcccatggcacctcgggaagctggaaatggattttgacttctgtgagggaacaactgtcgtggttaccgaagattgcggcaatagagggccctctctaaggacaacgaccgcttccggaaaactgatcactgagtggtgctgtcgctcatgcacactcccgcctctgcggtacagaggcgaggacggttgttggtacgggatggaaattaggccacttaaggagaaggaagagaacttggtgaatagtctggtaaccgccggacatggccagatcgataactttagcttaggtgtcctcggcatggcgctgttccttgaagagatgctgcgcactcgagtggggacaaaacacgccattttgctcgtggctgtctcgtttgttaccctgataacgggaaatatgtccttccgggacctaggccgtgtgatggtaatggtgggggcaactatgaccgatgacatcggaatgggcgtcacatatctggccctcctggctgcctttaaggtgagacccaccttcgcagcgggtcttttgctgaggaaattaacttctaaggagctcatgatggccacaattgggatcgctctgcttagccagtcaaccattcctgaaacaatctttgagctgactgatgccctagcactcggaatgatggttctgaaaatagtgcgcaacatggaaaagtaccaattggctgtcaccatcatggccattagttgcgtgcccaatgcagttatcctgcagaacgcctggaaggtgtcctgtacgattttagctgcggtctctgtaagcccactcctgcttacatcctcacagcagaaagccgactggatccctctggcattgaccataaagggcctcaatcccactgctattttcctgaccacactaagccggactagtaaaaagagatcttggccactgaacgaggccatcatggccgtgggcatggtttccatccttgctagctcgctcctgaaaaatgacattccgatgaccgggcctttggtggcaggaggtctgttaacggtctgctatgtgctcacaggcaggtcagccgatctggaacttgagcgagcggctgacgtaaagtgggaggatcaagccgaaatatctgggagttcccccatcctgagcattaccatctctgaggacggaagcatgtccattaaaaacgaagaggaggaacagatcttgactatactcatccgcacaggcctgctagtgatttcaggtgtctttccagttagtatccccattaccgcagccgcttggtacctgtgggaggtgaagaagcagcgggcaggggtgctttgggatgtccctagcccaccccctgtggaaaaagccgagctcgaagacggagcgtatagaatcaagcagaggggcatactgggctactctcaaattggggctggagtttataaagagggtactttccacacaatgtggcatgtaacccgtggcgccgtgttgatgcaccgcgggaagcggatcgagccgtcctgggcagatgtcaaaaaggacttaatctcatacggaggcggttggaagctggaaggggagtggaaagaaggagaggaagtgcaggttctcgccctggagccaggcaagaatcccagagctgtgcagacgaaacctggcatttttaggactaacaccgggacaatcggagccgtcagtcttgatttcagcccaggtacctccggctctcccatagtggaccgaaaggggaaagtagtcggactgtacggcaatggtgtggttacacggtcgggggcatatgtgagcgctattgcccagactgagaagtcaatcgaagataaccctgagattgaagacgatatcttccgcaagaaaagattgaccataatggacctacatccgggagcgggcaagacgaaaaggtacctgcccgccattgtccgggaggcaatcaagcgaggcctcagaacactgatccttgctccaactcgcgtggttgccgctgaaatggaggaggcattaagggggctgcctattcgttatcaaacccccgccatcaaagccgaacacacaggacgggagattgtggacctcatgtgtcatgctacctttactatgagattgctgtccccagtcagggtgcctaactacaatctcataatcatggatgaagcgcacttcaccgaccccgcaagtattgccgctcgcggttatatctctacacgagtagagatgggcgaggccgcagggatctttatgacggccactccaccgggaagcagagatcctttcccccagtccaacgctccaattatggacgaagagcgggaaatacccgagaggtcatggaattctggccacgaatgggtgaccgattttaagggtaagacagtttggttcgtccctagcatcaaagcggggaacgacattgccgcatgcctgcgcaagaatggaaaaaaggtgatccagcttagtcgtaaaacctttgattccgagtacgtgaagactagagctaacgactgggatttcgtcgtaacaaccgacattagcgagatgggcgccaattttaaggcagaacgggtgatcgatccaaggcgctgtatgaaacccgttatactgacggacggcgaggaacgagtgatcttggccgggcctatgccggtcactcattcttcagctgcccaaagacggggaaggattggtcgcaacccaaagaatgagaacgaccagtatatctacatgggcgaacccctagagaatgatgaggactgcgcgcactggaaagaagcaaagatgctgctcgataacattaatacacctgaggggatcataccctccatgttcgaaccagagagagaaaaagtggacgccattgatggagagtacaggttacggggcgaggctcgtaagacctttgttgacctgatgcgccgaggtgatcttcctgtgtggctggcctataaagtcgctgcagaagggatcaactacgccgacagaaagtggtgtttcgatggcattaagaataaccagatcctcgaggaaaacgtggaggtagagatatggaccaaagaaggagagaggaagaaattgaagccccggtggctggacgctcgcatctatagtgatccactcgccctgaaagaattcaaggagtttgcagcgggcagaaagagccttactctaaatctgattacagaaatggggaggttgcctaccttcatgacacagaaagcccggaacgctttagacaatctggccgtgctccatactgcagaggctggaggtcgagcctacaaccacgcactgtcggagcttccggaaacgctggagaccctcttgctgctaacactgctcgccactgttaccggcgggatctttcttttcctgatgtctggaaagggcattggtaaaatgacattagggatgtgctgcatcataaccgcttccattttgctgtggtatgcgcaaatccagccccactggatcgccgcaagcattatcctcgaatttttcctgatagtccttctgattccagagcctgaaaagcagagaactccccaggataatcaactcacgtacgtggtgatcgctattttgaccgtcgttgccgccacaatggcaaacgagatgggctttctggagaaaactaagaaggacttaggactaggctcaatcaccacacaggaaagtgagtctaatatactggacatcgatctccgcccagcttccgcctggaccctttatgcggtggctactacattcgtaacgcctatgctgaggcatagcattgaaaactcaagtgtgaatgtcagcttgaccgccatcgcaaaccaggccactgtgctgatggggctcggaaaaggttggcccctgtccaagatggacattggcgttccgcttctcgctatcgggtgttactctcaggtgaatccaattacactgaccgcagccttgctgttactagtcgcgcactacgctatcataggacctggcctgcaagccaaagcaacccgggaggcccagaagcgtgctgccgcaggtattatgaaaaaccccacagtagatgggatcactgtgatcgacctcgaaccaattccctatgatcctaagtttgagaagcagcttggccaggttatgctgttgatactgtgcgtgacgcaagtcctcatgatgagaaccacatgggctctgtgtgaggcccttactttagcgaccggaccgatcagcacactgtgggaaggcaatcccgggaggttctggaacaccactattgccgtgtccatggcaaatatctttcgcggatcatacctcgctggcgccggtttgctgttctctattatgaaaaacacgacaaatacccggcgagggactggaaacatcggcgagaccctaggtgaaaagtggaaaagtagactgaacgcactcggcaagtcggagtttcagatatataaaaagagcgggatccaggaggtcgacaggacacttgctaaagaaggaattaagcgcggcgagactgatcatcacgccgtgtcccgggggtctgccaagctgagatggttcgttgaacgtaatatggtgaccccagagggaaaagtagtggacttgggctgcggtagggggggatggtcatactattgtggcggtctgaagaacgtccgggaagttaaaggcctcacaaaggggggacctggccatgaggagcccatccctatgagcacgtacgggtggaatctggtgcgcttacaatccggagtcgatgtgttctttaccccacccgaaaaatgcgacactcttctgtgtgatattggcgagagttctcctaacccaacaatcgaagcgggtcgaaccctcagagtactaaatctggtggagaactggttgaataacaatactcagttctgcataaaggttctgaacccctatatgccgagcgtgattgaaaagatggagacactccagaggaaatacgggggagctcttgtccggaatcctctgtcacgcaactccacccacgagatgtactgggtgagtaatgcaacgggcaacatcgtcagctctgtgaatatgatctccagaatgttgattaacaggtttaccatgaagcacaaaaaggccacatatgaaccagacgttgatctgggctcagggactcgaaacataggaatcgagagcgaaattcccaatctcgacatcattggtaaacggatcgagaagataaagcaggaacatgagacctcgtggcactacgaccaagatcatccttataaaacatgggcttaccacggctcttatgagactaagcagaccgggagtgcctccagcatggtaaacggagtggtccgtttactgacaaaaccatgggacgtggttcccatggtgacccagatggcaatgactgatacgacaccgttcggccagcaaagagtctttaaggaaaaagtggacacccgcactcaggagcctaaggaaggtaccaagaaacttatgaagatcacagccgagtggctgtggaaagagctagggaagaaaaagacgcccaggatgtgtacccgggaagagttcactagaaaagtacgctcaaatgctgcgctcggagccatttttacagatgaaaacaagtggaagtccgcaagggaggctgtggaagacggccgattctgggagctggttgatcgggagagaaatttgcacctggaaggcaaatgcgagacctgtgtctacaacatgatggggaagagggaaaaaaagctcggagagtttggtaaagccaagggctctcgcgcaatctggtatatgtggcttggggcccgtttcctggaatttgaggctttaggattcctgaatgaggaccattggtttagccggggcaacagtttgtccggtgtggaaggggagggactccacagactgggctacattctaagggatgtgggcaagaaagaagggggagccatgtacgcggacgatactgcaggttgggacacacgcatcacccttgaggacctgaagaatgaagagatggtcacaaaccatatgaaaggcgagcacaagaaactcgccgaagctattttcaagctgacttatcagaataaggttgtgcgagtacagcggccaacccctagagggacggtgatggatataatcagcaggcgcgaccaaagaggatctggccaggtcggtacctacgggttgaacacattcactaatatggaggcccagctgattcggcaaatggaaggagagggcatctttaaatcaatccagcatctcaccgcaacagaggaaattgctgcccagaactggcttgctagggtgggccgtgagcgactgagtcgcatggccatatccggggatgactgcgttgtgaagcccatcgatgacagattcgcaagcgcgttaactgccctgaatgatatgggaaaagtccggaaggacattcagcaatgggaaccatctaggggttggaacgattggacccaggtgcccttttgctcgcaccacttccatgagttggtaatgaaagacggccgcgttctcgtggtcccttgtagaaaccaggatgaactgatcgggcgggctaggatttcacagggagccggctggagcctaaaggagacggcatgccttggtaagtcctatgctcaaatgtggacactgatgtactttcaccgacgtgacctcagactggccgcaaatgccatctgtagtgcggtgccatctcattgggtgccgaccagccgcactacatggtccatacacgctaaacacgagtggatgaccactgaagatatgttggccgtctggaaccgggtttggatccaggagaatccctggatggaagacaagacccctgtggagtcatgggaagaggtaccatatttagggaaaagggaggaccagtggtgcggaagtctgattggcctcacatctagagcaacgtgggccaagaacatccagaccgctattaatcaagtgcgcagccttatcggcaacgaagagtacactgattatatgccctccatgaaacggttcaggcgagaagaggaagaggccggggtcctgtggtga

SEQ ID NO: 14389 - RNA, 9876 nt, synthetic construct
  misc_feature 1..9876: note = derived and/or modified CDS sequence (opt3) from DENV-2__GQ868554__SS-prME
  source 1..9876: mol_type = other RNA
accgcaggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggcaatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgatcgaaaaggactcccctgtcaacatcgaggccgaacccccatttggagatagctacattataatcggcgtggagcctgggcagttaaaactgaattggttcaagaagggatcgtctattggtcaaatgtttgagacaactatgcgaggcgctaaacgcatggccatcctaggggacaccgcatgggatttcggatccctcggcggtgtttttacatcaattgggaaggccctgcaccaggtgttcggcgctatctacggagcggcatttagtggcgtaagctggactatgaaaatacttatcggggtcgtgattacctggatcggaatgaactccagatctacgagcttgtcagttagtctggtgctcgtcggcgtggtaacactgtatcttggtgccatggtgcaggctgactccgggtgtgttgtcagctggaagaataaagaactgaagtgcggatctggcattttcatcaccgataacgtgcacacttggacagagcagtacaagtttcaacccgaatcaccaagtaaattggccagcgcaatacagaaggcccatgaggaaggtatttgtggcatcaggtccgtgacccggctcgagaatctgatgtggaaacagattactcccgagttaaaccacatcctgtctgaaaatgaggtcaagctaaccataatgacaggggacacgaaaggaatcatgcaggctggcaagcgctcgctcagacctcaaccaaccgaactgaaatatagctggaagacttgggggaaggccaaaatgctttccacagagtcacataaccagaccttcttgattgatggaccggaaacagttgagtgccccaatactaacagggcatggaatagtctggaggtggaagactacggctttggtgtgttcaccacgaacatctggctcaagctgcgtgagaaacaggacgtattttgtgattctaagttaatgagcgcggctattaaagacaatcgggccgtccacgcagatatggggtattggatcgaatccgccctgaacgacacatggaagatggagaaggcttcattcatagaggtgaaaagctgccactggcctaagtctcataccctttggtccaatggagttttggaaagtgagatgattatccccaagaatttcgccggccccgtgagccagcacaactaccgacctggttatcatactcaaaccgcaggcccatggcacctcgggaagctggaaatggattttgacttctgtgagggaacaactgtcgtggttaccgaagattgcggcaatagagggccctctctaaggacaacgaccgcttccggaaaactgatcactgagtggtgctgtcgctcatgcacactcccgcctctgcggtacagaggcgaggacggttgttggtacgggatggaaattaggccacttaaggagaaggaagagaacttggtgaatagtctggtaaccgccggacatggccagatcgataactttagcttaggtgtcctcggcatggcgctgttccttgaagagatgctgcgcactcgagtggggacaaaacacgccattttgctcgtggctgtctcgtttgttaccctgataacgggaaatatgtccttccgggacctaggccgtgtgatggtaatggtgggggcaactatgaccgatgacatcggaatgggcgtcacatatctggccctcctggctgcctttaaggtgagacccaccttcgcagcgggtcttttgctgaggaaattaacttctaaggagctcatgatggccacaattgggatcaccctgcttagccagtcaacaattcctgaaactatcctggagctaaccgatgctctcgccctgggaatgatggttttgaaaatagtgcgcaacatggaaaagtaccaactggcagtcacgatcatggctattagttgcgtgcccaatgccgttatcttacggaacgcatggaaggtgtcctgtacaattctcgccgctgtctctgtaagcccactgcttctgacctcctcacagcagaaagcggactggatccctttggccctcactataaagggcctgaatcccaccgcaatttttctaacaactctgagcagaaccagtaaaaagaggtcttggccacttaacgaggctatcatggccgtgggcatggtttccatcctcgccagctcgctgttgaaaaatgacattccgatgacggggcctctggtggctggaggtttactcacagtctgctatgtgctgaccggccgatcagcagatcttgaactggagcgcgccgcggacgtaaagtgggaggatcaggctgaaatatctgggagttcccccatcttgagcattactatctctgaggacggaagcatgtccattaaaaacgaagaggaggaacaaacactcaccatcctgatacggactggcctactggtgatctcaggtgtcttcccagttagtattcccatcacagccgcagcctggtacctttgggaggtgaagaagcagagagctggggtgctctgggatgtccctagcccaccccctgtgggaaaagcagaactggaggacggcgcctataggattaagcagcgtggcatcttggggtactctcagataggagcgggtgtttataaagaaggcacctttcacacgatgtggcatgtaactcgcggggctgtgttaatgcaccggggaaagagaattgagccgtcctgggccgatgtcaaaaaggacctgatctcatacggcggtgggtggaagctcgagggagaatggaaagagggcgaagaggtgcaagttctggcacttgaaccaggcaagaatcccagggccgtgcagaccaaacctgggatcttcaagacaaacaccggaacaattggtgctgtcagtctggattttagcccaggcacttccgggtctcccatcgtggaccgaaaaggaaaggtagtcggcttgtacggtaatggggtggttacccggtcgggagcctatgtgagcgcaatagctcagacggagaagtcaattgaggataaccctgaaatcgaggacgatattttccgcaaaaagagactaacaatcatggacctgcatccgggcgccggcaaaactaagaggtacctccccgcgatagtccgggaagccattaaacgagggctgagaacccttatcttagcaccaacacgcgtggttgctgccgagatggaagaggctctgaggggactccctatccgttatcagacccccgcaattaaggccgagcacactggtcgggaaatcgtggacttgatgtgtcatgccaccttcacaatgagactgctctccccagtcagggtgcctaactacaatctgattataatggatgaggctcactttacggaccccgcgagtatcgcagcccgcggctatatttctactcgagtagaaatgggggaggctgccggaatcttcatgaccgcaacaccaccgggcagcagagatccttttccccaatccaacgccccaatcatggacgaggaacgggagattcccgaaaggtcatggaactctggtcacgagtgggtgaccgatttcaaggggaaaactgtttggtttgtccctagcataaaggctggaaacgacatcgcggcctgccttcgcaaaaatggcaagaaagtgattcagctgagtcgtaagacattcgattccgaatacgtgaagaccagagcaaacgactgggattttgtcgtaacgactgacatcagcgagatgggcgctaatttcaaagccgagcgggtgattgatccaaggcgctgtatgaagcccgttatcttgacagacggggaagaacgagtgatactagcaggacctatgccggtcacccattcttcagccgctcagagacggggtaggatcggccgcaaccccaagaatgaaaacgaccaatatatttacatgggggagcccctggaaaatgatgaggactgcgcccactggaaggaggcgaaaatgctcttagataacatcaatacccctgaaggaattatcccctccatgtttgagccagaaagagagaaggtggacgcaatagatggcgaatacaggctgcggggtgaggcccgtaaaactttcgttgaccttatgcgccgaggggatctgcctgtgtggctcgcttataaggtcgccgctgagggcattaactacgcagacagaaagtggtgttttgatggaatcaaaaataaccagattttggaagagaacgtggaagtagagatctggacaaaggagggcgaaaggaaaaagctgaaaccccggtggctcgacgcccgcatatatagtgatccactggctcttaaggagttcaaggagttcgccgcagggagaaaaagcctaaccctgaatttgatcacagagatgggaaggttacctacttttatgacgcagaaggcgcggaacgccctggacaatctcgctgtgctgcataccgccgaagccggtggccgagcttacaaccacgccctttcggagctgccggagacactcgaaactttgctgctactgaccctccttgcaacagttaccgggggaattttcctgtttttaatgtctggcaaaggtatcgggaagatgactttgggcatgtgctgcattatcacggcctccgtcctgctctggtatgctcagatacaaccccactggattgcggccagcatcatcctggagttctttcttattgtgctgctcatcccagaacctgagaaacagagaaccccacaggataatcagttgacatacgtggtcatagcaattctgactgttgtggctgccaccatggccaacgaaatgggattcttagagaagacaaagaaagacctaggcctggggtcaatcaccactcaagagagtgaatctaatattctcgacatcgatcttcgcccagcatccgcttggacactgtatgccgtagcgacgacctttgtgactcctatgttgaggcatagcatagagaactcaagtgtcaatgtgagcctgacagctatcgccaaccaggcaaccgttctcatgggactgggtaagggctggcccctttccaaaatggacattggggtgccgctcctggccatcggatgttactctcaggtcaatccaattaccttgacagctgcactgttactactggtagcccactacgcgatcattggccctggtctccaggctaaggccactcgggaagcacaaaaacgtgccgctgccgggatcatgaagaaccccacggtggatggcataaccgttattgaccttgagccaatcccctatgatcctaagttcgaaaaacagctgggacaggtgatgttgctgatcctctgcgtcacacaggtgctgatgatgagaactacctgggcactttgtgaggctttaacactggccaccggcccgattagcactctctgggaggggaatcccggaaggttttggaacacgacaatagcggtctccatggccaatatcttccgcggctcatacttggccggtgctgggctgctattttctattatgaagaacaccactaatacccggcgaggaacaggcaacatcggtgaaactctgggcgagaaatggaagagtagactcaacgcccttgggaaatcggagttccaaatttataagaaaagcggaatccaggaggtggacaggaccctggcaaaggagggcataaagcgcggggaaacagatcatcacgctgtttcccggggatctgccaaattgagatggtttgtggagcgtaatatggtaacgccagaaggcaaggtggtcgacctgggttgcgggaggggaggctggtcatactattgtggtggcctcaaaaacgttcgggaggtgaaggggctgaccaaaggaggccctgggcatgaagaaccaatccctatgagcacttacggatggaatttagtccgccttcagtccggcgtggatgtattcttcacaccacccgagaagtgcgacaccctgctctgtgatattggtgaaagttctcctaacccaactatcgaggccgggcgaacactaagagtgctgaatttggttgaaaactggctgaataacaatacccaattttgcattaaggtgctcaacccctatatgccgagcgtcatcgagaaaatggaaacgcttcagaggaagtacggaggcgcgctggtgcggaatcctttgtcacgcaactccacccacgagatgtactgggtcagtaatgctacaggcaacatagtgagctctgttaatatgatttccagaatgctgatcaacaggttcactatgaaacacaagaaagcaacctatgagccagacgtagatctcgggtcaggaacacgaaacatcggtattgaaagcgagatacccaatttagacatcattggcaagcggatcgaaaagattaaacaggagcatgaaacttcgtggcactacgaccaggatcatccttataagacctgggcctaccacgggtcttatgagacaaaacaaaccggaagtgcttccagcatggtgaacggcgtcgtgcgtctgcttactaagccatgggacgttgtgcccatggtcacgcagatggccatgacagataccactccgtttggtcagcagagagtgttcaaagagaaggtagacacccgcacacaagaacctaaggaggggacgaaaaagctgatgaggatcaccgcagaatggctatggaaagagctcggaaagaaaaagactccccggatgtgtacaagagaggaatttacccgcaaagtgaggtcaaatgccgctctgggcgcgatattcactgatgagaacaagtggaagtccgcccgagaagcagttgaggacggccggttttgggaattggtcgatagagagaggaatctgcacctcgaggggaaatgcgaaacatgtgtgtacaacatgatgggaaagcgcgagaagaaacttggtgagttcggcaaagctaaagggtctcgtgccatctggtatatgtggctgggagcacggtttttagagttcgaagccctgggctttttgaatgaggaccattggttcagcagaggtaacagtctctccggggtggagggagaaggcctgcacaggctaggctacattcttcgcgatgtcgggaagaaagagggaggtgctatgtacgccgacgataccgcgggctgggacacacgaatcactctggaagacctcaagaatgaggaaatggttaccaaccatatgaaaggggagcacaagaaactggcagaggccatttttaagttgacgtatcagaataaggtggtacgggtgcagagaccaacccctaggggaacagtcatggatatcattagccgcagagaccagcggggctctggtcaagtggggacttacggactgaacaccttcacaaatatggaagctcagctcataaggcagatggagggcgaaggcatcttcaaatcaattcaacatcttactgccaccgaggagatcgcagttcagaactggctggctcgtgtggggcgagaacgcttaagtagaatggccatctccggagatgactgcgtcgtgaagcccattgatgaccggtttgctagcgccctgacggcattgaatgatatgggtaaagtaaggaaggacatacagcagtgggagccatctcgcggctggaacgattggacacaagttcccttctgctcgcaccactttcatgaactcgtgatgaaagacgggagagtcctggtggtgccttgtcggaaccaggatgagctaatcggaagggcgcgaatttcacagggcgccggttggagccttaaggaaaccgcttgcctggggaagtcctatgcccagatgtggactctcatgtacttccaccgtagagacctgcgcttggcagctaatgccatctgtagtgcagtcccatctcattgggttccgacaagccggaccacttggtccattcacgccaaacacgagtggatgaccacagaggatatgttagcggtgtggaacagggtatggatccaagaaaatccctggatggaggacaagacgcctgtggaatcatgggaggaagtcccatatctgggaaaaagagaggaccagtggtgcggcagtctcataggccttacctctcgcgctacttgggccaagaacatccagacagcaattaatcaggtgcggagcctgatcgggaacgaggaatacaccgattatatgccctccatgaaaaggtttcgaagagaggaagaggaagccggagttctatggtga

SEQ ID NO: 14390 - RNA, 9876 nt, synthetic construct
  misc_feature 1..9876: note = derived and/or modified CDS sequence (opt3) from DENV-2__GQ868555__SS-prME
  source 1..9876: mol_type = other RNA
accgccggcgtgatcgtcatgctgattcccacagctatagcattccacctcactacgagaaacggggagcctcatatgatcgttggaaggcaggaaaagggtaaaagccttctgtttaagaccgaggacggcgtgaatatgtgcacattgatggccattgatttaggggaactgtgtgaggacactatcacctacaaatgcccactactccggcaaaacgaaccggaggatattgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggatcgagacctggatactgcggcatcctggcttcacaatcatggccgcaattttggcctacaccatcggcacgactcactttcagcgcgctctcattttcatcctgctgacagcagtggccccatccatgaccatgagatgcatagggatttctaacagggattttgtcgaaggagtgtcgggtggctcatgggtagacatcgttctcgagcacgggagctgtgtgactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggattgtgacctgcgccatgtttacatgcaaaaagaatatggaaggaaaagtggtccagcctgagaacctcgaatacaccatagttatcactccacacagcggtgaggagcatgctgtgggcaatgacacggggaagcacggaaaagaaattaagatcacaccgcagtcctcaataaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggattcagaaggagacacttgtgacgttcaagaaccctcatgccaaaaagcaagacgttgtggtcctgggctctcaggaaggggcgatgcacaccgccttgactggagcaacagagatccagatgtcctcaggtaatctactgtttaccggccatctcaaatgccgtctgcgcatggataagcttcaactgaaagggatgagctacagtatgtgtacaggaaagttcaagatcgtgaaagaaattgctgagactcagcacggcaccatcgtaattagagttcagtatgagggtgacgggtctccatgcaagatacccttcgaaatcacggatttggagaaaaggcatgtgctcggccggctgattaccgtcaacccgatcgtgacagaaaaggactcccctgtcaacatcgaggccgaacccccatttggagatagctacattataatcggcgtggagcctgggcagttaaaactgaattggttcaagaagggatcgtctattggtcaaatgtttgagactaccatgcgaggcgctaaacgcatggccatcctaggggacacagcatgggatttcggatccctcggcggtgtttttacttcaattgggaaggccctgcaccaggtgttcggcgctatctacggagcggcatttagtggcgtaagctggaccatgaaaatacttatcggggtcgtgattacgtggatcggaatgaactccagatctacaagcttgtcagttagtctggtgctcgtcggcgtggtaaccctgtatcttggtgccatggtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacaccaaaggaatcatgcaggctggcaagcgctcgctcagacctcaaccaactgaactgaaatatagctggaagacatgggggaaggccaaaatgctttccaccgagtcacataaccagacattcttgattgatggaccggaaactgcagagtgccccaataccaacagggcgtggaatagtctggaggttgaagactacggctttggtgtgttcacgacaaacatctggctcaagctgcgtgagaaacaggacgtgttttgtgattctaagttaatgagcgctgccattaaagacaatcgggcagtacacgccgatatggggtattggatcgaatccgctctgaacgacacctggaagatggagaaggcctcattcatagaggtcaaaagctgccactggcctaagtctcatactctttggtccaatggagtgttggaaagtgagatgattatcccaaaaaacttcgcaggccccgttagccagcacaactaccgacctggttatcatacccaaacagctggcccatggcacctcgggaagctggaaatggattttgacctatgtgagggaactaccgtggtcgtgacagaagattgcggcaatagagggccctctctgaggacgaccactgcctccggaaaactcatcacagagtggtgctgtcgctcatgcaccctgccgcctcttcggtacagaggcgaggacggttgttggtacgggatggaaattaggccattgaaggagaaggaagagaacctggttaatagtttagtgactgcgggacatggccagatcgataacttcagcctcggtgtactgggcatggccctttttctggaagagatgttgcgcacacgagtcgggaccaaacacgctattctcctggtggcagtgtcgttcgtcacgctaataactggaaatatgtcctttcgggacctgggccgtgttatggtgatggtaggggccaccatgacagatgacatcggaatgggcgtgacctatctcgctctgcttgccgcattcaaggtcagacccacttttgcggccggtttgctgttaaggaaactcacatctaaggagctgatgatggctaccattgggatcgcccttctgagccagtcaacaattcctgaaactatcctagagctcaccgatgcactggctttgggaatgatggtgctgaaaatagttcgcaacatggaaaagtaccaattagccgtgacgatcatggcaattagttgcgtccccaatgccgtgatcctccggaacgcttggaaggtttcctgtacaattctggcggccgtgtctgtcagcccacttctgttgacctcctcacagcagaaagcagactggatccctctcgctctgactataaagggcctaaatcccaccgccattttcctgacaactcttagcagaaccagtaaaaagaggtcttggccactcaacgaggccatcatggctgtaggcatggtgtccatcctggcaagctcgttgctgaaaaatgacattccgatgacggggcctttagttgccggaggtctcctgacagtgtgctatgtccttaccggccgatcagcggatctggaattggagcgcgctgccgaggtgaagtgggaagaccaggcagagatatctgggagttcccccatcctcagcattactatctctgaagatggaagcatgtccattaaaaacgaggaggaagagcaaacactgaccatcctaatacggactggcctgcttgtaatctcaggtgtgtttccagtcagtattcccatcacagccgctgcatggtacctctgggaagttaagaagcagagagccggggtgctgtgggacgtgcctagcccaccccctgtcggaaaagcggagttggaagagggcgcttataggattaagcagcgtggcatcttagggtactctcagataggagccggtgtgtataaagagggcaccttccacacgatgtggcatgttactcgcggggcagtactgatgcaccggggaaagagaattgaaccgtcctgggccgatgtgaaaaaggacctcatctcatacggcggtgggtggaagctggagggagaatggaaagagggcgaagaggtccaagtgcttgctctggagccaggcaagaatcccagggccgttcagaccaaacctgggatctttaagacaaacaccggaacaattggtgcagtgagtttggatttcagcccaggcacttccgggtctcccatcgtcgaccgaaaaggaaaggtggtaggcctatacggtaatggggtcgtgacccggtcgggagcttatgttagcgccatagcgcagacggaaaagtcaattgaggataaccctgaaatcgaggacgatatttttcgcaaaaagagactgacaatcatggacctccatccgggcgccggcaaaactaagaggtacctgcccgcaatagtgcgggaagctattaaacgagggcttagaaccttaatcctggccccaacacgcgtcgtggctgcagagatggaggaagccctcaggggattgcctatccgttatcagacccccgccattaaggctgagcacactggtcgggaaatcgttgatctgatgtgtcatgcgaccttcacaatgagactcctgtccccagtgagggtccctaactacaatcttattataatggacgaggcacacttcacggaccccgccagtatcgctgcccgcggctatatttctactcgagtggagatgggggaagcagccggaatctttatgaccgctacaccaccgggcagcagagatcctttcccccaatccaacgcgccaatcatggacgaggaacgggagattcccgaaaggtcatggaattctggtcacgagtgggtaaccgattttaaggggaaaactgtgtggttcgttcctagcataaaggccggaaacgacatcgcagcttgcctgcgcaaaaatggcaagaaagtcattcagttgagtcgtaagacatttgattccgagtacgtgaagaccagagccaacgactgggatttcgtggtcacgactgacatcagcgaaatgggcgcaaattttaaagccgagcgggtaattgatccaaggcgctgtatgaagcccgtgatcctaacagacggggaagagcgagttatactggctggacctatgccggtgacccattcttcagccgcgcagagacggggtaggatcggccgcaacccaaaaaatgaaaacgatcaatatatttacatgggggagcccctcgagaatgacgaagactgcgcacactggaaggaggccaaaatgttactggataacatcaatacccctgaaggaattatcccctccatgttcgagccagaaagagagaaggtcgacgctatagatggcgagtacaggcttcggggtgaagcccgtaaaacttttgtggacctgatgcgccgaggggatctccctgtttggttggcttataaggtggcagccgagggcattaactacgctgacagaaagtggtgtttcgatggaatcaaaaataaccagattctggaagagaacgtcgaggtggaaatctggacaaaggagggcgaaaggaaaaagctcaaaccccggtggctggacgcccgcatatatagtgatccacttgcactaaaggagtttaaggaattcgcggccgggagaaaaagcctgaccttgaatttaatcacagagatgggaaggctgcctactttcatgacgcagaaggctcggaacgccctcgacaatctggcagtacttcataccgctgaggccggtggccgagcatacaaccacgccctgtcggaactcccggagacattggaaactctgctactgctcacccttctggctacagtgaccgggggaatttttttattcttgatgtctggcaaaggtatcgggaagatgactctgggcatgtgctgcattatcacggcgtccgttctcctgtggtatgcccagatacaaccccactggattgcagctagcatcatccttgagtttttcctgattgtcctcttgatcccagaacctgagaaacagagaaccccccaggataatcagctgacatacgtggtgatagccattttaactgtcgttgccgcaaccatggctaacgagatgggatttctagaaaagacaaagaaagacctgggcctcgggtcaatcaccactcaagagagtgaatctaatattcttgatatcgacctgcgcccagcctccgcgtggacattgtatgctgtggccacgaccttcgtaactcctatgctgaggcatagcatagagaactcaagtgtgaatgtcagcctcacagcaatcgccaaccaggctaccgtgctgatgggacttggtaagggctggcccctctccaaaatggacattggggttccgctgttggcaatcggatgttactctcaggtgaatccaattaccctgacagccgcgttactactgctcgtcgctcactacgccatcattggccctggtcttcaggcaaaggccactcgggaagctcaaaaacgtgccgcagctgggatcatgaagaaccccacggtagatggcataaccgtgattgacctggagccaatcccctatgatcctaagtttgagaaacagttgggacaggttatgctgctcatcctgtgcgtgacacaggtccttatgatgagaactacctgggccttatgtgaagcgctgacactcgccaccggcccgattagcactttgtgggaggggaatcccggaaggttctggaacacgacaatagcagtgtccatggctaatatctttcgcggctcatacctggccggtgcagggctactgttctctattatgaagaacaccactaatacccggcgaggaacaggcaacatcggtgaaactctcggcgagaaatggaagagtagacttaacgctctggggaaatcggagtttcaaatttataagaaaagcggaatccaggaagtcgacaggaccttggccaaggagggcataaagcgcggggaaacagatcatcacgccgtgtcccggggatctgcgaaactgagatggttcgttgagcgtaatatggtgacgccagaaggcaaggtagtggacctcggttgcgggaggggaggctggtcatactattgtggtggcctgaaaaacgtccgggaggttaaggggttaaccaaaggaggccctgggcatgaggaacccatccctatgagcacttacggatggaatcttgtgcgcctgcagtccggcgtcgatgtgtttttcacaccacccgagaagtgcgacaccctcctatgtgatattggtgaaagttctcctaacccaactatcgaggctgggcgaacactgagagtattgaatctggtggaaaactggctcaataacaatacccaattctgcattaaggttcttaacccctatatgccgagcgtgatcgagaaaatggagacgctgcagaggaagtacggaggcgcattggtccggaatcctctgtcacgcaactccacccacgaaatgtactgggtgagtaatgccacaggcaacatagtcagctctgtgaatatgatttccagaatgctcatcaacaggtttactatgaaacacaagaaagctacctatgagccagacgttgatttagggtcaggaacacgaaacatcggtattgaaagcgagatacccaatctggacatcattggcaagcggatcgaaaagattaaacaggagcatgagacttcgtggcactacgatcaggaccatccttataagacctgggcctaccacgggtcttatgaaacaaaacaaaccggaagtgcatccagcatggtaaacggcgtggtccgtcttctgactaagccatgggacgtggttcccatggtgacgcagatggccatgacagataccactccgttcggtcagcagagagtctttaaagagaaggtggacacccgcacacaagaacctaaggaggggacgaaaaagctaatgaaaatcaccgctgagtggctctggaaggaactgggaaaaaagaaaactcccaggatgtgtacacgggaggaattcaccagaaaggtacgctcaaatgcggccttgggcgcaatatttactgatgagaacaagtggaaatccgctagggaagccgtggaggacggccgattctgggagctggttgatcgggaaagaaatctccaccttgaggggaagtgcgaaacatgtgtctacaacatgatgggaaaaagggagaagaaactgggtgaatttggcaaggcaaaggggtctcgcgccatctggtatatgtggttaggagctcgtttcctggagtttgaggccttgggcttcctcaatgaagaccattggtttagccggggtaacagtctgtccggggtggagggagaaggcctacacagacttggctacattctgagggatgtgagcaaaaaggaggggggagcgatgtacgcagacgataccgccggttgggacacacgcatcactctcgaagatctgaaaaatgaggagatggtcaccaaccatatgaagggcgaacacaaaaagttggctgaggccattttcaagctgacgtatcagaataaagttgtgcgagtacagcggccaacccctagagggacagtgatggacatcatttctaggcgcgaccagagaggatcaggccaagtcggtacttacgggctcaacacctttacaaatatagaagcacagcttatccggcagatggagggagagggcattttcaagagtatccaacatctgactgctaccgaagagatcgccgtgcagaactggttagctagggttggccgtgaacgactgtcccgcatggccattagcggggatgactgcgtggtcaaacccatagatgacagattcgcatctgcgttgacggccctcaatgatatgggaaaggtgcggaaagacatccagcagtgggagccatcgaggggttggaacgattggacacaagtacccttttgctcacaccacttccatgaactggttatgaaggacggccgcgtgctagtcgtgccttgtagaaaccaggatgagcttattgggcgggctaggatcagccagggagccggctggtccctgaaggagaccgcatgcctcggtaaaagttatgctcagatgtggactctgatgtactttcaccgacgtgacttgagattagccgcaaatgccatttgttctgcggtgccaagccattgggtcccgacatcccgcaccacttggtcaatccacgctaagcacgaatggatgaccacagaggatatgctggccgtttggaaccgggtgtggatacaagaaaatccctggatggaggacaaaacgcctgtagaaagttgggaggaggtgccatatctcgggaagagggaagatcagtggtgcggatctcttatcggcctgaccagcagagcaacttgggccaaaaacattcagacagctatcaatcaggtccgctccctaattggcaacgaggaatacaccgactatatgccctcaatgaagcggttcaggcgagaggaagaggaggccggggtgctgtggtga

SEQ ID NO: 14391 - RNA, 9876 nt, synthetic construct
  misc_feature 1..9876: note = derived and/or modified CDS sequence (opt3) from DENV-2__GQ868556__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgatcgaaaaggactcccctgtcaacatcgaggccgaacccccatttggagatagctacattataatcggcgtggagcctgggcagttaaaactgaattggttcaagaagggatcgtctattggtcaaatgtttgagacaactatgcgaggcgctaaacgcatggccatcctaggggacaccgcatgggatttcggatccctcggcggtgtttttacatcaattgggaaggccctgcaccaggtgttcggcgctatctacggagcggcatttagtggcgtaagctggactatgaaaatacttatcggggtcgtgattacctggatcggaatgaactccagatctacgagcttgtcagttagtctggtgctcgtcggcgtggtaacactgtatcttggtgccatggtgcaggctgactccgggtgtgttgtcagctggaagaataaagaactgaagtgcggatctggcattttcatcaccgataacgtgcacacttggacagagcagtacaagtttcaacccgaatcaccaagtaaattggccagcgcaatacagaaggcccatgaggaaggtatttgtggcatcaggtccgtgacccggctcgagaatctgatgtggaaacagattactcccgagttaaaccacatcctgtctgaaaatgaggtcaagctaaccataatgacaggggacacgaaaggaatcatgcaggctggcaagcgctcgctcagacctcaaccaaccgaactgaaatatagctggaagacttgggggaaggccaaaatgctttccacagagtcacataaccagaccttcttgattgatggaccggaaacagcagagtgccccaatactaacagggcgtggaatagtctggaggttgaagactacggctttggtgtgttcaccacgaacatctggctcaagctgcgtgagaaacaggacgtgttttgtgattctaagttaatgagcgctgccattaaagacaatcgggcagtacacgccgatatggggtattggatcgaatccgctctgaacgacacatggaagatggagaaggcctcattcatagaggtcaaaagctgccactggcctaagtctcataccctttggtccaatggagtgttggaaagtgagatgattatccccaagaatttcgcaggccccgttagccagcacaactaccgacctggttatcatactcaaaccgctggcccatggcacctcgggaagctggaaatggattttgacttctgtgagggaacaactgtggtcgtgaccgaagattgcggcaatagagggccctctctaaggacaacgaccgcctccggaaaactgatcactgagtggtgctgtcgctcatgcacactcccgcctctgcggtacagaggcgaggacggttgttggtacgggatggaaattaggccacttaaggagaaggaagagaacttggttaatagtctggtgaccgcgggacatggccagatcgataactttagcttaggtgtactcggcatggccctgttccttgaagagatgctgcgcactcgagtcgggacaaaacacgctattttgctcgtggcagtgtcgtttgtcaccctgataacgggaaatatgtccttccgggacctaggccgtgttatggtgatggtaggggccactatgaccgatgacatcggaatgggcgtgacatatctggctctcctggccgcatttaaggtcagacccaccttcgcggccggtcttttgctgaggaaattaacttctaaggagctcatgatggctacaattgggatcaccctgcttagccagtcaacaattcctgaaactatcctggagctaaccgatgccctcgcactgggaatgatggtgttgaaaatagttcgcaacatggaaaagtaccaactggctgtgacgatcatggccattagttgcgtccccaatgcagtgatcttacggaacgcctggaaggtttcctgtacaattctcgctgcggtgtctgtcagcccactgcttctgacctcctcacagcagaaagccgactggatccctttggcactcactataaagggcctgaatcccaccgctatttttctaacaactctgagcagaaccagtaaaaagaggtcttggccacttaacgaggccatcatggccgtaggcatggtgtccatcctcgctagctcgctgttgaaaaatgacattccgatgacggggcctctggttgcaggaggtttactcacagtgtgctatgtcctgaccggccgatcagccgatcttgaactggagcgcgcggctgacgtgaagtgggaggatcaggccgaaatatctgggagttcccccatcttgagcattactatctctgaggacggaagcatgtccattaaaaacgaagaggaggaacaaacactcaccatcctgatacggactggcctactggtaatctcaggtgtgttcccagtcagtattcccatcacagcagccgcttggtacctttgggaggttaagaagcagagagcaggggtgctctgggatgtgcctagcccaccccctgtcggaaaagccgaactggaggacggcgcgtataggattaagcagcgtggcatcttggggtactctcagataggagctggtgtgtataaagaaggcacctttcacacgatgtggcatgttactcgcggggccgtattaatgcaccggggaaagagaattgagccgtcctgggcagatgtgaaaaaggacctgatctcatacggcggtgggtggaagctcgagggagaatggaaagagggcgaagaggtccaagtgctggcccttgaaccaggcaagaatcccagggctgttcagaccaaacctgggatcttcaagacaaacaccggaacaattggtgccgtgagtctggattttagcccaggcacttccgggtctcccatcgtcgaccgaaaaggaaaggtggtaggcttgtacggtaatggggtcgtgacccggtcgggagcatatgttagcgctatagcccagacggagaagtcaattgaggataaccctgaaatcgaggacgatattttccgcaaaaagagactaacaatcatggacctgcatccgggcgcgggcaaaactaagaggtacctccccgccatagtgcgggaagcaattaaacgagggctgagaacccttatcttagctccaacacgcgtcgtggccgctgagatggaagaggcactgaggggactccctatccgttatcagacccccgccattaaggccgagcacactggtcgggaaatcgttgacttgatgtgtcatgctaccttcacaatgagactgctctccccagtgagggtccctaactacaatctgattataatggatgaggcgcactttacggaccccgcaagtatcgccgctcgcggctatatttctactcgagtggaaatgggggaggccgcaggaatcttcatgaccgccacaccaccgggcagcagagatccttttccccaatccaacgctccaatcatggacgaggaacgggagattcccgaaaggtcatggaactctggtcacgagtgggtaaccgatttcaaggggaaaactgtgtggtttgttcctagcataaaggcgggaaacgacatcgccgcatgccttcgcaaaaatggcaagaaagtcattcagctgagtcgtaagacattcgattccgaatacgtgaagaccagagctaacgactgggattttgtggtcacgactgacatcagcgagatgggcgccaatttcaaagcagagcgggtaattgatccaaggcgctgtatgaagcccgtgatcttgacagacggggaagaacgagttatactagccggacctatgccggtgacccattcttcagctgcccagagacggggtaggatcggccgcaaccccaagaatgaaaacgaccaatatatttacatgggggagcccctggaaaatgatgaggactgcgcgcactggaaggaggcaaaaatgctcttagataacatcaatacccctgaaggaattatcccctccatgtttgagccagaaagagagaaggtcgacgccatagatggcgaatacaggctgcggggtgaggctcgtaaaactttcgtggaccttatgcgccgaggggatctgcctgtttggctcgcctataaggtggctgcagagggcattaactacgccgacagaaagtggtgttttgatggaatcaaaaataaccagattttggaagagaacgtcgaagtggagatctggacaaaggagggcgaaaggaaaaagctgaaaccccggtggctcgacgctcgcatatatagtgatccactggcccttaaggagttcaaggagttcgcagcggggagaaaaagcctaaccctgaatttgatcacagagatgggaaggttacctacttttatgacgcagaaggcccggaacgctctggacaatctcgccgtactgcataccgcagaagctggtggccgagcctacaaccacgcactttcggagctgccggagacactcgaaactttgctgctactgaccctccttgccacagtgaccgggggaattttcctgtttttaatgtctggcaaaggtatcgggaagatgactttgggcatgtgctgcattatcacggcttccgttctgctctggtatgcgcagatacaaccccactggattgccgcaagcatcatcctggagttctttcttattgtcctgctcatcccagaacctgagaaacagagaaccccacaggataatcagttgacatacgtggtgatagctattctgactgtcgttgccgccaccatggcaaacgaaatgggattcttagagaagacaaagaaagacctaggcctggggtcaatcaccactcaagagagtgaatctaatattctcgacatcgatcttcgcccagcttccgcctggacactgtatgcggtggctacgacctttgtaactcctatgttgaggcatagcatagagaactcaagtgtgaatgtcagcctgacagccatcgcaaaccaggccaccgtgctcatgggactgggtaagggctggcccctttccaaaatggacattggggttccgctcctggctatcggatgttactctcaggtgaatccaattaccttgacagcagccctgttactactggtcgcgcactacgctatcattggccctggtctccaggccaaggcaactcgggaagcccaaaaacgtgctgccgcagggatcatgaagaaccccacggtagatggcataaccgtgattgaccttgagccaatcccctatgatcctaagttcgaaaaacagctgggacaggttatgttgctgatcctctgcgtgacacaggtcctgatgatgagaactacctgggctctttgtgaggccttaacactggcgaccggcccgattagcactctctgggaggggaatcccggaaggttttggaacacgacaatagccgtgtccatggcaaatatcttccgcggctcatacttggctggtgccgggctgctattttctattatgaagaacaccactaatacccggcgaggaacaggcaacatcggtgaaactctgggcgagaaatggaagagtagactcaacgcacttgggaaatcggagttccaaatttataagaaaagcggaatccaggaggtcgacaggaccctggctaaggagggcataaagcgcggggaaacagatcatcacgccgtgtcccggggatctgccaaattgagatggtttgttgagcgtaatatggtgacgccagaaggcaaggtagtggacctgggttgcgggaggggaggctggtcatactattgtggtggcctcaaaaacgtccgggaggttaaggggctgaccaaaggaggccctgggcatgaagaaccaatccctatgagcacttacggatggaatttagtgcgccttcagtccggcgtcgatgtgttcttcacaccacccgagaagtgcgacaccctgctctgtgatattggtgaaagttctcctaacccaactatcgaggcggggcgaacactaagagtactgaatttggtggaaaactggctgaataacaatacccaattttgcattaaggttctcaacccctatatgccgagcgtgatcgagaaaatggaaacgcttcagaggaagtacggaggcgctctggtccggaatcctttgtcacgcaactccacccacgagatgtactgggtgagtaatgcaacaggcaacatagtcagctctgtgaatatgatttccagaatgctgatcaacaggttcactatgaaacacaagaaagccacctatgagccagacgttgatctcgggtcaggaacacgaaacatcggtattgaaagcgagatacccaatttagacatcattggcaagcggatcgaaaagattaaacaggagcatgaaacttcgtggcactacgaccaggatcatccttataagacctgggcttaccacgggtcttatgagacaaaacaaaccggaagtgcctccagcatggtaaacggcgtggtccgtctgcttactaagccatgggacgtggttcccatggtgacgcagatggcaatgacagataccactccgtttggtcagcagagagtcttcaaagagaaggtggacacccgcacacaagaacctaaggaggggacgaaaaagctgatgaggatcaccgccgaatggctatggaaagagctcggaaagaaaaagactccccggatgtgtacaagagaggaatttacccgcaaagtaaggtcaaatgctgcgctgggcgccatattcactgatgagaacaagtggaagtccgcacgagaagctgtggaggacggccggttttgggaattggttgatagagagaggaatctgcacctcgaggggaaatgcgaaacatgtgtctacaacatgatgggaaagcgcgagaagaaacttggtgagttcggcaaagccaaagggtctcgtgcaatctggtatatgtggctgggagcccggtttttagagttcgaagctctgggctttttgaatgaggaccattggttcagcagaggtaacagtctctccggggtggagggagaaggcctgcacaggctaggctacattcttcgcgatgtggggaagaaagagggaggtgccatgtacgcggacgataccgcaggctgggacacacgaatcactctggaagacctcaagaatgaggaaatggtcaccaaccatatgaaaggggagcacaagaaactggccgaggctatttttaagttgacgtatcagaataaggttgtgcgggtacagagaccaacccctaggggaacagtgatggatatcattagccgcagagaccagcggggctctggtcaagtcgggacttacggactgaacaccttcacaaatatggaagcccagctcataaggcagatggagggcgaaggcatcttcaaatcaattcaacatcttactgcaaccgaggagatcgctgtgcagaactggctggcccgtgttgggcgagaacgcttaagtagaatggctatctccggagatgactgcgtggtcaagcccattgatgaccggtttgccagcgcactgacggcgttgaatgatatgggtaaagtgaggaaggacatacagcagtgggagccatctcgcggctggaacgattggacacaagtacccttctgctcgcaccactttcatgaactcgttatgaaagacgggagagtgctggtcgtgccttgtcggaaccaggatgagctaatcggaagggcccgaatttcacagggcgctggttggagccttaaggaaaccgcctgcctggggaagtcctatgcacagatgtggactctcatgtacttccaccgtagagacctgcgcttggctgccaatgcaatctgtagtgccgtgccatctcattgggtcccgacaagccggaccacttggtccattcacgcgaaacacgagtggatgaccacagaggatatgttagctgtttggaacagggtgtggatccaagaaaatccctggatggaggacaagacgcctgtagaatcatgggaggaagtgccatatctgggaaaaagagaggaccagtggtgcggcagtctcataggccttacctctcgcgccacttgggcaaagaacatccagacagccattaatcaggtccggagcctgatcgggaacgaggaatacaccgattatatgccctccatgaaaaggtttcgaagagaggaagaggaagctggagtgctatggtga

SEQ ID NO: 14392 - RNA, 9876 nt, synthetic construct
  misc_feature 1..9876: note = derived and/or modified CDS sequence (opt3) from DENV-2__GQ868557__SS-prME
  source 1..9876: mol_type = other RNA
accgccggcgtgatcgtcatgctgattcccacagctatagcattccacctcactacgagaaacggggagcctcatatgatcgttggaaggcaggaaaagggtaaaagccttctgtttaagaccgaggacggcgtgaatatgtgcacattgatggccattgatttaggggaactgtgtgaggacactatcacctacaaatgcccactactccggcaaaacgaaccggaggatattgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggatcgagacctggatactgcggcatcctggcttcacaatcatggccgcaattttggcctacaccatcggcacgactcactttcagcgcgctctcattttcatcctgctgacagcagtggccccatccatgaccatgagatgcatagggatttctaacagggattttgtcgaaggagtgtcgggtggctcatgggtagacatcgttctcgagcacgggagctgtgtgactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggattgtgacctgcgccatgtttacatgcaaaaagaatatggaaggaaaagtggtccagcctgagaacctcgaatacaccatagttatcactccacacagcggtgaggagcatgctgtgggcaatgacacggggaagcacggaaaagaaattaagatcacaccgcagtcctcaataaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggattcagaaggagacacttgtgacgttcaagaaccctcatgccaaaaagcaagacgttgtggtcctgggctctcaggaaggggcgatgcacaccgccttgactggagcaacagagatccagatgtcctcaggtaatctactgtttaccggccatctcaaatgccgtctgcgcatggataagcttcaactgaaagggatgagctacagtatgtgtacaggaaagttcaagatcgtgaaagaaattgctgagactcagcacggcaccatcgtaattagagttcagtatgagggtgacgggtctccatgcaagatacccttcgaaatcacggatttggagaaaaggcatgtgctcggccggctgattaccgtcaacccgatcgtgacagaaaaggactcccctgtcaacatcgaggccgaacccccatttggagatagctacattataatcggcgtggagcctgggcagttaaaactgaattggttcaagaagggatcgtctattggtcaaatgtttgagactaccatgcgaggcgctaaacgcatggccatcctaggggacacagcatgggatttcggatccctcggcggtgtttttacttcaattgggaaggccctgcaccaggtgttcggcgctatctacggagcggcatttagtggcgtaagctggaccatgaaaatacttatcggggtcgtgattacgtggatcggaatgaactccagatctacaagcttgtcagttagtctggtgctcgtcggcgtggtaaccctgtatcttggtgccatggtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacaccaaaggaatcatgcaggctggcaagcgctcgctcagacctcaaccaactgaactgaaatatagctggaagacatgggggaaggccaaaatgctttccaccgagtcacataaccagacattcttgattgatggaccggaaactgcagagtgccccaataccaacagggcgtggaatagtctggaggttgaagactacggctttggtgtgttcacgacaaacatctggctcaagctgcgtgagaaacaggacgtgttttgtgattctaagttaatgagcgctgccattaaagacaatcgggcagtacacgccgatatggggtattggatcgaatccgctctgaacgacacctggaagatggagaaggcctcattcatagaggtcaaaagctgccactggcctaagtctcatactctttggtccaatggagtgttggaaagtgagatgattatcccaaaaaacttcgcaggccccgttagccagcacaactaccgacctggttatcatacccaaacagctggcccatggcacctcgggaagctggaaatggattttgacctatgtgagggaactaccgtggtcgtgacagaagattgcggcaatagagggccctctctgaggacgaccactgcctccggaaaactcatcacagagtggtgctgtcgctcatgcaccctgccgcctcttcggtacagaggcgaggacggttgttggtacgggatggaaattaggccattgaaggagaaggaagagaacctggttaatagtttagtgactgcgggacatggccagatcgataacttcagcctcggtgtactgggcatggccctttttctggaagagatgttgcgcacacgagtcgggaccaaacacgctattctcctggtggcagtgtcgttcgtcacgctaataactggaaatatgtcctttcgggacctgggccgtgttatggtgatggtaggggccaccatgacagatgacatcggaatgggcgtgacctatctcgctctgcttgccgcattcaaggtcagacccacttttgcggccggtttgctgttaaggaaactcacatctaaggagctgatgatggctaccattgggatcgcccttctgagccagtcaacaattcctgaaactatcctagagctcaccgatgcactggctttgggaatgatggtgctgaaaatagttcgcaacatggaaaagtaccaattagccgtgacgatcatggcaattagttgcgtccccaatgccgtgatcctccggaacgcttggaaggtttcctgtacaattctggcggccgtgtctgtcagcccacttctgttgacctcctcacagcagaaagcagactggatccctctcgctctgactataaagggcctaaatcccaccgccattttcctgacaactcttagcagaaccagtaaaaagaggtcttggccactcaacgaggccatcatggctgtaggcatggtgtccatcctggcaagctcgttgctgaaaaatgacattccgatgacggggcctttagttgccggaggtctcctgacagtgtgctatgtccttaccggccgatcagcggatctggaattggagcgcgctgccgaggtgaagtgggaagaccaggcagagatatctgggagttcccccatcctcagcattactatctctgaagatggaagcatgtccattaaaaacgaggaggaagagcaaacactgaccatcctaatacggactggcctgcttgtaatctcaggtgtgtttccagtcagtattcccatcacagccgctgcatggtacctctgggaagttaagaagcagagagccggggtgctgtgggacgtgcctagcccaccccctgtcggaaaagcggagttggaagatggcgcttataggattaagcagcgtggcatcttagggtactctcagataggagccggtgtgtataaagagggcaccttccacacgatgtggcatgttactcgcggggcagtactgatgcaccggggaaagagaattgagccgtcctgggccgacgtgaaaaaggatctcatctcatacggcggtgggtggaagctggaaggagagtggaaagaaggcgaggaagtccaagtgcttgctctggagccaggcaagaatcccagggccgttcagaccaaacctgggatctttaagacaaacaccggaacaattggtgcagtgagtttggacttcagcccaggcacttccgggtctcccatcgtcgatcgaaaaggaaaggtggtaggcctatacggtaatggggtcgtgacccggtcgggagcttatgttagcgccatagcgcagacggagaagtcaattgaagacaaccctgagatcgaagatgacatttttcgcaaaaagagactgacaatcatggatctccatccgggcgccggcaaaactaagaggtacctgcccgcaatagtgcgggaggctattaaacgagggcttagaaccttaatcctggccccaacacgcgtcgtggctgcagaaatggaggaggccctcaggggattgcctatccgttatcagacccccgccattaaggctgaacacactggtcgggagatcgttgacctgatgtgtcatgcgaccttcacaatgagactcctgtccccagtgagggtccctaactacaatcttattataatggacgaagcacacttcacggatcccgccagtatcgctgcccgcggctatatttctactcgagtggagatgggggaggcagccggaatctttatgaccgctacaccaccgggcagcagagaccctttcccccaatccaacgcgccaatcatggatgaagagcgggaaattcccgagaggtcatggaattctggtcacgaatgggtaaccgactttaaggggaaaactgtgtggttcgttcctagcataaaggccggaaacgatatcgcagcttgcctgcgcaaaaatggcaagaaagtcattcagttgagtcgtaagacatttgactccgagtacgtgaagaccagagccaacgattgggacttcgtggtcacgactgatatcagcgagatgggcgcaaattttaaagccgaacgggtaattgacccaaggcgctgtatgaagcccgtgatcctaacagatggggaggaacgagttatactggctggacctatgccggtgacccattcttcagccgcgcagagacggggtaggatcggccgcaacccaaaaaatgagaacgaccaatatatttacatgggggaacccctcgagaatgacgaggattgcgcacactggaaggaagccaaaatgttactggacaacatcaatacccctgagggaattatcccctccatgttcgaaccagagagagaaaaggtcgatgctatagacggcgagtacaggcttcggggtgaggcccgtaaaacttttgtggatctgatgcgccgaggggacctccctgtttggttggcttataaggtggcagccgaaggcattaactacgctgatagaaagtggtgtttcgacggaatcaaaaataaccagattctggaggaaaacgtcgaggtggagatctggacaaaggaaggcgagaggaaaaagctcaaaccccggtggctggatgcccgcatatatagtgacccacttgcactaaaggaatttaaggagttcgcggccgggagaaaaagcctgaccttgaatttaatcacagaaatgggaaggctgcctactttcatgacgcagaaggctcggaacgccctcgataatctggcagtacttcataccgctgaggccggtggccgagcatacaaccacgccctgtcggagctcccggaaacattggagactctgctactgctcacccttctggctacagtgaccgggggaatttttttattcttgatgtctggcaaaggtatcgggaagatgactctgggcatgtgctgcattatcacggcgtccgttctcctgtggtatgcccagatacaaccccactggattgcagctagcatcatccttgaatttttcctgattgtcctcttgatcccagagcctgaaaaacagagaaccccccaggacaatcagctgacatacgtggtgatagccattttaactgtcgttgccgcaaccatggctaacgagatgggatttctagagaagacaaagaaagatctgggcctcgggtcaatcaccactcaagaaagtgagtctaatattcttgacatcgacctgcgcccagcctccgcgtggacattgtatgctgtggccacgaccttcgtaactcctatgctgaggcatagcatagaaaactcaagtgtgaatgtcagcctcacagcaatcgccaaccaggctaccgtgctgatgggacttggtaagggctggcccctctccaaaatggatattggggttccgctgttggcaatcggatgttactctcaggtgaatccaattaccctgacagccgcgttactactgctcgtcgctcactacgccatcattggccctggtcttcaggcaaaggccactcgggaggctcaaaaacgtgccgcagctgggatcatgaagaaccccacggtagacggcataaccgtgattgatctggaaccaatcccctatgaccctaagtttgagaaacagttgggacaggttatgctgctcatcctgtgcgtgacacaggtccttatgatgagaactacctgggccttatgtgaggcgctgacactcgccaccggcccgattagcactttgtgggaagggaatcccggaaggttctggaacacgacaatagcagtgtccatggctaatatctttcgcggctcatacctggccggtgcagggctactgttctctattatgaagaacaccactaatacccggcgaggaacaggcaacatcggtgagactctcggcgaaaaatggaagagtagacttaacgctctggggaaatcggagtttcaaatttataagaaaagcggaatccaggaggtcgataggaccttggccaaggaaggcataaagcgcggggagacagaccatcacgccgtgtcccggggatctgcgaaactgagatggttcgttgaacgtaatatggtgacgccagagggcaaggtagtggatctcggttgcgggaggggaggctggtcatactattgtggtggcctgaaaaacgtccgggaagttaaggggttaaccaaaggaggccctgggcatgaggagcccatccctatgagcacttacggatggaatcttgtgcgcctgcagtccggcgtcgacgtgtttttcacaccacccgaaaagtgcgataccctcctatgtgacattggtgagagttctcctaacccaactatcgaagctgggcgaacactgagagtattgaatctggtggagaactggctcaataacaatacccaattctgcattaaggttcttaacccctatatgccgagcgtgatcgaaaaaatggagacgctgcagaggaagtacggaggcgcattggtccggaatcctctgtcacgcaactccacccacgagatgtactgggtgagtaatgccacaggcaacatagtcagctctgtgaatatgatttccagaatgctcatcaacaggtttactatgaaacacaagaaagctacctatgaaccagatgttgacttagggtcaggaacacgaaacatcggtattgagagcgaaatacccaatctggatatcattggcaagcggatcgagaagattaaacaggaacatgagacttcgtggcactacgaccaggaccatccttataagacctgggcctaccacgggtcttatgagacaaaacaaaccggaagtgcatccagcatggtaaacggcgtggtccgtcttctgactaagccatgggatgtggttcccatggtgacgcagatggccatgacagacaccactccgttcggtcagcagagagtctttaaagaaaaggtggatacccgcacacaagagcctaaggaagggacgaaaaagctaatgaaaatcaccgctgagtggctctggaaggagctgggaaaaaagaaaactcccaggatgtgtacacgggaagagttcaccagaaaggtacgctcaaatgcggccttgggcgcaatatttactgacgaaaacaagtggaaatccgctagggaggccgtggaagatggccgattctgggagctggttgaccgggagagaaatctccaccttgaagggaagtgcgagacatgtgtctacaacatgatgggaaaaagggaaaagaaactgggtgagtttggcaaggcaaaggggtctcgcgccatctggtatatgtggttaggagctcgtttcctggaatttgaggccttgggcttcctcaatgaggatcattggtttagccggggtaacagtctgtccggggtggaaggagagggcctacacagacttggctacattctgagggacgtgagcaaaaaggaagggggagcgatgtacgcagatgacaccgccggttgggatacacgcatcactctcgaggacctgaaaaatgaagagatggtcaccaaccatatgaagggcgagcacaaaaagttggctgaagccattttcaagctgacgtatcagaataaagttgtgcgagtacagcggccaacccctagagggacagtgatggacatcatttctaggcgcgatcagagaggatcaggccaagtcggtacttacgggctcaacacctttacaaatatggaggcacagcttatacggcagatggaaggagagggcatcttcaagagtattcaacatctgactgctaccgaggaaaacgccgtgcagaattggttagctagggttggccgtgagcgactgtcccgcatggccatcagcggggacgattgcgtggtcaaacccatcgacgatagattcgcatctgcgttgacggccctcaacgacatgggaaaggtgcggaaagatattcagcagtgggaaccatcgaggggttggaacgactggacacaagtacccttttgctcacaccacttccatgagctggttatgaaggatggccgcgtgctagtcgtgccttgtagaaatcaggacgaacttatagggcgggctaggatcagccagggagccggctggtccctgaaggagaccgcatgcctcggtaaaagttatgctcagatgtggactctgatgtactttcaccgacgtgatttgagattagccgcaaacgccatttgttctgcggtgccaagccattgggtcccgacatcccgcaccacttggtcaatccacgctaagcacgagtggatgaccacagaagacatgctggccgtttggaatcgggtgtggattcaagagaacccctggatggaagataaaacgcctgtagagagttgggaagaggtgccatatctcgggaagagggaggaccagtggtgcggatctcttatcggcctgaccagcagagcaacttgggccaaaaatatacagacagctatcaaccaggtccgctccctaattggcaatgaagagtacaccgactatatgccctcaatgaagcggttcaggcgagaagaggaagaggccggggtgctgtggtga

SEQ ID NO: 14393 - RNA, 9876 nt, synthetic construct
  misc_feature 1..9876: note = derived and/or modified CDS sequence (opt3) from DENV-2__GU131947__SS-prME
  source 1..9876: mol_type = other RNA
accgccggcgtgatcgtcatgctgattcccacagctatagcattccacctcactacgcggaacggggagcctcatatgatcgttggaaggcaggaaaagggtaaaagccttctgtttaagaccgaggacggcgtgaatatgtgcacattgatggccattgatttaggggaactgtgtgaggacactatcacctacaaatgcccactactccggcaaaacgaaccggaggatattgactgttggtgcaattccacatctacctgggtaacttatggaacatgtaccacgactggcgagcaccgccgagaaaagcgttcagtggcgctggtcccccatgtgggtatggggcttgagacccggacagaaacttggatgagtagcgagggagcttggaaacacgttcagaggatcgagacctggattctgcggcatcctggcttcacaatcatggccgcaattttggcctacaccatcggcacgactcactttcagcgcgctctcattttcatcctgctgacagcagtggccccatccatgaccatgaggtgcatagggatttctaacagggattttgtcgaaggagtgtcgggtggctcatgggtagacatcgttctcgagcacgggagctgtgtgactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggattgtgacctgcgccatgtttacatgcaaaaagaatatggaaggaaaagtggtccagcctgagaacctcgaatacaccatagttatcactccacacagcggtgaggagcatgctgtgggcaatgacacggggaagcacggaaaagaaattaagatcacaccgcagtcctcaataaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggattcagaaggagacacttgtgacgttcaagaaccctcatgccaaaaagcaagacgttgtggtcctgggctctcaggaaggggcgatgcacaccgccttgactggagcaacagagatccagatgtcctcaggtaatctactgtttaccggccatctcaaatgccgtctgcgcatggataaacttcaactgaaagggatgagctacagtatgtgtacaggaaagttcaagatcgtgaaagaaattgctgagactcagcacggcaccatcgtaattagagttcagtatgagggtgacgggtctccatgcaagatacccttcgaaatcacggatttggagaaaaggcatgtgctcggccggctgattaccgtcaacccgatcgtgacagaaaaggactcccctgtcaacatcgaggccgaacccccatttggagatagctacattataatcggcgtggagcctgggcagttaaaactgaattggttcaagaagggatcgtctattggtcaaatgtttgagactaccatgcgaggcgctaaacgcatggccatcctaggggacacagcatgggatttcggatccctcggcggtgtttttacttcaattgggaaggccctgcaccaggtgttcggcgctatctacggagcggcatttagtggcgtaagctggaccatgaaaatacttatcggggtcgtgattacgtggatcggaatgaactccagatctaccagcttgtcagttagtctggtgctcgtcggcgtggtaaccctgtatcttggtgccatggtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacaccaaaggaatcatgcaggctggcaagcgctcgctcagacctcaaccaactgaactgaaatatagctggaagacatgggggaaggccaaaatgctttccaccgagtcacataaccagacattcttgattgatggaccggaaactgcagagtgccccaataccaacagggcgtggaatagtctggaggttgaagactacggctttggtgtgttcacgacaaacatctggctcaagctgcgtgagaaacaggacgtgttttgtgattctaagttaatgagcgctgccattaaagacaatcgggcagtacacgccgatatggggtattggatcgaatccgctctgaacgacacctggaagatggagaaggcctcattcatagaggtcaaaagctgccactggcctaagtctcatactctttggtccaatggagtgttggaaagtgagatgattatccccaagaatttcgcaggccccgttagccagcacaactaccgacctggttatcatacccaaacagctggcccatggcacctcgggaagctggaaatggattttgacctatgtgagggaactaccgtggtcgtgacagaagattgcggcaatagagggccctctctgaggacgaccactgcctccggaaaactcatcacagagtggtgctgtcgctcatgcaccctgccgcctcttcggtacagaggcgaggacggttgttggtacgggatggaaattaggccattgaaggagaaggaagagaacctggttaatagtttagtgactgcgggacatggccagatcgataacttcagcctcggtgtactgggcatggccctttttctggaagagatgttgcgcacacgagtcgggaccaaacacgctattctcctggtggcagtgtcgttcgtcacgctaataactggaaatatgtcctttcgggacctgggccgtgttatggtgatggtaggggccaccatgacagatgacatcggaatgggcgtgacctatctcgctctgcttgccgcattcaaggtcagacccacttttgcggccggtttgctgttaaggaaactcacatctaaggagctgatgatggctaccattgggatcgcccttctgagccagtcaacaattcctgaaactatcctagagctcaccgatgcactggctttgggaatgatggtgctgaaaatagttcgcaacatggaaaagtaccaattagccgtgacgatcatggcaattagttgcgtccccaatgccatgatcctccggaacgcttggaaggtgtcctgtacaattctggcggccgtttctgtgagcccacttctgttgacctcctcacagcagaaagcagactggatccctctcgctctgactataaagggcctaaatcccaccgccattttcctgacaactcttagcagaaccagtaaaaagaggtcttggccactcaacgaggccatcatggctgtcggcatggtatccatcctggcaagctcgttgctgaaaaatgacattccgatgacggggcctttagtggccggaggtctcctgacagtttgctatgtgcttaccggccgatcagcggatctggaattggagcgcgctgccgaggtcaagtgggaagaccaggcagagatatctgggagttcccccatcctcagcattactatctctgaagatggaagcatgtccattaaaaacgaggaggaagaacaaacactgaccatcctaatacggactggcctgcttgtgatctcaggtgtatttccagtgagtattcccatcacagccgctgcatggtacctctgggaagtcaagaagcagagagccggggttctgtgggacgtgcctagcccaccccctgtgggaagggcggagttggaagatggcgcttatcgtattaaacagcgcggcatcttagggtactctcagataggagccggtgtctataaggagggcaccttccacacgatgtggcatgtgactagaggggcagttctgatgcacagaggaaaaaggattgagccgtcctgggccgacgtaaagaaagatctcatctcatacggcggtgggtggaagctggaaggagagtggaaggaaggcgaggaagtgcaagtccttgctctggagccaggcaaaaatccccgagccgtgcagaccaagcctgggatctttaaaacaaacaccggaacaattggtgcagttagtttggacttcagcccaggcacttccgggtctcccatcgtggatcggaagggaaaagtcgtgggcctatacggtaatggggtagtcacccgctcgggagcttatgtgagcgccatagcgcagacggagaagtcaattgaagacaaccctgagatcgaagatgacatttttagaaagaaaaggctgacaatcatggatctccatccgggcgccggcaagactaaacggtacctgcccgcaatagttcgagaggctattaagagagggcttcgcaccttaatcctggccccaacaagggtggtcgctgcagaaatggaggaggccctccgtggattgcctatccggtatcagacccccgccattaaagctgaacacactggtagagagatcgtggacctgatgtgtcatgcgaccttcacaatgaggctcctgtccccagttcgcgtgcctaactacaatcttattataatggacgaagcacacttcacggatcccgccagtatcgctgcccgaggctatatttctactagagtcgagatgggggaggcagccggaatctttatgaccgctacaccaccgggcagccgggaccctttcccccaatccaacgcgccaatcatggatgaagagagggaaattcccgagcgctcatggaactctggtcacgaatgggtgaccgactttaaggggaagactgtatggttcgtgcctagcataaaagccggaaacgatatcgcagcttgcctgcgtaagaatggcaaaaaggttattcagttgagtagaaaaacatttgactccgagtacgtcaagacccgggccaacgattgggacttcgtggtgacgactgatatcagcgagatgggcgcaaattttaaggccgaaagggtcattgacccacgccgatgtatgaaacccgtaatcctaacagatggggaggaaagagtgatactggctggacctatgccggttacccattcttcagccgcgcagcggaggggtcgcatcggcagaaacccaaagaatgagaacgaccaatatatttacatgggggaacccctcgagaatgacgaggattgcgcacactggaaagaagccaagatgttactggacaacatcaatacccctgagggaattatcccctccatgttcgaaccagagagggaaaaagtggatgctatagacggcgagtaccggcttcgtggtgaggcccgcaagacttttgtcgatctgatgcgaagaggggacctccctgtgtggttggcttataaagttgcagccgaaggcattaactacgctgataggaagtggtgtttcgacggaatcaagaataaccagattctggaggaaaacgtggaggtcgagatctggacaaaagaaggcgagcggaagaaactcaagccccgctggctggatgccagaatatatagtgacccacttgcactaaaagaatttaaggagttcgcggccgggagaaagagcctgaccttgaatttaatcacagaaatgggacggctgcctactttcatgacgcagaaagctcgaaacgccctcgataatctggcagtgcttcataccgctgaggccggtggcagagcatacaaccacgccctgtcggagctcccggaaacattggagactctgctactgctcacccttctggctacagtaaccgggggaatatttttattcttgatgtctggcaagggtatcgggaaaatgactctgggcatgtgctgcattatcacggcgtccgtgctcctgtggtatgcccagatacaaccccactggattgcagctagcatcatccttgaatttttcctgattgttctcttgatcccagagcctgaaaagcagcgcacaccacaggacaatcagctgacatacgtcgtgatagccattttaactgtggtcgccgcaaccatggctaacgagatgggatttctagagaaaacaaagaaggatctgggcctcgggtcaatcaccactcaagaaagtgagtctaatattcttgacatcgacctgaggccagcctccgcgtggacattgtatgctgttgccacgaccttcgtgactcctatgctgcggcatagcatagaaaactcaagtgtaaatgtgagcctcacagcaatcgccaaccaggctaccgtcctgatgggacttggtaaaggctggcccctctccaagatggatattggggtgccgctgttggcaatcggatgttactctcaggttaatccaattaccctgacagccgcgttactactgctcgtggctcactacgccatcattggccctggtcttcaggcaaaagccactcgtgaggctcaaaagagagccgcagctgggatcatgaaaaaccccacggtcgacggcataaccgtaattgatctggaaccaatcccctatgaccctaagtttgagaagcagttgggacaggtgatgctgctcatcctgtgcgttacacaggtgcttatgatgaggactacctgggccttatgtgaggcgctgacactcgccaccggcccgattagcactttgtgggaagggaatcccggacgcttctggaacacgacaatagcagtctccatggctaatatctttcggggctcatacctggccggtgcagggctactgttctctattatgaaaaacaccactaatacccgaagaggaacaggcaacatcggtgagactctcggcgaaaagtggaaaagtaggcttaacgctctggggaagtcggagtttcaaatttataaaaagagcggaatccaggaggtggatcgcaccttggccaaagaaggcataaagagaggggagacagaccatcacgccgtctccagaggatctgcgaagctgcgttggttcgtggaaaggaatatggttacgccagagggcaaagtggtagatctcggttgcgggcggggaggctggtcatactattgtggtggcctgaagaacgtgcgcgaagtcaaagggttaaccaagggaggccctgggcatgaggagcccatccctatgagcacttacggatggaatcttgttcgactgcagtccggcgtggacgtctttttcacaccacccgaaaaatgcgataccctcctatgtgacattggtgagagttctcctaacccaactatcgaagctgggagaacactgagggtgttgaatctggtagagaactggctcaataacaatacccaattctgcattaaggtgcttaacccctatatgccgagcgttatcgaaaagatggagacgctgcagcggaaatacggaggcgcattggtgcgcaatcctctgtcaagaaactccacccacgagatgtactgggtcagtaatgccacaggcaacatagtgagctctgtcaatatgatttccaggatgctcatcaaccgatttactatgaagcacaaaaaggctacctatgaaccagatgtggacttagggtcaggaacacggaacatcggtattgagagcgaaatacccaatctggatatcattggcaaacgtatcgagaagattaagcaggaacatgagacttcgtggcactacgaccaggaccatccttataaaacctgggcctaccacgggtcttatgagacaaagcaaaccggaagtgcatccagcatggttaacggcgtagtgagacttctgactaaaccatgggatgtcgtgcccatggttacgcagatggccatgacagacaccactccgttcggtcagcagcgcgtgtttaaggaaaaagtcgataccaggacacaagagcctaaggaagggacgaagaaactaatgaagatcaccgctgagtggctctggaaagagctgggaaagaaaaagactccccggatgtgtacaagagaagagttcacccgcaaagtgaggtcaaatgcggccttgggcgcaatatttactgacgaaaacaagtggaagtccgctcgagaggccgtagaagatggccggttctgggagctggtggacagagagaggaatctccaccttgaagggaaatgcgagacatgtgtttacaacatgatgggaaagcgcgagaaaaagctgggtgagtttggcaaagcaaaggggtctcgtgccatctggtatatgtggttaggagctcggttcctggaatttgaggccttgggcttcctcaatgaggatcattggtttagcagaggtaacagtctgtccggggtcgaaggagagggcctacacaggcttggctacattctgcgcgacgtgagcaagaaagaagggggagcgatgtacgcagatgacaccgccggttgggatacacgaatcactctcgaggacctgaagaatgaagagatggtgaccaaccatatgaaaggcgagcacaagaaattggctgaagccattttcaagctgacgtatcagaataaggtcgttcgggtgcagagaccaacccctagggggacagtaatggacatcatttctcgcagagatcagcggggatcaggccaagtgggtacttacgggctcaacacctttacaaatatggaggcacagcttataaggcagatggaaggagagggcatcttcaaaagtattcaacatctgactgctatcgaggaaatcgccgtccagaactggttagctcgtgtgggccgagagcgcctgtccagaatggccattagcggggacgattgcgttgtgaagcccatagacgatcggttcgcatctgcgttgaccgccctcaatgacatgggaaaagtcaggaaggatatccagcagtgggaaccatcgcgcggttggaacgactggacgcaagtgcccttttgctcacaccacttccatgagctggtaatgaaagatggcagagttctagtggtcccttgtcggaaccaggacgaacttattgggagggctcgaatcagccagggagccggctggtccctgaaggagacagcatgcctcggtaagagttatgctcagatgtggaccctgatgtactttcaccgtagagatttgcgcttagccgcaaatgccatttgttctgcggtgccaagccattgggtgccgacttcccggacaacctggtcaatccacgctaaacacgagtggatgactaccgaagacatgctggccgtctggaacagggtttggatacaagagaatccctggatggaagataagacacctgtggagagttgggaagaggtaccatatctcgggaaaagagaggaccagtggtgcggatctcttatcggcctgacgagccgcgcaacctgggccaagaacattcagactgctatcaatcaggtgcggtccctaattggcaacgaagagtacacagactatatgccctcaatgaaaaggttccgaagagaagaggaagaggccggggtcctgtggtga

SEQ ID NO: 14394 - RNA, 9876 nt, synthetic construct
  misc_feature 1..9876: note = derived and/or modified CDS sequence (opt3) from DENV-2__GQ868558__SS-prME
  source 1..9876: mol_type = other RNA
accgccggcgtgatcgtcatgctgattcccacagctatagcattccacctcactacgaggaatggggagcctcatatgatcgttggaaggcaggaaaagggtaaaagccttctgtttaagaccgaggacggcgtgaatatgtgcacattgatggccattgatttaggggaactgtgtgaggacactatcacctacaaatgcccactactcaagcaaaacgaaccggaggatattgactgttggtgcaattccacatctacctgggtaacttatggaacatgtaccacgactggcgagcaccggcgcgaaaaacgatcagtggcgctggtcccccatgtgggtatggggcttgagacccgtacagaaacttggatgagtagcgagggagcttggaagcacgttcagagaatcgagacctggatactgaggcatcctggcttcacaatcatggccgcaattttggcctacaccatcggcacgactcactttcagcgggctctcattttcatcctgctgacagcagtggccccatccatgaccatgcgctgcatagggatttctaacagagattttgtcgaaggagtgtcgggtggctcatgggtagacatcgttctcgagcacgggagctgtgtgactacaatggctaagaataaacccaccttagatttcgaactgattaagacggaggccaaacagcctgcgacccttaggaagtattgcatcgaagcaaaattgacaaacactaccacagagagtcggtgtccaactcaaggagagccctccctgaatgaggaacaggacaagcgctttatctgcaagcattctatggtcgatcgaggctggggtaacgggtgtggactattcggcaaaggcgggattgtgacctgcgccatgtttacatgcaagaaaaatatggaaggaaaggtggtccagcctgagaacctcgaatacaccatagttatcactccacacagcggtgaggagcatgctgtgggcaatgacacggggaaacacggaaaggaaattaaaatcacaccgcagtcctcaataaccgaggccgaactgactggctatggtaccgtaacaatggagtgtagtcccagaaccgggcttgatttcaacgaaatggtgctgttgcaaatggaggacaaggcatggctcgtccacaggcagtggtttctggatttacctctgccatggctccccggcgctgacactcagggaagcaattggattcagaaggagacacttgtgacgttcaaaaaccctcatgccaagaaacaagacgttgtggtcctgggctctcaggaaggggcgatgcacaccgccttgactggagcaacagagatccagatgtcctcaggtaatctactgtttaccggccatctcaagtgccggctgcgtatggataaacttcaactgaaggggatgagctacagtatgtgtacaggaaagttcaaaatcgtgaaggaaattgctgagactcagcacggcaccatcgtaattcgcgttcagtatgagggtgacgggtctccatgcaaaatacccttcgaaatcacggatttggagaagagacatgtgctcggcaggctgattaccgtcaacccgatcgtgacagaaaaagactcccctgtcaacatcgaggccgaacccccatttggagatagctacattataatcggcgtggagcctgggcagttaaagctgaattggttcaagaaaggatcgtctattggtcaaatgtttgagactaccatgcggggcgctaagcgaatggccatcctaggggacacagcatgggatttcggatccctcggcggtgtttttacttcaattgggaaagccctgcaccaggtgttcggcgctatctacggagcggcatttagtggcgtaagctggaccatgaagatacttatcggggtcgtgattacgtggatcggaatgaactcccgctctaccagcttgtcagttagtctggtgctcgtcggcgtggtaaccctgtatcttggtgccatggtgcaggctgactccgggtgtgttgtcagctggaaaaataaggaactgaagtgcggatctggcattttcatcactgataacgtgcacacatggaccgagcagtacaaatttcaacccgaatcaccaagtaagttggccagcgcaatacagaaagcccatgaggaaggtatttgtggcatcagatccgtgactaggctcgagaatctgatgtggaagcagattacccccgagttaaaccacatcctgtctgaaaatgaggtcaaactaacaataatgacgggggacaccaagggaatcatgcaggctggcaaacggtcgctccgccctcaaccaactgaactgaagtatagctggaagacatgggggaaagccaagatgcattccaccgagtcacacaaccagacattccttattgatggaccggaaactgcagagtgccccaataccaacagagcgtggaatagtttggaggttgaagactacggctttggtgtgttcacgacaaacatctggctgaaactcagggagaagcaggacgtgttttgtgattctaaactgatgagcgctgccattaaggacaatcgtgcagtacacgccgatatggggtattggatcgaatccgctttaaacgacacctggaagatggagaaagcctcattcatagaggtcaagagctgccattggcctaaatctcacactctgtggtccaatggagtgcttgaaagtgagatgattatcccaaagaacttcgcaggccccgttagccagcataactaccggcctggttatcacacccaaacagctggcccatggcatttggggaaactcgaaatggattttgacctgtgtgagggaactaccgtggtcgtgacagaagattgcggcaatcgagggccctctctaagaacgaccactgcctccggaaagctgatcacagagtggtgctgtaggtcatgcaccctcccgcctctgcgctaccggggcgaggacggttgttggtacgggatggaaattagaccacttaaggagaaagaagagaacttggttaatagtctggtgactgcgggacacggccagatcgataacttcagcttaggtgtactcggcatggccctgtttcttgaagagatgctgaggacacgcgtcgggaccaagcacgctattttgctcgtggcagtgtcgttcgtcacgctgataactggaaatatgtcctttcgagacctaggccgggttatggtgatggtaggggccaccatgacagatgacatcggaatgggcgtgacctatctggctctcctggccgcattcaaagtccgtcccacttttgcggccggtcttttgctgagaaagttaacatctaaagagctcatgatggctaccattgggatcgccctgcttagccagtcaacaattcctgaaactatcctggagctaaccgatgcactcgctctgggaatgatggtgttgaagatagttaggaacatggaaaagtaccaactggccgtgacgatcatggcaattagttgcgtccccaatgccgtgatcttacgcaacgcttggaaagtttcctgtacaattctcgcggccgtgtctgtcagcccactgcttctgacctcctcacagcagaaggcagactggatccctttggtactcactataaaaggcctgaatcccaccgctattttcctaacaactctgagccggaccagtaagaaaagatcttggccacttaacgaggccatcatggccgtgggcatggtttccatcctcgctagctcgctgttgaagaatgacattccgatgacggggcctctggtggcaggaggtttactcacagtctgctatgtgctgaccggcaggtcagccgatcttgaactggagcgagcggctgaggtaaaatgggaagaccaggccgagatatctgggagttcccccatcttgagcattactatctctgaagatggaagcatgtccattaagaacgaggaggaagaacaaacactcaccatcctgatacgcactggcctactggtgatctcaggtgtctttccagttagtattcccatcacagcagccgcttggtacctttgggaagtgaagaaacagcgggcaggggtgctctgggacgtccctagcccaccccctgtgggaaaggccgagctggaagatggcgcgtatagaattaaacagaggggcatcttggggtactctcagataggagctggtgtttataaggagggcaccttccatacgatgtggcacgtaactcgtggggccgtgttaatgcatcgcggaaaacggattgagccgtcctgggcagacgtcaagaaggatctgatctcatacggcggtgggtggaaactcgaaggagagtggaaggaaggcgaggaagtgcaagttctggcccttgagccaggcaaaaatcccagagctgtgcagaccaagcctgggatctttaaaacaaacgccggaaccattggtgcagtcagtctggacttcagcccaggcacatccgggtctcccatcgtggataggaagggaaaggtagtcggcttgtacggtaatggggtggttactcgatcgggagcttatgtgagcgccatagcgcagaccgagaaatcaattgaagacaaccctgagatcgaagatgacatttttcggaagaaacgcctaacgatcatggatctgcacccgggcgccggcaagacaaaaagatacctccccgcaatagtcagggaggctattaagcgggggctgcgaactcttatcttagccccaaccagagtggttgctgcagaaatggaggaggccctgcgcggactccctatcaggtatcagacacccgccattaaggctgaacataccggtcgtgagatcgtggacttgatgtgtcacgcgactttcaccatgcggctgctctccccagtcagagtgcctaactacaatctgattataatggacgaagcacacttcacagatcccgccagtatcgctgccaggggctatatttctacgcgcgtagagatgggggaggcagccggaatctttatgactgctaccccaccgggcagccgagaccctttcccccaatccaacgcgccaatcatggatgaagagagagaaattcccgagcggtcatggaactctggtcatgaatgggtgacagactttaaagggaagaccgtttggttcgtccctagcataaaagccggaaacgatatcgcagcttgccttaggaagaatggcaaaaaggtgattcagctgagtcgcaagacttttgactccgagtacgtgaaaacacgtgccaacgattgggacttcgtcgtaaccacggatatcagcgagatgggcgcaaattttaaggccgaaagagtgattgacccacggaggtgtatgaaacccgttatcttgactgatggggaggaacgcgtgatactagctggacctatgccggtcacacactcttcagccgcgcagcgaagaggtcggatcggcaggaacccaaagaatgagaacgaccaatatatttacatgggggaacccctggagaatgacgaggattgcgcacattggaaagaagccaagatgctcttagacaacatcaatacccctgagggaattatcccctccatgttcgaaccagagcgcgaaaaagtggatgctatagacggcgagtacagactgaggggtgaggcccggaagacctttgttgatcttatgcgtcgcggggacctgcctgtgtggctcgcttataaggtcgcagccgaaggcattaactacgctgatcgaaaatggtgtttcgacggaatcaagaataaccagattttggaggaaaacgtggaggtagagatctggactaaagaaggcgagagaaagaaactgaagcccaggtggctcgatgcccggatatatagtgacccactggcacttaaggaatttaaagagttcgcggccgggcgcaagagcctaacactgaatttgatcaccgaaatgggaagattacctacattcatgactcagaaagctaggaacgccctggataatctcgcagtgctgcacacggctgaggccggtggccgggcatacaaccacgccctttcggagctgccggaaaccctcgagacattgctgctactgactctccttgctaccgttacagggggaatttttctgttcttaatgtctggcaagggtatcgggaaaatgaccttgggcatgtgctgcattatcactgcgtccgtcctgctctggtatgcccagatacaaccccattggattgcagctagcatcatcctggaatttttccttattgtgctgctcatcccagagcctgaaaagcagcgaacgccccaggacaatcagttgacctacgtggtcatagccattctgacagttgtggccgcaactatggctaacgagatgggatttttagagaagaccaaaaaggatctaggcctggggtcaatcacaacccaagaaagtgagtctaatattctcgacatcgaccttagaccagcctccgcgtggactctgtatgctgtagccacaacgttcgtgacccctatgttgcgccacagcatagaaaactcaagtgtcaatgtgagcctgactgcaatcgccaaccaggctacagttctcatgggactgggtaaaggctggcccctttccaagatggatattggggtgccgctcctggcaatcggatgttactctcaggtcaatccaattaccttgaccgccgcgctgttactactggtagctcattacgccatcattggccctggtctccaggcaaaagccacaagggaggctcaaaagcgggccgcagctgggatcatgaagaaccccactgtggacggcataacggttattgatcttgaaccaatcccctatgaccctaaatttgagaagcagctgggacaggtgatgttgctgatcctctgcgtcacccaggtgctgatgatgcgtacaacttgggccctttgtgaggcgttaaccctggccacaggcccgattagcaccctctgggaagggaatcccggaagattctggaacactacgatagcagtctccatggctaatatctttaggggctcatacttggccggtgcagggctgctattctctattatgaaaaacacaaccaatactcgccggggaaccggcaacatcggtgagacactgggcgaaaagtggaaaagtcgactcaacgctcttgggaagtcggagtttcaaatttataaaaagagcggaatccaggaggtggatagaactctggccaaggaaggcataaaaagaggggagaccgaccaccatgccgtttcccgcggatctgcgaagttgcggtggttcgtggaaagaaatatggtaacaccagagggcaaagtggtcgatctgggttgcgggcgtggaggctggtcatactattgtggtggcctcaagaacgttagggaagtgaaagggctgacgaagggaggccctgggcacgaggagcccatccctatgagcacctacggatggaatttagtccggcttcagtccggcgtggacgtatttttcactccacccgaaaagtgcgatacactgctctgtgacattggtgagagttctcctaacccaaccatcgaagctgggcgcactctacgagtgctgaatttggttgagaactggctgaataacaatacacaattctgcattaaagtgctcaacccctatatgccgagcgtcatcgaaaagatggagacccttcagagaaaatacggaggcgcactggtgaggaatcctttgtcacggaactccacgcacgagatgtactgggtcagtaatgccaccggcaacatagtgagctctgttaatatgatttcccgcatgctgatcaacagatttacaatgaagcataaaaaggctacttatgaaccagatgtagacctcgggtcaggaaccaggaacatcggtattgagagcgaaatacccaatttagatatcattggcaagcgaatcgagaaaattaagcaggaacacgagacatcgtggcattacgaccaggaccacccttataaaacttgggcctaccacgggtcttatgagaccaagcaaacaggaagtgcatccagcatggtgaacggcgtcgtgcggctgcttaccaaaccatgggatgttgtgcccatggtcactcagatggccatgacggacacaaccccgttcggtcagcagcgtgtgtttaaggaaaaggtagatactagaacccaagagcctaaagaagggacaaagaaactgatgaagatcacggctgagtggctatggaaagagctcggaaagaaaaagacaccccgcatgtgtactagggaagagttcacacggaaggtgagatcaaatgcggccctgggcgcaatatttaccgacgaaaacaaatggaagtccgctcgcgaggccgttgaagatggcaggttctgggagttggtcgaccgagagcggaatctgcatctcgaagggaaatgcgagacttgtgtgtacaacatgatgggaaagagagagaagaaacttggtgagtttggcaaggcaaaagggtctagggccatctggtatatgtggctgggagctcgcttcttagaatttgaggccctgggcttcttgaatgaggatcactggtttagccgtggtaacagtctctccggggtggaaggagagggcctgcatcggctaggctacattcttagagacgtcagcaagaaagaagggggagcgatgtacgcagatgacacagccggttgggataccaggatcacactggaggacctcaagaatgaagagatggttactaaccacatgaaaggcgagcataagaagctggctgaagccattttcaaattgacctatcagaataaggtggtacgcgtgcagcgaccaacgcctcgggggaccgtcatggacatcatttctagaagggatcagcgcggatcaggccaagtgggtacatacgggctgaacacttttaccaatatggaggcacagctcataagacagatggaaggagagggcatcttcaaaagtattcaacaccttacagctatcgaggaaatcgccgttcagaactggctggctaaggtgggccgggagaggttatcccgtatggccattagcggggacgattgcgtcgtgaaacccatagacgatcgattcgcatctgcgctgactgccttgaatgacatgggaaaggtacgcaaggatatccagcagtgggaaccatcgagaggttggaacgactggacccaagttcccttttgctcacaccatttccacgagctcgtgatgaaagatggccgggtcctggtggtgccttgtaggaaccaggacgaactaattgggcgcgctagaatcagccagggagccggctggtcccttaaggagacggcatgcctgggtaaaagttatgctcagatgtggacactcatgtactttcatcggagggatctgcgattggccgcaaatgccatttgttctgcggtcccaagccactgggttccgacctcccgtactacatggtcaatccacgctaagcatgagtggatgaccactgaagacatgttagccgtgtggaacagagtatggatacaagagaatccctggatggaagataaaacccctgtggagagttgggaagaggtcccatatctggggaagcgcgaggaccagtggtgcggatctctcatcggccttacaagccgggcaacgtgggccaagaacattcagaccgctatcaatcaggtgaggtccctgattggcaacgaagagtacactgactatatgccctcaatgaaaagattccgccgggaagaggaagaggccggggttctatggtga

SEQ ID NO: 14395 - RNA, 9876 nt, synthetic construct
  misc_feature 1..9876: note = derived and/or modified CDS sequence (opt3) from DENV-2__KJ189305__SS-prME
  source 1..9876: mol_type = other RNA
accgccggcgtgatcgtcatgctgattcccacagctatggcattccacctcactacgcggaatggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggtcgaagactacggctttggtgttttcaccacgaacatttggctcaagctgaaagagaagcaggacgtgttttgtgattctaaattaatgagcgctgccatcaaggacaatcgtgcagtgcacgccgatatggggtattggatagaatccgctctgaacgacacatggaagatggagaaagcctcattcattgaggtaaagagctgccactggcctaaatctcataccctttggtccaatggagtcttggaaagtgagatgatcatcccaaagaacttcgcaggccccgctagccagcacaactaccggcctggttattacactcaaaccgccggcccatggcatctcgggaaactggaaatggattttgacttctgtgagggaacaactgtggttgtgaccgaagattgcggcaatcgagggccctctctaagaacaacgaccgcgtccggaaagctgattactgagtggtgctgtaggtcatgcacactcccgcctctgcgctaccggggcgaggacggttgttggtatgggatggaaatcagaccacttaaggagaaagaagagaacttggtcaatagtctggtgaccgccggacacggccagattgataactttagcttaggtgttctcggcatggctctgttccttgaagagatgctgaggactcgcgtggggacaaagcatgcaatattgctcgtagccgtctcgtttgtgaccctgatcacgggaaatatgtccttccgagacctaggccgggtgatggtcatggttggggctactatgaccgatgacattggaatgggcgtgacatacctggccctcctggcagcgtttaaagtacgtcccaccttcgccgctggtcttttgctgagaaagttaacttctaaagagctcatgatggccacaatcgggattgcactgcttagccagtcaaccatccctgaaacaatactggagctaactgatgctctcgccctgggaatgatggtgttgaagatcgtcaggaacatggaaaagtatcaactggcagtgaccattatggccatcagttgcgttcccaatgctgtgattttacagaacgcgtggaaagtctcctgtacgatcctcgccgcagtgtctgttagcccactgcttctgacatcctcacagcagaaggctgactggatacctttggccctcaccattaaaggcctgaatcccactgccatctttctaaccacactgagccgcacaagtaagaaacggtcttggccacttaacgaggctatcatggcagtgggcatggtctccattctcgccagctcgctgttgaagaatgacataccgatgaccgggcctctggtagcgggaggtttactcacggtgtgctacgttctgacaggcagatcagctgatcttgaactggagagggccgcagacgtgaaatgggaggatcaagccgaaatctctgggagttcccccattttgagcatcaccatttctgaggacggaagcatgtccatcaagaacgaagaggaggaacagactctcacaatactgatccgaaccggcctactggtcatttcaggtgtgttcccagtaagtatccccattactgctgcagcctggtatctttgggaggtgaagaaacagcgcgcgggggtcctctgggatgttcctagcccaccccctgtgggaaaggctgaactggaggacggcgcctaccggatcaaacagagaggcatattggggtattctcaaattggagcaggagtgtacaaggaaggcacatttcacaccatgtggcacgtcacgagaggggcagtgttaatgcatcgtggaaaacgcatcgagccgtcctgggctgatgttaagaaggacctgatctcatacggcggtgggtggaaactcgagggagaatggaaggagggcgaagaggtacaggtgctggcccttgaaccaggcaaaaatccccgggcagtccagactaagcctgggattttcaaaaccaacacaggaaccatcggtgctgtgagtctggattttagcccaggcacatccgggtctcccatagttgacaagaagggaaaagtggtcggcttgtatggtaatggggtggtaactagatcgggagcctacgtcagcgcgattgcccagaccgagaagtcaatcgaggataaccctgaaattgaggacgatatcttcaggaaaaagcgactaacgataatggacctgcacccgggcgcaggcaaaacaaagcggtatctccccgctattgtgcgcgaagccatcaagagagggctgaggactcttatcttagctccaacccgggttgtggcagccgagatggaagaggccctgcgaggactccctattagataccaaacacccgctatcaaagcggagcataccggtcgcgaaattgtcgacttgatgtgtcacgcaactttcaccatgaggctgctctccccagtgcgtgttcctaactataatctgataatcatggatgaggcccattttacagaccccgctagtattgccgcacggggctacatctctacgagagtggaaatgggggaggccgctggaatcttcatgactgcgaccccaccgggcagcagggatccttttccccagtccaacgccccaattatggacgaggaacgcgagatacccgaacgatcatggaactctggtcacgagtgggtcacagatttcaaggggaaaaccgtgtggtttgtacctagcatcaaggcaggaaacgacattgctgcctgccttaggaagaatggcaagaaggtgatccagctgagtcggaaaactttcgattccgaatatgttaagacaagggcaaacgactgggattttgtcgtgaccacggacattagcgagatgggcgccaatttcaaagctgagcgcgtgatcgatccacgtagatgtatgaagcccgtcatattgactgacggggaagaacgggtaatcctagccggacctatgccggtgacacactcttcagcggcacaaaggcgcggtcgaattggcagaaaccccaagaatgaaaacgaccagtacatctacatgggggagcccctggaaaatgatgaggactgcgcccattggaaggaggctaaaatgctcttagataacattaatacccctgaaggaatcataccctccatgtttgagccagaacgggagaaggttgacgccattgatggcgaatataggctgcgcggtgaggctagaaagaccttcgtggaccttatgaggagaggggatctgcctgtctggctcgcatacaaagtggccgctgagggcatcaactatgccgaccgtaagtggtgttttgatggaattaaaaataaccagatcttggaagagaacgttgaagtggagatatggactaaggagggcgaacgcaaaaagctgaagccccgatggctcgacgcaagaatctacagtgatccactggcgcttaaagagttcaaggagttcgccgctgggaggaaaagcctaacactgaatttgattaccgagatgggacggttacctacatttatgactcagaaggcccgcaacgcactggacaatctcgctgtcctgcacacggccgaagccggtggtagagcatataaccatgctctttcggagctgccggagaccctcgaaacattgctgctactgactctccttgcgaccgtgacagggggaatcttcctgtttttaatgtctggcaaaggtattgggaagatgaccttgggcatgtgctgcatcataactgcctccattctgctctggtacgcacaaatccagccccactggatcgctgccagcattatcctggagttctttcttatagtactgctcattccagaacctgagaagcagaggacgccccaggataatcaattgacctatgtggttatcgccattctgacagtcgtggcagctactatggccaacgaaatgggattcttagagaaaaccaagaaagacctaggcctggggtcaatcacaacccaggagagtgaatctaatatactcgacatcgatcttcggccagcgtccgcttggactctgtacgccgtggcaacaacgtttgtcacccctatgttgcgacacagcattgagaactcaagtgttaatgtgagcctgactgccatcgctaaccaggcaacagtactcatgggactgggtaagggctggcccctttccaaaatggacattggggtgccgctcctggccatcggatgttactctcaggtcaatccaattaccttgaccgcggctctgttactactggtggcccattatgcaatcataggccctggtctccaagccaaggctacaagagaagcccagaagcgcgcagctgccgggattatgaaaaaccccactgttgatggcatcacggtgatcgaccttgagccaattccctacgatcctaagttcgaaaaacagctgggacaggtcatgttgctgatactctgcgtaacccaagtgctgatgatgaggacaacttgggcgctttgtgaggccttaaccctggcaacaggcccgatcagcaccctctgggaggggaatcccggacggttttggaacactacgattgctgtttccatggccaatatcttccgtggctcatatttggccggtgctgggctgctattttctattatgaagaacacaaccaatactagaaggggaaccggcaacatcggtgaaacactgggcgagaaatggaagagtcgcctcaacactcttgggaaatcggagttccagatatacaaaaagagcggaatccaggaggtggaccggaccctggccaaagagggcattaagcgaggggaaacagatcaccatgccgtctccagaggatctgcgaaattgaggtggtttgtggagcgcaatatggtcacgccagaaggcaaggtggttgacctgggttgcgggcggggaggctggtcatattactgtggtggcctcaaaaacgtgagagaggtaaaggggctgaccaagggaggccctgggcacgaagaaccaatccctatgagcacttatggatggaatttagtgcgtcttcaatccggcgtcgatgttttcttcacaccacccgagaaatgcgacaccctgctctgtgatattggtgaaagttctcctaacccaactatcgaggctgggaggacactacgggtgctgaatttggtcgaaaactggctgaataacaatacccagttttgcataaaggtgctcaacccctacatgccgagcgtaattgagaaaatggaaacgcttcagcgcaagtacggaggcgcactggtgcgaaatcctttgtcaagaaactccacccatgagatgtattgggttagtaatgccacaggcaacatcgtgagctctgtcaatatgatctccaggatgctgattaaccggttcactatgaaacacaagaaggctacctacgagccagacgtggatctcgggtcaggaacacgcaacataggtatcgaaagcgagattcccaatttagacatcattggcaaaagaatcgaaaagataaaacaggagcacgaaacttcgtggcattatgaccaagatcacccttacaagacctgggcctatcatgggtcttacgagacaaaacagaccggaagtgcatccagcatggtcaacggcgtggttaggctgcttactaagccatgggacgtagtgcccatggtcacgcagatggccatgacagataccactccgtttggtcagcaacgagtgttcaaggagaaagttgacacccggacacaggaacctaaggaggggacgaaaaagctgatgaaaatcaccgctgaatggctatggaaggagctcggcaagaagaagactccccgtatgtgtacaagagaggaatttacccgcaaagtgaggtcaaatgcggccctgggcgcaattttcactgatgagaacaagtggaaatccgctcgggaagccgtcgaggacggcagattttgggaattggtggatcgcgagaggaatctgcacctcgaggggaagtgcgaaacatgtgtatataacatgatgggaaaacgagagaagaaacttggtgagttcggcaaagcaaaggggtctcgggccatctggtacatgtggctgggagctagatttttagagttcgaagccctgggctttttgaatgaggaccactggttcagcaggggtaacagtctctccggggtggagggagaaggcctgcatcgcctaggctacattcttcgtgatgttgggaaaaaggagggaggtgcgatgtatgcagacgataccgccggctgggacacacggatcactctggaagacctcaaaaatgaggaaatggtcaccaaccacatgaagggggagcataagaaactggctgaggccatttttaagttgacgtaccagaataaagtggtgagagtccagaggccaacccctcgcggaacagttatggatataatcagccgacgggaccaaagaggctctggtcaggtggggacttatggactgaacaccttcacaaatatggaagcacagctcattaggcaaatggagggcgaaggcatcttcaagtcaatccagcaccttactgctaccgaggagattgccgtacagaactggctggctcgcgtggggagagaacggttaagtaggatggccatatccggagatgactgcgtcgtgaaacccatcgatgaccgttttgcaagcgcgctgacggccttgaatgatatgggtaaggttcgaaaggacattcagcaatgggagccatctcgcggctggaacgattggacacaggtgcccttctgctcgcatcactttcacgaactcgtcatgaaagacgggagagtgctggtagttccttgtcggaaccaggatgagctaatcggaagggctcgcatttcacagggcgccggttggagccttaaggaaaccgcatgcctggggaaatcctacgctcaaatgtggactctcatgtatttccatagacgggacctgaggttggccgcaaatgccatctgtagtgcggtgccatctcactgggtcccgacaagccgaaccacttggtccatacatgctaagcacgagtggatgaccacagaggatatgttagccgtgtggaaccgtgtgtggatccaggaaaatccctggatggaggacaaaacgcctgtcgaatcatgggaggaagttccatacctgggaaagagagaggaccagtggtgcggcagtctcattggccttacctctcgcgcaacttgggccaagaacatccagacagctattaatcaagtgcggagcctgatcgggaacgaggaatataccgattacatgccctccatgaaaaggtttagacgcgaggaagaggaagccggagtactatggtga

SEQ ID NO: 14396 - RNA, 9876 nt, synthetic construct
  misc_feature 1..9876: note = derived and/or modified CDS sequence (opt3) from DENV-2__FJ898451__SS-prME
  source 1..9876: mol_type = other RNA
accgccggcgtgatcgtaatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccattactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataaacttcaactgaaagggatgagctacagtatgtgtactggaaagttcaagatcgtcaaagaaatcgctgagacccagcacggcacgattgtgatcagagtacagtatgagggtgacgggtctccatgcaagattcccttcgaaataaccgatttggagaaaaggcatgttctcggccggctgatcacagtgaacccgattgtcactgaaaaggactcccctgtgaacatcgaggccgaacccccatttggagatagctacatcattgtcggcgtggagcctgggcagttaaaactgaattggttcaagaagggatcgtctataggtcaaatgtttgagaccacaatgcgaggcgctaaacgcatggccatcctaggggacactgcatgggatttcggatccctcggcggtgtttttacctcaattgggaaggccctgcaccaggtgttcggcgctatctacggagcggcatttagtggcgtaagctggacgatgaaaattcttatcggggtcataatcacatggattggaatgaactccagatctaccagcttgtcagtgagtctggttctcgtgggcgtcgtgactctgtatcttggtgtaatggtgcaggccgactccgggtgtatcgttagctggaagaataaagaactgaagtgcggatctggcattttcatcacagataacgtccacacctggactgagcagtacaagtttcaacccgaatcaccaagtaaattggctagcgccatacagaaggcacatgaggaaggtatttgtggcatcaggtccgtgacccggctcgagaatctgatgtggaaacagattacacccgagttaaaccacatcctgtctgaaaatgaggtgaagctaacgataatgaccggggacatcaaaggaattatgcaggccggcaagcgctcgctcagacctcaaccaactgaactgaaatatagctggaagacatgggggaaggctaaaatgctttccaccgagtcacataaccagacattcttgatcgatggaccggaaactgccgagtgccccaataccaacagggcatggaatagtctggaggtcgaagactacggctttggtgttttctctacgaacatttggctcaagctgcgtgagaaacaggacgtgttttgtgatagcaagttaatgtccgcggctatcaaagacaatcgggccgtgcacgcagatatggggtattggatagaatcagtactgaacgacacatggaagatggagaaggccagcttcattgaggtcaaatcttgccactggcctaagtcccataccctttggagtaatggagtgttggaaagcgagatgatcatccccaagaacttcgctggccccgtttctcagcacaactaccgacctggttatcatactcaaaccgccggcccatggcacctcgggaagctggaaatggattttgacttctgtgagggaacaactgtggtcgtgaccgaagattgcggcaatagagggccctccctaaggacaacgaccgcatcaggaaaactgattactgagtggtgctgtcgcagttgcacactcccgcctctgcggtacagaggcgaggacggttgttggtacgggatggaaatcaggccacttaaggagaaggaagagaacttggttaatagcctggtgaccgctggacatggccagattgataacttttcgttaggtgtactcggcatggccctgttccttgaagagatgctgcgcactcgagtcgggacaaaacacgcgatattgctcgtggccctgtcctttgtgaccctaatcacgggaaatatgtctttccgggacctgggccgtgtcatggttatggtgggggctactatgaccgatgacattggaatgggcgtaacatatctcgcactgcttgccgcttttaaggtgagacccaccttcgccgcaggtttgctgttaaggaaactcactagcaaggagctgatgatggcgacaatcgggattgcccttctgtcacagagtaccctacctgaaacaatcctcgagctgactgatgctttggccctgggaatgatggtcttaaaaatagtgcgcaacatggaaaagtaccaactcgcagttaccatcatggctatttcctgcgtgcccaatgccgtcatcctgcagaacgcatggaaggtgtcttgtacgattcttgccgctgttagcgtgtccccactgttgctcacatcaagccagcagaaagcggactggatccctctggccctaaccataaagggcctgaatcccactgcaatttttcttaccacactcagtcggacttctaaaaagagatcctggccactgaacgaggctatcatggccgtcggcatggtaagcatcttggcctcgtcactgctaaagaatgacattccgatgaccgggcctctcgtggctggaggtctgcttacggtttgctatgtgctgacaggcaggtctgcagatttggaactcgagcgagccgcggacgtcaagtgggaggatcaagctgaaataagtgggtccagccccatcctgtctattaccatcagcgaggacggatccatgtcaattaaaaacgaagaggaggaacagactctaacaatcctgatacgcaccggccttctcgtgatcagtggtgtattcccagtgagcattcccatcactgccgcagcctggtacctgtgggaggtcaagaagcagcgggctggggttttgtgggatgtgccttctccaccccctgtgggaaaagcagaattagaggacggcgcctatagaattaagcagaggggcatcctggggtactcccaaataggagcgggtgtctataaagaaggcacatttcacaccatgtggcatgtgacgcgtggggctgttctcatgcaccgcggaaagcggattgagccgtcatgggccgatgtcaaaaaggacctgatcagttacggcggtgggtggaaacttgagggagaatggaaagagggcgaagaggtgcaggtcctggcattggaaccaggcaagaatcccagagccgtgcagactaaacctgggatcttcaagaccaacacaggaaccattggtgctgttagcctagatttttccccaggcacatctgggtcgcccatcgtggacaggaaaggaaaggtcgtgggcctgtacggtaatggggtagtcactcgaagcggagcctatgtgtcagcaatagctcagaccgagaagtccattgaggataaccctgaaatcgaggacgatattttccggaaaaagcgcctcacgatcatggacctgcatccgggcgccggcaaaacaaagagataccttcccgcgatagttagggaagccattaaacgggggttacgaactctgatcctcgcaccaaccagagtggtcgctgccgagatggaagaggctttgcgcggactgcctatcaggtatcaaacacccgcaattcgtgccgagcacaccggtcgggaaatcgtggacctcatgtgtcatgccactttcaccatgagactgcttagtccagttagggtgcctaactacaatctgattataatggatgaggctcactttacagaccccgcgtctatcgcagcccgcggctatattagcacgcgagtcgaaatgggggaggctgccggaatcttcatgactgcaaccccaccgggctccagagatccttttccccagtcaaacgccccaatcatggacgaggaacgggagattcccgaaaggtcttggaatagcggtcacgagtgggtgacagatttcaaggggaagaccgtatggtttgtgcctagtataaaagctggaaacgacatcgcggcctgcttgcgcaagaatggcaaaaaggttattcagctatcccgtaaaactttcgatagcgaatacgtcaagacaagagcaaacgactgggattttgtggtgaccacggacatctctgagatgggcgctaatttcaaggccgagcgggtcattgatccaaggcgctgtatgaaacccgtaatcctgactgacggggaagaacgagtgatactcgcaggacctatgccggttacacattcatccgccgctcaaagacggggtaggatcggccgcaacccaaagaatgaaaacgaccagtatatttacatgggggagcccttagaaaatgatgaggactgcgcccactggaaagaggcgaagatgctgcttgataacatcaatacccctgaaggaattatccccagtatgtttgagccagaaagagagaaagtggacgcaatagatggcgaatacaggctgcggggtgaggcccgtaagaccttcgtcgacctcatgcgccgaggggatttgcctgtgtggctggcttataaagttgccgctgagggcattaactacgcagacagaaagtggtgttttgatggaatcaagaataaccagattctcgaagagaacgtggaagtcgagatctggactaaagagggcgaaaggaagaaactgaagccccggtggcttgacgcccgcatatatagcgatccactagctctgaaagagttcaaggagttcgccgcagggagaaagtcgttgacattaaatctgatcaccgagatgggaaggctccctacatttatgactcagaaagcgcggaacgccctggacaatcttgctgtgctgcatacggccgaagtaggtggccgagcatacaaccacgctctctctgagttgccggagaccctggaaacactactgctccttactctgttagccaccgtgacagggggaattttcttgtttctgatgtccggcaagggtatcgggaaaatgaccctcggcatgtgctgcattatcactgcaagcatactgctttggtatgcccaaattcagccccactggatcgctgcgtcaatcattctggagttctttctcatcgttttgctgataccagaacctgagaagcagagaacgccccaggataatcaattaacctacgtcgtgattgccatcctaacagtggtcgcagctactatggccaacgaaatgggattcctggagaaaaccaagaaggacctcggctttgggagtattacaacccaggagtctgaatccaatatccttgacatagatctgcgcccagccagcgcatggactttgtatgctgttgccacaacgttcgtgacccctatgctgaggcattcaatcgagaacagtagcgtaaatgtgtccctcactgcgattgctaaccaggccacagtcctgatgggacttggtaaaggctggcccctctctaagatggacatcggggtgccgctgttggcaattggatgttacagccaggttaatccaatcaccctgaccgccgctttactactgctcgtggcacactacgccattatcggccctggtcttcaagcgaaagctacacgggaagcccagaagcgtgcagccgctgggataatgaaaaaccccactgtcgatggcattacggtaatcgacctggagccaatcccctatgatcctaagtttgaaaagcagttgggacaggtgatgctgctcattctgtgcgttacccaagtgcttatgatgagaacaacttgggccttatgtgaggcactgaccctcgctacaggcccgatatccaccttgtgggaggggaatcccggaaggttctggaacactacgatcgccgtctcaatggcgaatatttttcgcggctcttacctggccggtgcagggctactgttcagtatcatgaaaaacacaaccaatactcggcgaggaaccggcaacgtgggtgaaacactcggcgagaagtggaaatcgagacttaacgctctgggaaagagcgaatttcagatttataaaaagtccggaatccaggaggtcgacaggactttggccaaagagggcataaagcgcggggaaaccgatcatcacgcagtgtctcggggatcagctaagctgagatggttcgttgagcgtaatatggtgacaccagaaggcaaagtagtggacctcggttgcgggaggggaggctggagctactattgtggtggcctgaagaacgtccgggaggttaaagggttaacgaagggaggccctgggcatgaggaaccaatccctatgtccacctacggatggaatcttgtgcgcctgcaaagtggcgtcgatgtgttctttactccacccgagaaatgcgacacactcctatgtgatattggtgaatctagccctaacccaaccatcgaggccgggcgaactctgagagtattgaatctggtggaaaactggctcaataacaatacacagttctgcattaaggttcttaacccctatatgccgtcagtgatcgagaagatggaaaccctgcagaggaaatacggaggcgccttggtccggaatcctctgtcccgcaacagtacgcacgagatgtactgggtgagcaatgcgaccggcaacatagtctcttccgtgaatatgatttcaagaatgctcatcaacaggtttacaatgaagcacaaaaaggctacttatgagccagacgttgatttagggagcggaacccgaaacatcggtattgaatcggagatacccaatctggacatcattggcaaacggatcgaaaagattaagcaggagcatgaaacatcttggcactacgaccaagatcatccttataaaacttgggcataccacgggagttatgagaccaagcagacaggatccgccagctcaatggtaaacggcgtggtccgtcttctgaccaaaccatgggacgtggttcccatggtgactcagatggctatgacggatacaaccccgttcggtcagcaaagagtctttaaggagaaagtggacactcgcacccaggaacctaaggaggggacaaagaaactaatgaagatcacggccgaatggctctggaaagagctgggaaagaaaaagacccccaggatgtgtactcgggaggagttcacaagaaaagtacgctccaatgcagccttgggcgctatatttaccgatgagaacaagtggaagtctgcgagggaagccgtggaggacggccgattctgggaactggttgatcgggagagaaatctccaccttgaggggaaatgcgaaacttgtgtctacaacatgatgggaaagagggagaaaaagctgggtgaatttggcaaagcaaaggggagccgcgctatctggtatatgtggttaggagcccgtttcctggagtttgaagcattgggcttcctcaatgaggaccattggtttagtcggggtaactccctgagcggggtggagggagaaggcctacacagacttggctacattctgagggaggtggggaagaaagaaggaggtgccatgtacgctgatgacacagccggctgggatacccgcatcacactcgaggacctgaagaatgaagagatggtcactaaccatatgaaaggggagcacaagaaattggcggaagcaattttcaagctgacctatcagaataaggttgtgcgagtacagcggccaacgcctagaggaaccgtgatggacatcatttctaggaaagatcaacgcggctcaggtcaggtcgggacatacggactcaacactttcaccaatatggaggcccagcttataagacaaatggaaggcgagggcatctttaagagtattcagcatctgacagctactgaggaaatcgccgtgcagaactggttagcacgggttgggagggagcgtctgtcccgaatggctatcagcggagacgattgcgtggtcaaacccattgacgatcgcttcgcctctgctttgaccgccctcaatgacatgggtaaggtgagaaaagatatacagcaatgggaaccatcgcggggctggaacgactggacgcaggtacccttttgctcacaccacttccatgagctggttatgaaggatgggagggtgctagtcgtgccttgtcgcaaccaggacgaacttatcgggagagcacggattagccagggcgcgggttggtccctgaaggagacagcctgcctcgggaaaagttatgctcaaatgtggaccctgatgtactttcacaggcgagatttgcgtttagccgcaaatgctatctgttctgccgtgccaagccattgggtcccgacttccagaacaacctggtcaattcacgcaaagcacgagtggatgactaccgaagacatgctggccgtttggaaccgcgtgtggatccaggagaatccctggatggaagataaaacacctgtagagagttgggaagaggtgccatatctcggaaagcgggaggaccagtggtgcggctctcttataggcctgacgagcagggcgacctgggctaaaaacatccagactgccattaatcaagtcagatccctaatcgggaacgaagagtacacagactatatgccctcaatgaagcgcttccggagggaagaggaagaggcaggagtgctgtggtga

SEQ ID NO: 14397 - RNA, 9876 nt, synthetic construct
  misc_feature 1..9876: note = derived and/or modified CDS sequence (opt3) from DENV-2__HM488257__SS-prME
  source 1..9876: mol_type = other RNA
accgccggaatcattataatgatgatccccacagtgatggctttccacctgactacgagaaacggggaacctcatatgattgtaagcaggcaggaaaagggaaaatccctcctttttaagaccgagaatggtgttaacatgtgcacactgatggcaatggacttgggcgaattatgtgaggatactatcacctacaattgcccactgctacggcaaaacgaaccggaggacattgattgttggtgcaattctacatcaacctgggtgacttatgggacatgtaccgtaacgggagagcaccgccgagaaaaacgtagtgtggccctcgtcccccatgtgggcatgggtctggagactcggaccgaaacatggatgagctccgagggggcgtggaagcacgctcagaggatcgagacttgggttcttcggcatcctggattcaccataatggccgcaatcctggcctacacaattggcaccacgtattttcagcgcgtgttgatcttcattctcctgactgctgtcgcaccatctatgacaatgagatgcatcggcatatcgaacagggactttgtggaaggggtatcaggaggtagctgggttgatattgtgctggagcacggcagttgtgtcaccactatggccaaaaataagcccacactcgacttcgaattaatcaagaccgaggctaaacaccctgccacgctgcggaagtactgcattgaagcgaaacttaccaacacaactaccgcatcccgctgtccaacacagggggagccctctttgaatgaggaacaagataagcgatttgtgtgcaaacatagcatggtggacagaggatggggcaacggttgtgggctgttcggaaagggcggcatcgtcacttgcgccatgtttacctgcaagaaaaatatggaggggaagatcgttcagcctgaaaacctagagtatacaattgtgataaccccacactccggagaagagaatgctgtaggtaacgatactggcaaacatgggaaggagatcaaagtgacgccgcagtcaagtattacagaagccgagctcaccggatacggcactgtcaccatggaatgtagccccaggacaggtctggacttcaatgagatggtgcttctgcagatggaaaacaaggcatggttggttcaccggcaatggtttctcgatctgcctttaccatggctgcccggggctgacacccagggctctaactggatccagaaagagactctcgtgacattcaagaatcctcacgccaagaaacaggatgtcgtggtacttggatcccaagagggcgcgatgcatacggccctgaccggggcaactgaaatacagatgtcaagcggaaacttgctatttacaggtcacctgaagtgccgtctccgcatggacaaactgcagcttaagggcatgagttattctatgtgtaccgggaaattcaaggttgtgaaggagattgctgaaacacaacatggaactatcgtcatcagagtgcagtacgagggcgacggttccccatgcaaaattcccttcgagatcatggatctggaaaagaggcacgtcttggggcggctcattaccgtgaatccgatagttacggagaaagacagccctgtgaacatcgaagccgagcccccatttggcgattcgtacattatcgtaggagtcgaacctggccagctgaagttatcttggttcaaaaaggggtcctcaatcggacagatgtttgagaccacaatgcgaggtgctaagcgcatggccattctgggcgacactgcatgggatttcgggagtctaggaggcgtgtttaccagcataggtaaagccctccatcaagttttcggggctatctatggcgcggcattttccggagtgtcttggacaatgaagattctgatcggcgtcgtgattacttggatcgggatgaatagcagatcaaccagtctttccgtcagcttggtgctggttggagtcgtgacgctctacctgggcgtgatggtccaggccgactctggttgtgttgtgtcatggaaaaacaaggagcttaaatgcgggagtggaatattcatcacagataatgtgcacacctggactgaacagtataagtttcagcccgagagcccatccaagctggcttctgccattcaaaaagcacacgaagagggcatctgtggtattaggtcggtaacacggttggaaaacctcatgtggaagcagatcacccccgagctgaatcatatattaagcgagaacgaagtcaaactgactattatgaccggcgacatcaaggggattatgcaggccggaaaacgctccctaagacctcagccaacagagctcaagtactcatggaaggcttggggcaaggccaagatgctgagtacggaacttcacaatcataccttcttgatcgatgggccggagactgcagaatgccccaacacaaatagggcgtggaactctctggaggtggaggactatggatttggcgttttcaccacaaatatatggctcaaactgaaggaacgtcaagatgtgttttgtgacagcaaattaatgtccgctgccatcaaggacaaccgggcagtccacgccgatatgggttactggattgagtcagctctgaacgacacttggaaaatcgaaaaggccagcttcattgaggtgaagtcttgccactggcctaaatcccataccctttggagtaatggggttttggagagcgaaatgatcataccaaagaacttcgcaggacccgtgtctcagcacaattatcgacctggctaccatacgcagacagctggtccatggcacctcggcagactggagatggattttgacttctgtgaagggaccactgtagtcgtgaccgaggattgcggaaacaggggcccctccctacgcacaactaccgcctcagggaaactgattacagaatggtgctgtcggagttgcacgctcccgcctctgagatacaggggagaggacggctgttggtatggtatggagatccgcccacttaaggaaaaagaggaaaatttggtgaacagcctggtcaccgcggggcatggacagatcgataatttttcgttaggcgttctcggtatggccctgttccttgaggaaatgctgcgaactcgggtgggcacaaagcacgctattttgctcgtagcagtgtcctttgtcaccctgatcactgggaacatgtctttccgtgacctaggaagagtgatggttatggtgggcgccacaatgaccgatgacattgggatgggagtcacgtacctggctctcctggccgcatttaaggtgaggcccacttatgcggccggccttttgctgcgcaaattaaccagcaaggagctcatgatgacaaccataggtatcgttctgctttcacaaagtactattcctgagacaatcctggaactaaccgatgctctcgccctggggatgatggtgttgaaaattgtccggaatatggagaagtaccagctggcagtaacaatcatggctatattatgcgtgcccaacgccgttatcctccagaatgcatggaaagtgtcctgtactaccctggccatggtctctgtgagcccacttctgttgacgtcctcacaacagaaggctgactggattcctctcgcgctgacaatcaagggactaaaccccaccgccattttcctgactacccttagcagaacaagtaaaaagaggtcttggccactcaatgaagcaatcatggctgtaggcatggtgtccatactggccagctcgttgctgaaaaacgatattccgatgactggccctttagtcgccgggggactcctgaccgtttgctatgtgcttacgggtcgatcagctgacctggagttggaacgcgcagccgacgtgcggtgggaggagcaggcggaaatctctggcagttcccccatcctcagcattacaatatctgaggatgggagcatgtccatcaagaatgaagaggaggaacagaccctgactattctaatcagaacaggactgcttgtcatttcaggcctctttccagtgagtatccccataaccgctgccgcatggtacctgtgggaggttaaaaagcaaagggccggtgtattgtgggacgtgcctagcccaccccctgtcgggaaagctgaattagaggatggagcatatcgtatcaagcagaagggcattctgggctactctcagatcggggccggagtgtacaaagaaggtactttccacacaatgtggcatgttacccgcggcgcggtgctcatgcacaaggggaaacggattgagccgtcctgggctgacgtcaagaaagatctgatctcatatggaggcggttggaaacttgagggggaatggaaggagggagaagaggtgcaggtactggccttggaaccaggcaaaaaccccagagcagtccaaacgaagcctggcctatttaaaactaacaccgggacaataggagccgtgagtctggacttcagcccaggtacctccggctctcccattgttgataagaaagggaaggtggtcggactctacggcaatggtgtggttacaaggtcggggacttatgtgagcgctatcgcccagaccgagaagtcaatcgaggacaaccctgaaattgaggatgacatctttaggaagaaacggctgacgataatggatcttcatccgggagcaggcaaaacaaaacgctacttacccgctattgtcagagaagccatcaaaaggggcctgcggactctcattttggcgccaacccgagtggtagccgcagagatggaagaggctctgagagggctccctatccgctatcagacacccgccataagggctgagcacaccggacgtgaaattgtggacctgatgtgtcatgcaactttcaccatgcggcttctgtccccaatcagagttcctaattacaacttgatcattatggatgaggcccacttcacagaccccgccagtatcgctgcgaggggttatatttctacgcgcgtcgaaatgggcgaggcagccgggatatttatgactgctaccccaccgggaagccgagaccctttcccccagtccaatgccccaatcatggatgaggaaagagagattcccgaacggtcatggaactctggccacgagtgggtgacagactttaagggtaagaccgtgtggttcgtccctagcatcaaagcagggaatgatatcgccgcttgcctaaggaagaacggcaaaaaggtaattcaactgagtcgcaaaacttttgactccgaatacataaagacacgtaccaatgattgggacttcgtggttacgactgatatcagcgagatgggcgcgaactttaaggccgagagagtgattgacccacggaggtgtatgaaacccgtcatcctcacagatggcgaagaacgcgtgattttagcagggcctatgccggttacccattcttcagctgcccagcgaagaggacgggtgggtaggaatccaaagaacgaaaatgaccagtacatctatatgggcgagcccctggaaaacgatgaggactgcgcacactggaaagaggccaagatgcttctggacaatataaacacccctgaagggatcattccctccatgttcgagccagaacgcgagaaagtcgatgctatcgacggagaatacagactcaggggcgaggcccggaagacttttgtggatttgatgcgtcgcggtgacctgcctgtatggctcgcgtatcgagtggcagccgaggggattaactacgctgatagaaggtggtgtttcgacggcgttaaaaataaccaaatcctggaagagaatgtcgaagtggagatatggacaaaggagggagaacggaagaaacttaagccccgctggctagatgccagaatttatagtgacccactggctttgaaagagtttaaggagttcgcagccggcagaaagagcttaaccctgaacctcatcacagagatggggcggctgcctactttcatgacgcagaaggctcgaaatgcccttgataacctggcagtgctccataccgcggaagccggaggtagagcttacaatcacgccttgtcggagctgccggagacactagaaactctgctccttctgaccttattggcaacagtcaccggcgggatttttctgttcctcatgtctggaaagggcatcggtaaaatgactctggggatgtgctgcataatcacggcttccattcttctgtggtatgcccagatccagccccactggattgcagccagcatcatactcgagtttttcttgattgttctgttaatcccagaacctgagaagcaacgcacaccccaggacaaccagctaacatacgtggtaatcgctattctgactgtggtcgcggccaccatggcaaatgaaatgggctttctcgagaaaacaaagaaagatttcggacttggctcaatcaccactcagcaaccagagagtaacatactggacattgatttgaggcctgcttctgcctggacactgtacgccgtggcaacgacctttatcactcccatgctccggcattccattgaaaatagctcagttaacgtgagtctgacagctatcgccaatcaggcgaccgtccttatggggctcggaaagggttggccgctgagcaagatggacataggcgtaccattgctggctatcgggtgttattcccaggtgaaccctattaccttaacagccgcactactgctccttgttgcccactacgctatcattggacccggcctgcaggcaaaagccactcgtgaggcgcaaaagagagctgccgcaggtatcatgaaaaatccaacggtggacgggattaccgtcatcgatttggaccccataccttatgatccgaagttcgaaaaacagctgggccaggtgatgctcctggtcctttgcgtgacacaggttttaatgatgaggactacctgggccctgtgtgaggctctcacattggccaccggacccatttctactctgtgggaaggcaacccagggcgcttttggaatacgacaatcgcagtgagcatggctaacatcttccggggatcctacctagccggcgcgggtctgctcttttcaattatgaagaacaccgccaatactcgaagagggaccggaaacacaggcgagactcttggtgagaagtggaaacataggctgaatgcattgggcaagtctgagttccaaatatataaaaagagtgggatccaggaggtagaccgcaccctggctaaagaaggaattaagcggggcgagacagatcaccatgccgtgtcgagagggagcgcaaaactccgttggtttgtcgagaggaacctggttacgcctgaaggaaaggtggtcgacttaggctgcggtagagggggatggtcctactattgtggcggtcttaagaatgtgaaagaggtaaagggcctgaccaaagggggacccggccacgaagaacctatcccaatgtctacttacgggtggaacctcgtgcgcctacagtcaggagttgatgtgttcttcacaccccctgaaaagtgcgacaccctgttgtgtgatattggcgagagctccccaaatcccactgtcgaggctggtcgaacactgagagtgctcaaccttgtcgaaaattggctgaacaataacacccaattttgcatcaaagtgttgaatccgtacatgcctagtgttatagagaagatggaagccctgcagaggaagtatgggggagccctcgtacggaacccattatctcgcaatagcacgcacgagatgtactgggtgtcaaacgcgtccggcaacatcgtcagtagcgtgaatatgatttctagaatgctgatcaacaggttcaccatgcgacataaaaaggctacatatgaacccgacgttgatcttggctccgggactcggaatattggaatcgagtcagagacccctaacctggacataattggtaaacgtatcgaaaagatcaaacaggagcacgaaacaagctggcattacgatcaggaccacccatataagacttgggcataccacggctcgtatgagaccaagcaaacagggtctgccagttccatggtgaatggagtcgtgagactactcaccaaaccctgggacgtaattccgatggtgactcagatggctatgacggatacaaccccttttggccagcagcgcgttttcaaggaaaaagtcgacactaggacccaagagcccaaggagggtaccaaaaagctgatgaagataacggccgaatggttgtggaaagagctggggaagaaaaagaccccacggatgtgtactagagaagagtttacacgcaaagtgaggagcaacgcagccctcggagctatcttcaccgatgagaataagtggaaatcagcgcgagaagccgtggaggactccggcttttgggaacttgtcgataaggagcggaacctgcatttagaaggcaagtgcgagacttgtgtttacaatatgatggggaaaagagagaagaaactgggagagttcggtaaggcaaaaggctctagggctatttggtacatgtggttgggggcccgctttctcgagttcgaagcactgggatttctaaacgaggaccactggttcagccgtaagaatagtctttccggcgtggaaggtgaggggctgcataagctcggatatatcctgcgggatgtaagcaaaaaggagggcggcgccatgtacgctgacgatacagccgggtgggacaccagaattacattggaagatctgaaaaacgaggaaatggtgactaatcacatggagggagaacataagaaactcgcggaggcaatctttaggcttacctatcagaacaaggtcgtgcgcgttcagcgacctacgccccggggtaccgtgatggacataatctctagaagggaccagcgcggctcagggcaagtcgtgacatacggactgaatactttcaccaacatggaggcccagttaattagacagatggaaggcgagggtgtattcaagagtatccaacacctgacagctactgaagagattgccgttaaaacctggttggtgcgggtcgggagggagcgtctctcccgaatggcaatcagcggagatgactgcgtggtgaagccactggatgaccgctttgcttctgccctaacggctcttaacgatatgggcaaagtcagaaaggacattcagcagtgggaaccctcgcggggctggaatgattggacacaggttcctttctgctcacaccattttcacgagctgataatgaaagacgggagggtgctcgtagtgccatgtcgcaaccaagatgaactgatcggacgagcccggattagccagggtgcaggctggtccttgagggagaccgcgtgcttagggaagagttatgcccagatgtggtctctgatgtacttccatcgacgtgacctcagacttgctgccaatgcaatctgtagcgctgtcccgtcccactgggtgcccacttcacgcacaacctggagtatccacgccactcatgaatggatgaccacagaggatatgctgacggtttggaaccgggtgtggattcaggagaatccttggatggaagacaagaccccagtcgagtcttgggaagagataccctatctaggaaaaagggaagatcaatggtgcggcagcctgatcggtctcacttccagagcaacatgggccaagaacattcagaccgcgatcaatcaggtgcgctcattgattgggaacgaggagtacactgactacatgcctagcatgaaacggtttaggcgagaagaggaagaggctggagtactgtggtga

SEQ ID NO: 14398 - RNA, 9876 nt, synthetic construct
  misc_feature 1..9876: note = derived and/or modified CDS sequence (opt3) from DENV-2__HQ999999__SS-prME
  source 1..9876: mol_type = other RNA
accgccggcgtgatcgtcatgctgattcccacagctatggcattccacctcactacgcgaaatggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactgctccggcaaaacgaaccggaggatatcgactgttggtgcaattccacatctacctgggtgacttatggaacatgtaccacgactggcgagcaccgccgagaaaagcgttcagtggcgctggtcccccatgtgggtatggggcttgagaccagaacagaaacttggatgagtagcgagggagcttggaaacacattcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtcctcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttatctgcaagcattctatggtggatagaggctggggtaacgggtgtggactattcggcaagggcgggattgtaacctgcgccatgtttacatgcaaaaagaatatggaaggaaaagtggtgcagcctgagaacctcgaatacaccatagtcatcactccacacagcggtgaggagcatgctgttggcaatgacacggggaagcacggaaaagaaattaagatcacaccgcagtcctcaataaccgaggccgaactgactggctatggtaccgtgacaatggagtgtagtcccaggaccgggcttgatttcaacgaaatggtactgttgcaaatggaggacaaagcatggctcgtgcaccggcagtggtttctggatttacctctgccatggctccccggcgctgacactcagggaagcaattggattcagaaggagacacttgtcacgttcaagaaccctcatgccaaaaagcaagacgtggttgtgctgggctctcaggaaggggcgatgcacaccgccttgactggagcaacagagatccagatgtcctcaggtaatctactgtttaccggccatctcaaatgccgtctgcgcatggataaacttcaactgaaagggatgagctacagtatgtgtacaggaaagttcaagatcgtcaaagaaattgctgagactcagcacggcaccatcgtgattagagtacagtatgagggtgacgggtctccatgcaagatacccttcgaaatcacggatttggagaaaaggcatgttctcggccggctgattaccgtgaacccgatcgtcacagaaaaggactcccctatcaacattgaggccgaacccccatttggagatagctacataatcattggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtctttacttcaatcgggaaggccctgcaccaggtgttcggcgctatatacggagcggcatttagtggcgttagctggaccatgaaaatccttattggggtgatcattacgtggatcggaatgaactccagatctactagcttgtcagtaagtctggtcctcgtgggcgttgtgaccctgtatcttggtgccatggtccaggctgactccgggtgtgtggtaagctggaagaataaagaactgaagtgcggatctggcatattcattactgataacgtgcacacatggaccgagcagtacaagtttcaacccgaatcaccaagtaaattggccagcgcaatccagaaggcccatgaggaaggtatttgtggcatcaggtccgttactcggctcgagaatctgatgtggaaacagataacccccgagttaaaccacatcctgtctgaaaatgaggtcaagctaacaattatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggtggaagactacggctttggtgtgttcaccacgaacatatggctcaagctgaaagagaagcaggacgtcttttgtgattctaaattaatgagcgctgccattaaggacaatcgtgcagttcacgccgatatggggtattggatcgaatccgctctgaacgacacatggaagatggagaaagcctcattcatcgaggtaaagagctgccactggcctaaatctcataccctttggtccaatggagtgttggaaagtgagatgattatcccaaagaacttcgcaggccccgtaagccagcacaactaccggcctggttatcatactcaaaccgctggcccatggcacctcgggaaactggaaatggattttgacctatgtgagggaacaactgtcgtggttaccgaagattgcggcaatcgagggccctctctgagaacaacgaccgcctccggaaagctcattactgagtggtgctgtaggtcatgcacactgccgcctcttcgctaccggggcgaggacggttgttggtacgggatggaaataagaccattgaaggagaaagaagagaacctggtgaatagtttagtcaccgcgggacatggccagatcgataacttcagcctcggtgtgctgggcatggccctttttctggaagagatgttgaggactcgcattgggacaaagcacgctatcctcctggttgcagtgtcgttcgtaaccctaattacgggaaatatgtcctttcgagacctgggccgggtcatggtgatggtgggggccactatgaccgatgacatcggaatgggcgtcacatatctcgctctgcttgccgcattcaaagttcgtcccacctttgcggccggtttgctgttaagaaagctcacttctaaagagctgatgatggctacaatagggatcgcccttctgagccagtcaaccattcctgaaacaatcctagagctcactgatgcactggctttgggaatgatggtgctgaaggtagtgaggaacatggaaaagtaccaattagccgtcaccattatggcaatcagttgcgtgcccaatgccgttatactccagaacgcttggaaagtgtcctgtacgattctggcggccgtctctgtgagcccacttctgttgacatcctcacagcagaaggcagactggatccctctcgctctgaccatcaaaggcctaaatcccactgccattttcctgaccacacttagccgcacaagtaccaagcggtcttggccactcaacgaggccataatggctgttggcatggtgtccatcctggcaagctcgttgctgaaaaatgacattccgatgacggggcctttagtcgccggaggtctcctgacagtatgctatgtgcttaccggcagatcagcggatctggaattggagagggctgccgacgttaagtgggaggatcaagcagaaatctctgggagttcccccattctcagcatcactatatctgaggacggaagcatgtccatcaaaaacgaagaggaggaacagacactgaccattctaatccgaactggcctgcttgtgatttcaggtgtctttccagtgagtatccccataacagccgctgcatggtacctctgggaggtaaagaagcagcgcgccggggtgctgtgggatgtccctagcccaccccctgttgaaaaagcggagttggaagacggagcttatcggattaagcagagaggcatcttaggctactctcaaatcggggccggagtgtataaagagggtaccttccacacgatgtggcatgtgactaggggcgcagtcctgatgcaccgtgggaagcgcattgagccgtcctgggccgatgtgaaaaaggacctcatctcatacggaggcggttggaagctggaaggggagtggaaagaaggagaggaagttcaggtacttgctctggagccaggcaagaatccccgggccgtgcagaccaaacctggcatatttaagacaaacaccgggacaattggagcagtcagtttggatttcagcccaggtacttccggctctcccatcgtggacagaaaagggaaggttgtgggactatacggcaatggtgtcgtgaccaggtcgggggcttatgtaagcgccattgcgcagacggagaagtcaatcgaagataaccctgagatagaagacgatatttttagaaagaagcggctgacaatcatggacctccatccgggagccggcaaaactaagcgctacctgcccgcaatcgtcagagaggctattaaaaggggccttcggaccttaatcctggccccaacacgagtggttgctgcagaaatggaggaggccctcagagggttgcctattcgctatcaaacccccgccataaagactgaacacaccggaagggagatcgtggacctgatgtgtcatgctacattcacgatgcgtctcctgtccccagtccgggtgcctaactacaatcttattatcatggatgaagcgcacttcactgaccccgcaagtatcgccgctagaggttatatttctaccagggttgagatgggcgaggccgcagggatatttatgacagccaccccaccgggaagccgcgatcctttcccccagtccaacgctccaatcatggacgaggaacgagaaattcccgagagatcatggaactctggccacgaatgggtgactgattttaagggtaaaacagtctggttcgtgcctagcatcaaggcggggaacgacattgccgcatgcctgcggaaaaatggaaagaaagtaatccagttgagtaggaagacctttgattccgagtacgtgaagacgcgcgctaacgactgggatttcgttgtcactacagacataagcgagatgggcgccaattttaaagcagaacgtgtgatcgatccaagacggtgtatgaagcccgtgattctaaccgacggcgaggaaagggtcatcctggccgggcctatgccggtaacccattcttcagctgcccaacgccgaggaagaattggtcggaaccccaagaatgagaacgaccagtatatctacatgggcgaacccctcgagaatgatgaggactgcgcgcactggaaggaagcaaaaatgttactggataacataaatactcctgaggggattatcccctccatgttcgaaccagagagggaaaaggtggacgccattgatggagagtaccgccttagaggcgaggctaggaaaacatttgttgacctgatgcggcgtggtgatctccctgtgtggttggcctataaggtcgctgcagaagggatcaactacgccgaccgccgatggtgtttcgatggcataaagaataaccagatcctggaggaaaacatggaggtggagatttggaccaaagaaggagagagaaagaaactcaagcccaggtggctggacgctcggatctatagtgatccacttgccctaaaagaatttaaggagttcgcagcgggccgcaagagcctgacattgaatttaattactgaaatggggagactgcctacgttcatgacccagaaagccaggaacgctctcgacaatctggccgttcttcatacagcagaggctggaggtcgggcctacaaccacgcactgtcggagctcccggaaactttggagaccctgctactgctcacacttctggccaccgtgactggcgggatctttttattcttgatgtctggaaagggcataggtaaaatgacgctggggatgtgctgcattatcaccgcttccatcctcctgtggtatgcgcaaattcagccccactggatcgccgcaagcataattcttgaatttttcctgatcgtcctcttgattccagagcctgaaaagcagcgaacaccccaggataatcaactgacttacgtggtaatcgctatattaaccgtggttgccgccacaatggcaaacgagatgggctttctagagaaaaccaagaaggacctgggactcggctcaatcactacacaggaaagtgagtctaatattcttgacatcgatctgagaccagcttccgcctggacgttgtatgcggtcgctaccactttcctgacacctatgctccgccatagcattgaaaactcaagtgtgaatgtgagcctgaccgccatcgcaaaccaggccaccgtccttatggggctcggaaaaggttggcccctgtccaagatggacattggcgctccgttgctggcaatcgggtgttactctcaggttaatccaataacattaactgccgcgctactgctccttgtggctcactacgccattatcggacctggcctgcaagcaaaagccacgagggaggctcagaagcgggccgcagctggtatcatgaaaaaccccaccgtagatgggattacagtgatagacttggatccaatcccctatgaccctaagtttgaaaagcagctgggccaggtcatgctcctgattctttgcgtgactcaagttttaatgatgcgtaccacatgggccctgtgtgaggcgctcaccttggccactggaccgatcagcacgctgtgggagggcaatcccgggagattctggaacacaaccattgcagtgtccatggctaatatctttaggggatcatacctagccggcgcaggtctactcttctctataatgaaaaacactaccagtacacgccgggggactggaaatatcggcgaaacccttggtgagaagtggaaatcgcgactgaacgctttgggcaagagcgaatttcagatttataaaaagtccgggatccaggaggtcgatagaacactggccaaagagggaattaagaggggcgaaacggaccatcacgccgtatctcgcgggtcagcgaagctccggtggttcgtggagagaaacatggttaccccagaaggaaaagtggtcgatctgggctgcggtcgtgggggatggagctactattgtggcggtttaaagaatgtgagggaggtcaaaggccttactaaagggggacctggccatgaggaaccaatccctatgtccacatacgggtggaacctggtgcggctccaaagtggagttgacgtgtttttcaccccacccgagaaatgcgatactctactgtgtgacataggcgaatctagccctaatccaacaattgaggctggtcgcaccttgcgagtactgaacctcgtggaaaattggcttaacaataacacgcagttctgcatcaaggtcctgaatccctatatgccgtcagttatcgagaagatggaagcattgcagagaaaatacgggggagccctggtgaggaaccctctctcccggaatagtacccacgagatgtactgggtcagcaacgctacaggcaatattgtgtcttccgtaaacatgatatcacgcatgttaatcaatagatttactatgaagcacaaaaaggccacctatgagccagatgtggacctgggcagcgggacaaggaacattggaatcgaatcggaggttcccaaccttgacattatcggtaaacgaatagaaaagatcaagcaggagcatgaaacttcttggcactacgatcaagaccatccttataaaacctgggcataccacggcagttatgagacaaagcagaccgggtccgccagctcaatggtgaatggagtcgtgcggctgctaactaaaccatgggatgtcgtgcccatggttacgcagatggctatgacagacaccactccgttcggccagcaacgtgtatttaaggagaaagtggataccagaacacaggaacctaaggagggtacgaagaaactcatgaagattaccgcggaatggctgtggaaagagttggggaagaaaaagactccccgcatgtgtacaagggaggagttcacccggaaagtcagatccaacgccgcactgggagctatctttactgacgagaataagtggaagtctgcccgcgaagcagtggaggatggcaggttctgggaactcgttgaccgagagcggaaccttcacctggagggcaaatgcgaaacatgtgtgtacaatatgatggggaagagagagaaaaagttaggagaatttggtaaagccaagggcagcagggctatttggtatatgtggctgggggcccgcttcttggagtttgaagcgctcggattcctgaacgaggatcattggtttagtcgtggcaattccctaagcggtgtcgagggggaaggacttcaccggctgggctacatcctcagagaggtgtctaagaaagaaggcggggcaatgtacgccgacgataccgctggatgggacacaaggattactctggaggacttgaagaacgaagagatggtaaccaatcatatgaaaggtgagcacaagaaactggccgaagcaatattcaagctcacgtatcagaacaaggtggttcgcgtccagcgaccaacccctcggggcacagtgatggatatcatttcaagaagggaccaacgcgggagtggacaggtgggcacttacggtcttaatacctttacaaacatggaggctcagctgatcagacaaatggaaggggagggaatcttcaaatccattcagcatttaactgccaccgaggaaatagctgtccagaattggctggcccgggttggcagggagcgtttgagccgaatggcaatctctggcgatgactgcgtggtaaagcccattgatgaccgcttcgcgtcggccctcacggctctgaacgatatggggaaagtgagaaaggacatccagcaatgggaaccatcacggggatggaatgattggacacaggtccccttttgcagccaccacttccatgagctagtgatgaaagacggtagggttcttgtggtcccttgtcgcaaccaggatgaactgattggcagagcccggatctcccagggggcaggatggagtctcaaggagaccgcttgcctgggcaagtcttatgcccaaatgtggactttgatgtactttcacaggcgagacttacgtctggcagccaacgcgatatgtagcgctgtgccatcccattgggtaccgacatcaagaaccacttggagtatccacgccaaacacgagtggatgaccacagaagatatgctcgcagtttggaatcgcgtgtggattcaggagaacccctggatggaagacaagacgcctgtcgagtcttgggaagaggtgccatatcttggtaaacgggaggaccagtggtgcgggagcctgatcggactaacctccagggccacttgggctaagaatattcagacagccatcaaccaagtgagatcactgataggcaatgaagagtacaccgattatatgcccagcatgaaacgcttccggagggaagaggaagaggcaggcgtcctctggtga

SEQ ID NO: 14399 - RNA, 9876 nt, synthetic construct
  misc_feature 1..9876: note = derived and/or modified CDS sequence (opt3) from DENV-2__FJ898449__SS-prME
  source 1..9876: mol_type = other RNA
accgcaggaatgatcattatgctgatacccactgtgatggctttccacctcactacgagaaatggggagcctcatatgatcgtcagcaggcaggaaaagggaaagtcccttctgtttaagaccaaggacggtacaaatatgtgcactttgatggcaatggatttaggcgagctgtgtgaagacaccattacctacaagtgcccattcctcaagcaaaacgagccggaagatatcgactgttggtgcaattctacctcaacttgggttacatatgggacctgtacgactaccggagagcaccggcgcgagaagcgaagtgtggccctcgtaccccatgtgggcatgggtctggaaacacgtactgagacctggatgagctccgaaggggcgtggaagcacgctcagagaattgagacatggatccttaggcatcctggatttaccataatggccgcaatcctggcctacacgattggcactacacacttccagcgggtcttgatctttattctcctgaccgctatcgcaccatctatgactatgcgctgcataggcatttcgaacagagatttcgtggagggggtttcaggaggtagctgggtggacatcgtcctggaacacggcagttgtgtgacaaccatggccaaaaataagcccacgctcgattttgagttaattaaaaccgaagctaagcagcctgccacactgaggaaatattgcatcgaggcgaaacttactaacaccacaactgactcccggtgtccaacccaaggggaacccacattgaatgaggagcaggataagcgcttcgtatgcaaacattctatggttgaccgaggatggggcaacggttgtgggctgtttggaaagggcggcatcgtgacctgcgcaatgttcacttgcaaaaagaatatggaagggaaaattgtccagcctgagaacctagaatacacggtggtgataacaccacacagcggagaggaacatgccgtcggtaatgataccggcaagcacgggaaagaggttaagatcactccgcagtcctcaattaccgaggctgaactcacaggatatggcaccgtgactatggagtgtagtcccagaacaggtctggactttaacgaaatggtacttctgcaaatggaggataaggcctggttggtgcacaggcagtggttcctcgacctgcctttaccatggctgcccggggcagacacgcagggcagcaattggatccagaaagaaaccctcgtcacttttaagaaccctcatgctaaaaagcaagatgtggttgtgcttggatctcaggagggcgccatgcacacagcgctgaccggggccacagagatacagatgtcctcaggaaatttgctattcactggtcatctgaaatgccggctccgtatggacaagctgcaacttaagggcatgagctacagtatgtgtaccgggaaattcaagattgtcaaagaaatcgcagagacgcagcacggaaccatcgtgattcgcgtacagtatgaaggcgatggttctccatgcaagatcccctttgagattatggacctggagaaaagacatgttttggggaggctcataacagtgaacccgatcgtcactgaaaaggattcccctgtgaacattgaggctgaacccccattcggcgacagctacatcatcattggagtcgagcctggccagctgaagttagattggtttaaaaaggggtcgtctataggacaaatgttcgaaaccacaatgcggggtgccaaacgaatggctatcctgggcgacactgcctgggattttgggtccctaggaggcgtgttcacctcaattggtaaggcactccaccaggtttttggggccatctacggcgctgcgttcagtggagtgagctggacgatgaaaattctgatcggcgtaataatcacatggattgggatgaactcccgctctaccagcctttcagtcagtttggtgctggttggaatcgtgactctctatctgggcgtcatggtgcaggcagactccggttgtgtagtgagctggaagaacaaggagcttaaatgcgggtctggaatttttgttacagataatgtccacacctggactgagcagtacaagttccaacccgaatcaccaagtaaactggccagcgctatccagaaggcccatgaggaaggcatatgtggtattagatccgtgaccaggttggagaacctcatgtggaaacagatcacatctgaactgaatcacattttatcggagaacgaggtgaagctgacgatcatgaccggcgacataaaagggatcatgcaggtcggaaagcggagcctacgcccccaacctactgaactcagatattcctggaagacatggggcaaagcaaagatgctgtcaaccgagcttcataatcagacatttttgattgacgggccagaaactgccgagtgcccgaacaccaatagggcttggaacagtctggaagttgaggattacggattcggcgtgtttacgacaaatatctggctccgtctgcgggagaaacaggacgtgttctgtgattctaagttaatgagcgccgcaattaaagacaaccgagcggtacacgctgatatgggttattggatcgaatccgccctgaatgacacctggaagatagagaaggcatcattcattgaagtcaaaagctgccactggcccaagtctcatactctttggtccaacggggtgttggagagtgagatgatcatccctaaaaattttgccggaccagttagccagcacaacaacagacccggctaccatacccaaacagctggtccttggcacctcggcaagctggaaatggatttcgacttttgtgaggggactaccgtggtcgtgacagaagagtgcggaaataggggcccatctctacgcacgaccactgcctccgggaaactgattacagaatggtgctgtcggtcatgcaccctacccccgctgagatataggggagaggatggctgttggtacggtatggagatccgccctcttaaggaaaaggaggaaaacttggttagtagcctggtgactgcagggcatggacagattgacaatttctcgttaggcatactcggtatggctctgtttcttgaggaaatgctgcgaacacgggtaggcaccaaacacgccatcttgctcgtcgcggtgtccttcgtgacgctgattactgggaacatgtcttttcgtgatctaggaagagtcatggttatggtgggcgccaccatgacagacgatatcgggatgggagtaacctacctggctctcctggcagccttcaaggtgaggccaacttttgctgccggccttttgctgcgcaaattaacaagcaaggagctcatgatgaccacaattggtatcgtcctgctttcacagagttccatacccgagactatcctggaactaaccgacgcactcgcgctggggatgatggtgttgaaaatggttcggaatatggagaagtatcaactggccgtgacgattatggctatcttatgcgtccctaacgccgtgattctccagaatgcatggaaggtttcttgtacaatcctggctgtggtcagcgtaagcccccttctgttgacctcaagccagcagaaagccgactggataccactcgcactgactattaagggactaaaccctaccgccatcttcctgacaactcttagtagaacctctaaaaagaggtcctggcccctcaatgaagctatcatggcggtgggcatggttagcattctggcctcgtcattgctgaaaaacgatataccaatgacgggcccgttagtggcagggggactcctgacagtctgctacgtgcttaccggtcgatctgctgacctggagttggaacgcgccactgatgtaaagtgggacgatcaagccgagatcagtggctccagccctattctctctatcacaattagcgaggacgggtccatgtcaatcaaaaatgaagaggaagaacagaccctgactatactaatccggacaggactgcttgtgattagtggcctctttcccgtcagcatcccaattaccgctgcagcctggtatctgtgggaggttaagaagcagagagcgggtgtgttgtgggatgtgccctctcctccacccgtcgggaaagctgaattagaggacggagcctacaggatcaagcagaaaggcatactgggctattcccaaattggggcaggagtgtacaaggaaggtacgttccacactatgtggcatgttacccgtggcgccgtactcatgcacaaagggaagcgcatcgagccttcatgggctgatgtgaagaaagacctgatcagttatggaggcggttggaaacttgaaggggagtggaaagagggagaagaggtccaggtgctggcattggaaccgggcaagaacccacgggccgttcagacaaaacccggcctatttagaaccaatacagggactattggagcggtgagcctggatttctcccctggtacctctggctcgccaatcgtcgacaagaaggggaaagtggtaggactctacggcaacggtgtcgtgacgaggagcggggcttacgtttcagccatagcacagacagagaagtccattgaagataatcccgagatcgaggacgacattttccgaaaacggcgcctgactatcatggatcttcatcctggagccggcaagaccaaaaagtatttaccggctatagtgagagaagccattaagaggggcctgcggacactcatcttggcacccacccgagtcgtggctgccgagatggaagaggcgctgagagggctcccaatccgctaccaaactcctgccattagggcagaacacaccggacgtgagatcgttgacctgatgtgtcatgctacatttacgatgcggcttctgagtcccattagagtgccaaactataacttgataatcatggatgaggcccacttcactgaccctgcttctattgcagccaggggttacatcagcacccgcgtcgaaatgggcgaggccgctgggatctttatgacagcgacacccccaggatcccgagatccgttccctcagtcaaatgcacccattatggacgaagagagagagataccagaacggtcttggaacagcggccacgagtgggtgactgattttaaaggtaagacagtatggttcgtgcccagtatcaaaaccgggaatgacattgccgcttgcctaaggaagaacggaaaacgcgttatccagctgtcccgtaagacgtttgatagcgaatatgtcaagactagaacaaatgactgggatttcgtggtgaccaccgacatttctgagatgggcgccaactttaaagcagaacgggtcatcgaccctaggcgctgtatgaagccagtaatactcactgatggcgaggagcgagtgatcttagccgggcccatgcctgttacacattcatccgctgcgcaaagacggggaaggattggtcgcaatccgagaaacgaaaatgaccagtacatctatatgggcgagccactggaaaacgatgaggactgcgcccactggaaagaagcaaagatgcttctggataatattaacacccccgaggggatcatacctagtatgttcgagcccgaaagggagaaagtggacgctattgatggagaataccggctccgtggcgaggcccgcaagacatttgtcgacttgatgcgaagaggtgatctgccagtgtggctcgcatacaaagttgccagcgaagggatcaattatgctgacaggcggtggtgtttcgatggcactcgcaacaatcagattctggaggagaacgtggaagtcgagatctggacgaaggaaggagagagaaagaaacttaagcctaggtggctagacgcccggatatactcggatcccctggcgttgaaagagttcaaggaatttgcagccggccgaaaatctttaaccctgaacctcatcacagagatggggagactgccaactttcatgacccagaaggctcgcgacgcccttgacaatctggctgtgctccatacagcagaagccggaggtaaggcttataaccacgccttgtccgagctgcctgaaaccctagagactctgctccttctgacgttattggcaaccgtaacaggcgggatttttctgttcctcatgagcggaaggggcatcggtaaaatgactctggggatgtgctgcattatcaccgcgtcaatacttctgtggtacgcccaaattcagccgcactggatcgctgccagtatcattctcgagtttttcttgatcgtgctgttaatacccgaaccagagaagcagcggacacctcaggataatcaactaacctatgttattatcgcaattctgactgtcgtggctgccacaatggcaaacgaaatgggctttctcgagaaaacgaagaaagaccttggactgggccatatcgccacccagcagcccgaatctaatatattggatatcgacctgcgtccagcttccgcgtggactctctacgccgtggcaacaaccttcattacccctatgctgagacacagcatcgagaactcaagtgtcaatgttagccttacagctattgccaaccaggccactgtgctcatggggctgggaaagggttggcccttgtccaagatggatatcggcgtaccgctgttagcaattgggtgttattctcaagtgaatccaatcacgctaaccgctgccctgctccttctggtcgcgcattacgctataattggacctggcttgcaggccaaagcaacaagggaggcccagaagcgcgctgcagccggtatcatgaaaaaccccactgtggacgggatcaccgttattgatctggacccaataccctacgatcctaagtttgaaaaacagctcggccaagtgatgctgcttgtcttatgcgtaacacaggtgctgatgatgcggaccacttgggcgctctgtgaggctttgacgctggccacaggaccggttagcaccctatgggaaggcaatcccgggcgattctggaacactaccatcgcagtgtccatggccaatatttttagaggatcatatctggctggcgccggtctccttttctctatcatgaagaacacaacaagtaccaggcgcgggacaggaaatattggcgagacgctgggtgaaaagtggaaatcgcggttgaacgcactgggcaagagcgagtttcagatctacaaaaagtccgggatacaagaggtcgacagaaccctcgctaaagaaggaatcaagcgtggcgagactgatcaccatgccgtgtctagggggtcagcgaaactgcggtggttcgtcgaacgcaatttagtgacaccagagggaaaggttgtggaccttggctgcggtcgagggggatggagctattactgtggcggtctgaagaacgtaagagaggtgaaaggcctcaccaaaggcgggcctgggcacgaggaacccattcctatgtccacttatgggtggaacctagtcaggctgcagagtggagttgatgtgttctttgtcccacccgaacggtgcgacacattgctgtgtgacatcggcgagtctagccctaatccaaccgtggaagccggtcgcacgctcagagtacttaacctggtggagaattggttgaacaataacacccagttctgcgttaaagtgctgaatccctacatgccgtcagtcattgagaggatggaaacactccagcgaaagtatgggggagcattagtgcggaaccctctgtcccgtaatagtactcacgagatgtactgggtcagcaacgcttctggcaatatcgtgtcctcagttaacatgataagcagaatgcttattaatcgctttaccatgaggcataaaaaggccacatacgaaccagatgtagacctgggctcggggactcggaacatcggaatcgagtctgaaacccccaatctagatattataggtaagagaatcgagaaaattaagcaagagcacgaagcaagttggcattatgaccaggatcacccttacaaaacatgggcttatcacggctcctacgagaccaagcagactgggagcgcctcatccatggtgaacggagtcgtgcgcctcctgacgaaaccatgggacgttgtgcccatggtcacacagatggccatgaccgatactaccccgttcggccaacagagggtgtttaaggaaaaggtagacacacgaacgcaggagcctaaagaaggtaccaagaaattgatgaagatcactgcggagtggctgtggaaagagctcgggaaggaaaagacaccccggatgtgtaccagagaggagttcactaaaaaggtgaggtctaacgctgcacttggagccatttttacagatgagaataaatggaagtccgctcgcgaggccgttgaagacaaccgtttctgggagctggtcgataaagaacggaatttacatctggagggcaagtgcgaaacctgtgtgtataacatgatgggcaaaagagagaagaagttgggggagtttggaaaagcaaagggtagtagggccatctggtacatgtggctcggcgctcgcttcctggaatttgaggcgctagggttccttaatgaagaccactggttttcccgagagaacagcctgtctggagtggaaggcgagggtctccataaactggggtatatattgcgggaggtctcaaagaaagaaggaggcgccatgtacgcagacgatacagctggctgggacactagaatcaccattgaggatctgaagaatgaagagatgatcacgaaccacatggccggggaacataagaaactcgcagaggccattttcaaacttacctaccagaataaagttgtgagggtacaacgcccaacacctagaggaactgtgatggacatcattagtcggagggatcagcgtggttccggccaggtcgggacctatggactgaacacattcactaatatggaggctcaattaatacgacagatggaaggcgagggtatctttaagagcattcagcacctgaccgcctctgaagagatcgcggtgcaggactggttggttcgcgtggggagagagcggctctcgaggatggcaatctcaggagatgactgcgtcgtgaaacccctggatgaccgcttcgccagagctctaacggcccttaacgatatgggcaaggtacggaaggacattcaacagtgggaaccaagcaggggctggaatgattggacacaggttcccttttgctcccaccatttccacgagctgataatgaaagacgggcgaaccctcgtggtcccttgtcgtaaccaggacgaactgatcggcagagcacgcattagtcaaggtgctggctggtctttgcgggagactgcctgcttaggaaagagctacgctcagatgtggtccctgatgtattttcataggagagatctccgccttgccgcaaatgcgatctgttcagccgtgccaagtcactgggtgccgacatctcggaccacttggagcattcacgcttcccatgaatggatgaccacagaggacatgctgacggtctggaacagggtttggatcctagagaacccctggatggaagataaaacccctgtggagtcatgggaagagataccatacctgggaaagcgagaagaccagtggtgcggcagcctcatcggtttgacttctagagccacatgggccaagaatattcagaccgctatcaaccaagtacggtccctgattgggaatgaggagtatactgattacatgcccagtatgaagaggttccgccgtgaagaggaagaggccggagtgctttggtga

SEQ ID NO: 14400 - RNA, 9876 nt, synthetic construct
  misc_feature 1..9876: note = derived and/or modified CDS sequence (opt3) from DENV-2__FJ906966__SS-prME
  source 1..9876: mol_type = other RNA
accgccggcatgatcattatgctgatacccacagtgatggctttccacctcactacgagaaacggggagcctcatatgatcgtcagcaggcaggaaaagggaaaatcccttctgtttaagaccgaggacggtgttaatatgtgcacattgatggcaatggatttaggcgaactgtgtgaggacactattacctacaaatgcccattcctaaagcaaaacgaaccggaggatatcgactgttggtgcaattctacatcaacctgggtgacttatgggacatgtaccacgactggagagcaccggcgcgaaaaacgaagtgtagccctcgtgccccatgtcggcatgggtctggagacccgtacagaaacttggatgagctccgagggggcgtggaagcacgctcagagaattgagacctggatccttaggcatcctggatttacaataatggccgcaatcctggcctacaccattggcacgactcacttccagcgggctttgatctttattctcctgacagcagtggccccatctatgaccatgcgctgcatcggcatatcgaacagagatttcgttgaaggggtgtcaggaggtagctgggtcgacattgtgctggagcacggcagttgtgtaactacaatggctaagaataaacccaccctcgattttgaattaatcaagacggaggccaaacagcctgcgaccctgaggaagtattgcattgaagcaaaacttacaaacactaccacagactcccggtgtccaactcaaggggagccctctttgaatgaggaacaggataagcgcttcgtttgcaagcatagcatggtggaccgaggatggggcaacggttgtgggctgtttggaaaaggcggcatcgtcacctgcgccatgttcacatgcaagaaaaatatggaggggaaggtggtgcagcctgaaaacctagagtacaccatcgtcattactccacactccggagaagagcatgctgttggtaatgatacgggcaaacacgggaaggagataaaaatcacaccgcagtcaagtattaccgaagccgagctcactggatatggcaccgtgacaatggaatgtagccccagaaccggtctggactttaacgagatggtacttctgcaaatggaaaataaggcatggttggtgcacaggcagtggttcctcgatctgcctttaccatggctgcccggggctgacactcagggcctcaactggatccagaaggagacacttgtcacgtttaaaaatcctcatgccaagaaacaagacgtggttgtgctgggatctcaggagggcgcgatgcacaccgccttgactggggcaacagaaatacagatgtcctcaggaaacctactgttcaccggtcatctcaagtgccggctgcgtatggataaacttcaactgaagggcatgagctacagtatgtgtacagggaagttcaaagtcgtgaaggagattgctgaaactcagcacggaaccatcgtaatccgcgttcagtatgagggcgacggttctccatgcaaaattccctttgagatcatggatttggaaaagagacatgtgctcgggaggctgattacggtcaacccgatagtgaccgagaaagactcccctgtcaatatcgaagccgagcccccattcggcgatagctacattatcatcggagtggaacctggccagttaaagctgaactggtttaagaaagggtcgtctattggacaaatgatagagacaactatgcggggtgctaagcgaatggccatcctaggcgacaccgcatgggatttcgggtccctcggaggcgtttttacatcaattggtaaagccctgcaccaggtgttcggggctatctacggcgcggcatttagtggagtaagctggattatgaagatccttataggcgtcatcattacttggatcgggatgaattcccgctctaccagcttgtcagtgagtctggttctcgtgggagtcgtgacgctgtatcttggcgtaatggtgcaggccgactccggttgtgttgtcagctggaaaaacaaggagctgaagtgcgggtctggaattttcatcacagataatgtgcacacctggactgaacagtacaaatttcaacccgagtcaccaagtaagttggctagcgccatacagaaagcacatgaagagggcatttgtggtatcagatccgtgacaaggctcgaaaacctgatgtggaagcagattacccccgagttaaatcacatcctgtctgagaacgaagtcaaactaactataatgaccggcgacatcaaggggattatgcaggccggaaaacggtcgctccaacctcagccaacagagctgaagtatagctggaagacgtggggcaaagctaagatgctttccaccgaatcacataatcagactttcttgatcgatgggccggagacagccgaatgccccaacaccaatcgcgcatggaacagtctggaggttgaggactacggatttggcgtgttcacaactaatatttggctcaaactgagagaaaagcaggacgtgttttgtgattctaaattaatgagcgcggctatcaaggacaacagggccgtacacgcagatatgggttattggatagagtccgccctgaatgacacctggaagattgaaaaagcttcattcatcgaggtcaagagctgccactggcctaaatctcatacgctttggtccaacggggtgttggagagtgaaatgatcattccaaagaacttcgccggacccgttagccaacacaattaccgtcctggctatcatacacagaccgcaggtccatggcacctcggcaaactggagatggattttgacttctgtgaagggactaccgtggtcgtgacagaggattgcggaaaccggggcccctctctacgaactaccacagcttccgggaagctgatcacggaatggtgctgtagatcatgcaccctcccgcctctgaggtaccgcggagaggacggctgttggtacggtatggagattcggccacttaaggaaaaagaggaaaatttggttaacagtctggtgactgccgggcatggacagatagataattttagcttaggcgtactcggtatggcgctgttccttgaggaaatgctgagaacaagggtcggcaccaagcacgccatcttgctcgtggctgtgtcgtttgtcactctgattacagggaacatgtccttccgcgacctaggacgagttatggtgatggtaggcgcaaccatgacggatgacatcgggatgggagtgacttatctggccctcctggctgcctttaaagtccggcccaccttcgcagcgggccttttgctgcgtaagttaacatctaaagagctcatgatgaccactattggtatcgtgctgcttagccaatcaacaatacctgagaccatcctggaactaacagatgccctcgctctggggatgatggttttgaagatggtgagaaagatggagaaataccagctggccgtcactattatggcaatcttatgcgtgcccaatgctgttattctccagaacgcctggaaggtgagttgtaccatcctggcagtcgtatccgtgtctccactttttctgacgagctcccagcaaaaagccgactggatacctttggctctcacaattaagggactgaatcccaccgcgatcttcctaactaccctgtcaaggacaaacaaaaagcgcagctggccacttaatgaagccatcatggcagttggcatggtgagtattctcgcttcttccctgttgaaaaacgacataccgatgactggccctctggtcgccgggggattactcaccgtgtgctatgtactgacgggtcggagcgccgatcttgagctggaaagagctgcagacgtgaagtgggaggatcaggccgagatctcgggctcatctcccattttgagtatcacaatttccgaagacgggagcatgtctatcaagaatgaggaagaggagcagaccctcactatactgatcaggacaggactactggtcattagcggcctttttccagtttccatccccattaccgcggctgcctggtacctctgggaagtgaaaaagcagcgagcaggtgtgctgtgggatgtcccttcaccaccccctgtggggaaagccgagttggaagacggagcttatcgcatcaagcaaaaaggcatattaggctacagtcagattggggcaggagtttataaggagggtactttccacacaatgtggcatgtaacccggggcgccgtgctgatgcacaaggggaaaagaatcgaaccgagctgggcggatgtcaagaaagacctcatctcttacggaggcggttggaagctggagggggagtggaaagaaggagaggaagtgcaggttcttgctctggagccaggcaagaaccccagggccgtgcagacgaagcctggcttgtttaaaactaatgcagggaccattggagccgtctccctagatttctcaccaggtacaagtggcagccccatcatagacaagaaagggaaggtggtaggactgtacggcaacggtgtcgtgacccgttccggggcttatgtttctgccattgcacaaacagaaaaatcgatcgaggataaccctgagattgaagacgatatcttccgcaagcggaagctcactataatggacctgcatccgggagctggcaaaaccaagagataccttcccgccattgtgagggaggcgatcaaacgaggcttacggacgctgatcctcgccccaacacgcgtcgtggcagctgaaatggaggaagccttgagagggctgcctattaggtatcagactcccgctatccgggcagagcacaccggacgagagattgttgacctcatgtgtcatgccacatttaccatgagactgcttagcccagtgcgcgtccctaattacaacctgataatcatggatgaagcccacttcactgaccccgcttcaattgcggcaaggggttatatctccacccgtgtggagatgggcgaagccgctgggatctttatgacagccacgccaccgggaagtcgggatcctttcccccagtctaatgcaccaattatggacgaggagagagaaatacccgagaggagctggtcctcaggccacgaatgggtaactgattttaagggtaaaaccgtgtggttcgttccttctatcaaggccgggaacgacattgctgcgtgcttgcgcaagaatggaaaaaaggtcatccaactaagccgaaaaacatttgatagtgagtacgtgaagaccagaactaacgactgggatttcgtggtcacaaccgacatttccgaaatgggcgccaattttaaagcagagcgggtaatcgatccaaggcgctgtatgaagcccgtgatactgacggacggcgaggaacgtgttatcctcgctgggcctatgccggtgactcatagctctgccgcacagagacggggaaggattggtcgcaacccaaaaaatgagaacgaccagtatatctacatgggcgaacccttagagaatgatgaagactgcgcccactggaaggaggctaagatgctgcttgataacattaatacacctgaggggatcataccctcaatgttcgaaccagagcgagaaaaagtcgacgccattgatggagagtacagactgcggggcgaagcgaggaagacctttgtggacctcatgcgcagaggtgatttgcctgtttggctggcatatagggtggccgctgaggggatcaactacgccgaccggcgttggtgtttcgatggcattaaaaataaccagatcctcgaggaaaacgtcgaggtggaaatatggaccaaggagggagagcgcaaaaagctgaagccccgatggcttgacgctagaatctattccgatccactagcactgaaagaattcaaggagtttgccgctggcaggaaaagtttgactttaaatctgattacagaaatggggcggctccctaccttcatgacacaaaaggcccgcgacgcactggataaccttgcggtactgcatactgccgaggctggaggtagagcctacaatcacgcactcagcgaattgccggagacgctggagaccctactgctccttacactgttagctactgtgaccggcgggatctttttgttcctgatgtcgggaaggggcattggtaaaatgacactcgggatgtgctgcatcataaccgcctctattctgctttggtatgcacagatccagccccactggatcgccgcttccattatcctggaatttttcctcatagttttgctgattccagagcctgaaaagcagcggactccccaagacaaccagttaacgtacgtcgtgatcgcgattctaaccgtggtcgccgcaacaatggctaatgagatgggctttctggaaaagactaaaaaggacctcggacttggcagcatcaccacacagcagccagagtcaaacatactggatatcgacttgcgacctgccagtgcctggaccctgtatgcagttgctactacattcgtgacgcccatgctcagacattctattgagaattccagcgtaaacgtgtcactgaccgccatcgcgaatcaagctactgtccttatggggctcggaaaaggttggccgctgagtaagatggatattggcgtgccattgctggccatcgggtgttacagccaggttaaccctattacattaaccgcagccctatttctgctcgtggctcactacgcaatcataggacccggccttcaggccaaagcgacccgcgaagctcagaagagggccgcagccggtattatgaagaatccaacagtcgacgggatcactgtaatcgatctggaccccattccttatgatccgaaattcgagaagcaattgggccaggtgatgctgctcgttctgtgcgtgacgcaggtccttatgatgcggaccacatgggctttatgtgaagccctgactctcgcaaccggacccatatccacattgtgggagggcaacccagggcgtttttggaataccactatcgctgtgtctatggccaacattttcagaggaagctacctggcgggcgccggtctactgttttccatcatgaaaaatacgacaaacaccaggcgcgggactggaaatattggcgaaaccctcggtgagaagtggaaatcacggcttaacgcactgggcaagtctgagttccaaatctataaaaagagtgggatacaggaagtcgaccgaacattggctaaggagggaatcaaaagaggcgaaactgatcatcacgccgtgtcgagggggagcgcaaagctgcgctggttcgttgagcggaacatggtgacccctgagggaaaagtagtggacctcggctgcggtagagggggatggtcctactattgtggcggtctgaagaatgtccgtgaagttaaaggcttaacaaaggggggacccggccatgaggaacctattccaatgtctacgtacgggtggaaccttgtgaggctgcagtcaggagtcgatgtgtttttcaccccccctgagaagtgcgacactctcctatgtgatatcggcgaaagctccccaaatcccacagtagaggctggtcggaccctgcgcgtgttgaacctggttgagaattggctcaacaataacactcagttttgcattaaagtgcttaatccgtatatgcctagtgtcatcgaaaagatggaggccctgcaacgaaaatacgggggagccttggtgagaaacccactgtctaggaatagcacacacgaaatgtactgggtctcaaacgcgtccggcaatatagtgagtagcgttaacatgatttctcggatgctcatcaatcgcttcaccatgagacacaagaaagctacgtatgagcccgacgtagacttaggctccgggaccaggaacatcggaattgaatcagagatacctaacctggatatcattggtaagcgaatcgagaagattaaacaggaacatgagacaagctggcactacgaccaggatcatccatataagacttgggcataccacggctcgtatgaaaccaaacagacagggtctgccagttccatggtgaatggagtcgtgcggcttctgactaagccctgggacgttgtgccgatggtcacccaaatggctatgacagataccactccttttggccagcagcgtgtgttcaaagagaaggtagacacgagaacacaggaacccaaggagggtaccaaaaagctaatgaaaatcactgccgagtggctctggaaggaactggggaaaaagaaaaccccacgcatgtgtacaaggcaagagtttacgcggaaggtgagaagcaacgcagccttgggagctatattcaccgatgaaaataagtggaaatcagcgcgcgaggccgttgaggactccaggttttgggaactggtcgataaggagcgaaacctccaccttgaaggcaaatgcgagacttgtgtgtacaatatgatgggcaagcgggaaaaaaagctgggggagttcggaaaggcaaaaggttctagagctatctggtatatgtggttaggcgccaggtttctggagttcgaagcattggggtttctcaacgaggaccattggttcagccgcgaaaatagtctgtccggagtggagggcgaaggtctacacaagcttgggtacattctgcgtgatgtcagcaaaaaggagggaggcgccatgtacgctgacgacacagccggctgggatacccggatcactctcgaggacctgaaaaacgaagagatggttacaaatcatatggaaggggagcacaagaagttggcggaagcaattttcaaactgacctatcagaacaaggtggtaagagtgcagaggcctacaccccgcggaactgtcatggatatcatttctcgacgggaccaaagaggttcaggccaggtggggacctacggactcaatacgtttaccaacatggaggcccagcttataaggcagatggagggcgaaggtgttttcaaaagtatccaacatctgacagtgactgaggaaattgctgtccagaattggttagcccgcgtggggagagagcggctgtccaggatggcaatcagcggagatgactgcgtagttaagccattggatgaccgttttgcttctgccctcaccgctctgaacgatatgggcaaagtgcgaaaggacatccagcagtgggagccctcgcgcggctggaatgattggacacaagtccctttctgctcacaccactttcatgaactaattatgaaggacgggagagtgcttgtggtcccatgtcggaaccaggatgagctgataggaagggcccgcatcagccagggtgcaggctggtccctcagagaaactgcgtgcctggggaaaagttatgcccagatgtggtctttgatgtacttccaccggagggacttacgactggctgccaacgcaatttgtagcgctgttccgtcccattgggtgcccacctcacgtacgacatggagtatccacgccaagcacgagtggatgaccactgaagacatgctcacagtatggaatagagtgtggattcaagagaacccttggatggaggataaaaccccagtcgaatcttgggaggaaatcccctatcttggaaagcgcgaggaccagtggtgcggcagcctgataggtctaacttcccgggcaacctgggccaaaaatatccagacagcgattaaccaggtgaggtcactgatcgggaatgaagagtacacggattatatgcctagcatgaagagatttcgccgggaggaagaggaagctggagttctctggtga

SEQ ID NO: 14401 - RNA, 9876 nt, synthetic construct
  misc_feature 1..9876: note = derived and/or modified CDS sequence (opt3) from DENV-2__FJ906968__SS-prME
  source 1..9876: mol_type = other RNA
accgccggcatgatcattatgctgatacccaccgtgatggctttccacctcactacgaggaacggggaacctcatatgatcgtcagcaggcaggaaaagggaaaatcccttctgtttaagaccgaggacggtgttaatatgtgcacattgatggcgatggatttaggcgaactgtgtgaggacactattacctacaaatgcccattcctaaagcaaaacgaaccggaggatatcgactgttggtgcaattctacatcaacctgggtgacttatgggacatgtaccacgactggagagcaccggcgcgaaaaacgaagtgtcgccctcgtgccccatgtcggcatgggtctggagacccgtacagaaacttggatgagctccgagggggcgtggaagcacgctcagagaattgagacctggatccttaggcatcctggatttacaattatggccgcaatcctggcctacaccattggcacgactcacttccagcgggctttgatctttattctcctgacagcagtggccccatctatgaccatgcgctgcatcggcatatcgaacagagatttcgttgaaggggtgtcaggaggtagctgggtcgacattgtgctggagcacggcagttgtgtaactacaatggctaagaataaacccaccctcgattttgaattaatcaagacggaggccaaacagcctgcgaccctgaggaagtattgcattgaagcaaaacttacaaacactaccacagactcccggtgtccaactcaaggggagccctctttgaatgaggaacaggataagcgcttcgtttgcaagcatagcatggtggaccgaggatggggcaacggttgtgggctgtttggaaaaggcggcatcgtaacctgcgccatgttcacatgcaagaaaaatatgaaggggaaagtggtgcagcctgagaacctagaatacaccatcgtcattactccacactccggagaggaacatgctgttggtaatgatacgggcaagcacgggaaagagataaagatcacaccgcagtcaagtattaccgaggccgaactcactggatatggcaccgtgacaatggagtgtagccccagaaccggtctggactttaacgaaatggtacttctgcaaatggagaataaggcatggttggtgcacaggcagtggttcctcgatctgcctttaccatggctgcccggggctgacactcagggctctaactggatccagaaagaaacactcgtcacgtttaagaatcctcatgccaaaaagcaagacgtggttgtgcttggatcccaggagggcgcgatgcacaccgccctgactggggcaacagagatacagatgtcaagcggaaacttgctattcaccggtcatctgaaatgccggctccgtatggataagctgcaacttaagggcatgagttactctatgtgtacagggaaattcaaggtcgtgaaagaaattgctgagactcagcacggaaccatcgtaatccgcgttcagtatgaaggcgacggttccccatgcaagattccctttgagatcatggatctggagaaaagacatgtgttggggaggctcattacggtcaacccgatagtgaccgaaaaggacagccctgtcaatatcgaggccgaacccccattcggcgattcgtacattatcatcggagtggagcctggccagctgaagttaaactggtttaaaaaggggtcttccattggacaaatgatagaaacaactatgcggggtgctaaacgaatggccatcctgggcgacaccgcatgggatttcgggtcactaggaggcgtttttacaagtattggtaaggccctccaccaggtgttcggggctatctacggcgcggcatttagcggagtatcctggattatgaaaatcctgataggcgtcatcattacttggatcgggatgaactctcgcagcacctcacttagtgtgtccttggttctggtgggagtcgtgacgctctatctgggcgtaatggtgcaggccgacagcggttgtgttgtctcttggaagaacaaggagcttaaatgcgggtcaggaattttcatcacagataatgtgcacacctggactgagcagtacaagtttcaacccgaaagtccaagcaaactggcttccgccatacagaaggcacatgaggaaggcatttgtggtatcagatctgtgacaaggttggagaacctcatgtggaaacagattacccccgaactgaatcacatcttatcggagaacgaggtcaagctgactataatgaccggcgacatcaaagggattatgcaggccggaaagcggagcctacaacctcagccaacagaactcaagtattcctggaaaacgtggggcaaggctaaaatgctgtcaaccgagagtcataatcagactttccttatcgatgggccggaaacagccgagtgccccaacaccaatcgcgcatggaactctttggaagttgaggactacggatttggcgtgttcacaactaatatttggctgaagctcagagagaaacaggacgtgttttgtgatagcaagctgatgtccgcggctatcaaggacaacagggccgtacacgcagatatgggttattggatagaatcagccttaaatgacacctggaaaattgagaaggctagcttcatcgaagtcaaatcttgccactggcctaagtcccatacgctgtggagtaacgaggtgcttgagagcgaaatgatcattcccaagaatttcgccgggcccgtttctcaacacaattaccgtcctggatatcatacacagaccgcaggcccatggcacttgggtaagctcgagatggattttgacttctgtgaaggcactaccgtggtcgtgacagaggattgcgggaaccggggaccctccctgcgaactaccacagcttcaggcaagctaatcacggaatggtgctgtagaagttgcaccctgccgcctctcaggtaccgcggggaggacggatgttggtacggcatggagattcggccactgaaagaaaaggaggaaaatcttgttaacagcttggtgactgccggtcatgggcagatagataatttttcgctgggagtattaggcatggcactcttcctggaggaaatgcttagaacaagggtcggtaccaaacacgccatcctgttggtggctgtgtcctttgtcactctcattacaggcaacatgtctttccgcgacctggggcgagttatggtgatggtaggagcaaccatgacggatgacatcggcatgggggtgacttatctagccctgctcgctgcctttaaggtccggcccaccttcgcagcgggactgcttttgcgtaaactgacaagcaaggagttaatgatgaccactattggcatcgtgctcctgtcacaaagtacaatacctgagaccatccttgaactgacagatgccctagctctcggtatgatggttctgaagatggtgagaaaaatggagaagtaccagttggccgtcactattatggcaatcctgtgcgtgcccaatgctgttattttacagaacgcctggaaagtgtcctgtaccatcctcgcagtcgtatctgtgagcccactgtttcttacgtcctcacagcaaaaggccgactggatacctctggctttgacaattaaagggctcaatcccaccgcgatcttcctgactaccctaagcaggacaaacaagaaacgcagttggccactgaatgaagccatcatggcagttggaatggtgtctattcttgcttccagcctcctgaagaacgacataccgatgactggccctttggtcgccggcgggctgttaaccgtgtgctatgtactcacgggacggtcggccgatctggagcttgaaagagctgcagacgtgaagtgggaggatcaggccgagatctcaggttctagtcccattctgtccatcacaattagcgaagacggctctatgagcatcaaaaatgaggaagaggagcagatattgaccatcctcattaggactgggctgctagtcatctccggactgtttccagtttcaattcccatcacagcggctgcctggtgtctttgggaagtgaagaaacagcgagcaggcgtgctctgggatgtccctagtccaccccctgtgggtaaggccgagctggaagacggggcttaccgcataaaacaaaagggaattttgggctatagccagatcggcgcaggggtttacaaggagggaaccttccacactatgtggcatgtaacacggggtgccgtgttaatgcacaaaggcaagagaatcgaaccgtcttgggcggatgtcaaaaaggacctgatttcctatgggggaggctggaaactcgagggtgagtggaaggaaggggaggaagtgcaggttctggctcttgagccaggaaagaaccccagggccgtgcagaccaaacctggcctgtttaagacgaatgcaggcactatcggggccgtctcattggatttcagtccaggaaccagcggttcccccataattgacaaaaagggcaaagtggtagggctatacggaaacggcgtcgtgacacgttctggtgcttacgtttcggccatcgcacaaaccgaaaagagcattgaggataaccctgagatcgaagacgatatattccgcaagcggaaactgacaattatggacctccatccgggggctggaaagactaaaagatatctgcccgccatcgtgagggaggcgatcaagcgaggccttcggaccttaattctggccccaacgcgcgtcgtggcagctgaaatggaggaagccctcagaggcttgcctatcaggtaccagacacccgctattcgggcagagcacactgggcgagagatagttgacctgatgtgccatgccacctttacaatgagactcctgtcaccagtgcgcgtccctaattataaccttatcattatggatgaagcccacttcaccgaccccgcttccatcgcggcaaggggatacatcagtactcgtgtggagatgggtgaagccgctggcatttttatgaccgccacaccaccggggtctcgggatcctttcccccagagcaatgcaccaataatggacgaggagagagaaatccccgagaggtcctggtcatctggacacgaatgggtaacggattttaaaggcaagactgtgtggttcgttcctagcattaaggccggtaacgacatcgctgcgtgtctgcgcaaaaatgggaagaaagtcattcaattgagtcgaaagacctttgattccgagtatgtgaaaacaagaaccaacgactgggatttcgtggtcactacagacatcagcgaaatgggagccaattttaaggcagagcgggtaatagatccaaggcgctgcatgaaacccgtgatcctaaccgacggcgaggaacgtgttattctggctggccctatgccggtgacgcattcttcagccgcacagagacgggggaggatcggacgcaacccaaagaatgagaacgaccagtacatttatatgggtgaacccctcgagaatgatgaagactgtgcccactggaaggaggctaaaatgttactggataacatcaatactcctgagggcataattccctccatgttcgaaccagagcgagaaaaggtcgacgccatcgatggggagtacagacttcggggagaagcgaggaaaacatttgtggacctgatgcgcagaggcgatctccctgtttggttggcatacagggtggccgctgagggtattaactatgccgaccggcgttggtgcttcgatgggatcaagaataaccagatactggaggaaaacgtcgaggtggaaatctggaccaaagagggcgagcgcaagaagctcaaaccccgatggctggacgctagaatttacagtgatccacttgcactaaaggagttcaaagagtttgccgctggaagaaagagcctgaccttgaatttaatcactgaaatgggccggctgcctacattcatgacccaaaaagcccgcgacgcactcgataacctggcggtacttcatacagccgaggctggtgggagggcctataatcacgcactgtcggaactcccggagactttggagacgctgctactgctcacccttctggctacagtgactgggggcatatttttattcttgatgtctgggaggggaatcggcaagatgaccctgggtatgtgctgtataattacagcctccatcctcctgtggtacgcacagatccagccccactggattgccgctagcatcatacttgaatttttcctgattgttctcttgatcccagagcctgaaaagcagcggaccccacaagacaaccagctgacttatgtcgtgattgcgatcttaacggtggtcgccgcaaccatggctaatgagatggggtttctagagaaaactaagaaagacctgggcctcggatcaataactacccagcagccagaaagtaacatccttgatattgacctgcgacctgcctctgcctggacattgtacgcagttgctaccactttcgtgacacccatgctgagacattccatcgagaatagctcagtaaacgtgagtctcacggccattgcgaatcaagctaccgtcctgatgggccttgggaagggatggccgctcagcaaaatggatatcggtgtgccactgttggccattggctgctattcccaggttaaccctatcactctgacagcagccttatttctactggtggctcactacgcaataattgggcccggactccaggccaaggcgacccgcgaagctcagaagagggccgcagccggcatcatgaaaaatccaaccgtcgacggtatcacagtaattgatcttgaccccataccttacgatccgaagttcgagaaacaactgggacaggtgatgttgctggttctctgtgtgactcaggtcctgatgatgcggacgacctgggctctttgcgaagccttaacactggcaactggccccatctctaccctctgggagggaaacccaggccgtttttggaatacaaccattgctgtgagcatggccaacatcttcagagggtcctatttggcgggagccggcctgctattttcaattatgaagaatactacgaacacaaggcgcggtaccgggaatatcggagaaactctgggcgagaaatggaagtctcggctcaacgcacttggtaaaagtgagttccaaatatacaagaagtcgggcatccaggaagtcgaccgaaccctggctaaagaggggattaagagaggagaaacagatcatcacgccgtgagcaggggctccgcaaaattgcgctggttcgttgagcggaacatggtgactcctgaggggaaggtagtggacctgggatgtggcagaggtgggtggtcttattactgcggaggcctcaaaaatgtccgtgaagttaagggtctgaccaagggcgggcccggacatgaggaacctatcccaatgtcaacatatggctggaacttagtgaggcttcagagcggggtcgatgtgtttttcacgccccctgagaaatgtgacaccctgctctgcgatattggagaatccagtccaaatcccactgtagaggctggccggacactacgcgtgctgaacttggttgagaattggctgaacaataacacccagttttgtatcaaggtgctcaatccgtacatgccttctgtcatagagaaaatggaggcccttcaacgaaagtatggtggggccctggtgagaaacccattgagcagaaattcaactcacgaaatgtactgggtctccaacgcgagtggaaatattgtgagctctgttaacatgatctcccggatgctgatcaatcgcttcacaatgagacacaaaaaggctacctacgagcccgacgtagacctcggctcaggcacgaggaacattgggatagaaagcgagatccctaacttagatattatcggaaagcgaattgagaaaatcaagcaggaacatgagacctcgtggcactatgaccaggatcatccatacaaaacatgggcatatcacggttcttacgaaactaagcagaccggcagtgcctccagcatggtgaatggggtcgtgcggctgcttacaaaaccctgggacgttgtgccgatggtcactcaaatggctatgaccgatacaaccccttttggacagcagcgtgtgttcaaggagaaggtagacactagaacgcaggaacccaaagagggcacaaagaaactgatgaagataaccgccgagtggctatggaaagaactcggtaagaaaaagactccacgcatgtgcaccagggaggaatttacacggaaggtgagatcaaacgcagccctgggggctatcttcacggatgagaataaatggaagtccgcgcgcgaggccgttgaagactctaggttttgggagttggtcgataaagaacgaaacctgcacctcgagggaaagtgtgaaacctgcgtgtataatatgatgggcaaacgggagaagaaacttggcgagttcgggaaagcaaagggaagcagagctatttggtacatgtggctgggtgccaggtttttagagttcgaggcactgggctttttgaacgaagaccattggttcagtcgcgaaaattccctcagcggggtggaaggagagggcctgcacaaactaggttatatccttcgtgatgtctctaagaaagaagggggagccatgtacgctgacgacactgccggctgggatacacggattaccctggaagacctcaagaacgaggaaatggttactaatcatatggagggcgaacacaagaaactggcggaggcaatcttcaagttgacataccaaaacaaagtggtaagagtgcagaggcctacaccccgcgggacagtcatggatattatatcacgacgggaccagagaggaagtggtcaagtgggcacttatgggctgaatacctttacgaacatggaggcccagctcatcaggcagatggaaggagagggcgttttcaagtccattcagcatcttaccgtgacagaagagatcgctgtccaaaattggctggcccgcgtgggtagagagcggttaagcaggatggcaatctctggggatgactgcgtagttaaaccactggatgaccgttttgcttcggccttgactgctctcaacgatatgggaaaggtgcgaaaggacattcagcagtgggaaccctcacgcggctggaatgattggacccaggtccctttctgtagccaccactttcatgagctgataatgaaagacggcagagtgctagtggtcccatgccggaaccaagatgaacttatcgggagggcccgcatttcccagggagcaggttggagtctgagagagacagcgtgtctcggcaagtcttacgcccagatgtggagcctgatgtatttccaccggagggacttgcgattagctgccaacgcaatctgctccgctgttccgtcacattgggtgcccacaagtcgtaccacgtggtctattcacgccaaacacgaatggatgacaaccgaggacatgctgactgtatggaatagagtgtggatccaggagaacccttggatggaagataagacaccagtcgagagctgggaagagataccctacctcgggaaacgcgaagaccaatggtgtggatcccttatcggcctgacctcacgggcaacttgggccaagaatattcagaccgcgatcaaccaggtgaggagcctaattggtaatgaggagtatacagattacatgccttctatgaagagatttcgccgggaagaggaagaggctggggttctgtggtga

SEQ ID NO: 14402 - RNA, 9876 nt, synthetic construct
  misc_feature 1..9876: note = derived and/or modified CDS sequence (opt3) from DENV-2__FJ906969__SS-prME
  source 1..9876: mol_type = other RNA
accgccggcatgatcattatgctgatacccacagtgatggctttccacctcactacgagaaacggggagcctcatatgatcgtcagcaggcaggaaaagggaaaatcccttctgtttaagaccgaggacggtgttaatatgtgcacattgatggcaatggatttaggcgaactgtgtgaggacactattacctacaaatgcccattcctaaagcaaaacgaaccggaggatatcgactgttggtgcaattctacatcaacctgggtgacttatgggacatgtaccacgactggagagcaccggcgcgaaaaacgaagtgtagccctcgtgccccatgtcggcatgggtctggagacccgtacagaaacttggatgagctccgagggggcgtggaagcacgctcagagaattgagacctggatccttaggcatcctggatttacaataatggccgcaatcctggcctacaccattggcacgactcacttccagcgggctttgatctttattctcctgacagcagtggccccatctatgaccatgcgctgcatcggcatatcgaacagagatttcgttgaaggggtgtcaggaggtagctgggtcgacattgtgctggagcacggcagttgtgtaactacaatggctaagaataaacccaccctcgattttgaattaatcaagacggaggccaaacagcctgcgaccctgaggaagtattgcattgaagcaaaacttacaaacactaccacagactcccggtgtccaactcaaggggagccctctttgaatgaggaacaggataagcgcttcgtttgcaagcatagcatggtggaccgaggatggggcaacggttgtgggctgtttggaaaaggcggcatcgtcacctgcgccatgttcacatgcaagaaaaatatgaaggggaaagtggtgcagcctgagaacctagaatacaccatcgtcattactccacactccggagaggaacatgctgttggtaatgatacgggcaagcacgggaaagagataaagatcacaccgcagtcaagtattaccgaggccgaactcactggatatggcaccgtgacaatggagtgtagccccagaaccggtctggactttaacgaaatggtacttctgcaaatggagaataaggcatggttggtgcacaggcagtggttcctcgatctgcctttaccatggctgcccggggctgacactcagggctctaactggatccagaaagaaacactcgtcacgtttaagaatcctcatgccaaaaagcaagacgtggttgtgcttggatcccaggagggcgcgatgcacaccgccctgactggggcaacagagatacagatgtcaagcggaaacttgctattcaccggtcatctgaaatgccggctccgtatggataagctgcaacttaagggcatgagttactctatgtgtacagggaaattcaaggtcgtgaaagaaattgctgagactcagcacggaaccatcgtaatccgcgttcagtatgaaggcgacggttccccatgcaagattccctttgagatcatggatctggagaaaagacatgtgttggggaggctcattacggtcaacccgatagtgaccgaaaaggacagccctgtcaatatcgaggccgaacccccattcggcgattcgtacattatcatcggagtggagcctggccagctgaagttaaactggtttaaaaaggggtcttccattggacaaatgttcgaaacaactatgcggggtgctaaacgaatggccatactgggcgacaccgcatgggattttgggtcactaggaggcgttttcacaagtatcggtaaggccctccaccaggtgtttggggctatttacggcgcggcattcagcggagtatcctggatcatgaaaattctgatcggcgtcataatcacttggattgggatgaattctcgcagcacctcacttagtgtgtccttggttctggtgggagtcgtgacgctctatctgggcgtaatggtgcaggccgacagcggttgtgttgtctcttggaagaacaaggagcttaaatgcgggtcaggaatctttattacagataatgtgcacacctggactgagcagtacaagttccaacccgaaagtccaagcaaactggcttccgccatccagaaggcacatgaggaaggcatatgtggtattagatctgtgacaaggttggagaacctcatgtggaaacagatcacccccgaactgaatcacattttatcggagaacgaggtcaagctgactatcatgaccggcgacataaaagggatcatgcaggccggaaagcggagcctacaacctcagccaacagaactcaagtattcctggaaaacgtggggcaaggctaaaatgctgtcaaccgagagtcataatcagacttttcttattgatgggccggaaacagccgagtgccccaacaccaatcgcgcatggaactctttggaagttgaggactacggattcggcgtgtttacaactaatatctggctgaagctcagagagaaacaggacgtgttctgtgatagcaagctgatgtccgcggctattaaggacaacagggccgtacacgcagatatgggttattggatcgaatcagccttaaatgacacctggaaaatagagaaggctagcttcattgaagtcaaatcttgccactggcctaagtcccatacgctgtggagtaacggggtgcttgagagcgagatgatcatcccaaaaaactttgccggacccgtttctcaacacaattaccgtcctggctatcatacacagaccgcaggtccatggcacttgggcaagctcgaaatggatttcgacttttgtgaggggactaccgtggtcgtgacagaagattgcggaaaccggggcccctccctgcgaactaccacagcttcagggaagctaattacggagtggtgctgtagaagttgcaccctgccgcctctcaggtaccgcggagaagacggctgttggtacggtatggagatccggccactgaaagagaaggaagagaatcttgttaacagcttggtgactgccgggcatggacagattgataatttctcgctgggcgtattaggtatggcgctctttctggaagagatgcttagaacaagggtcggcaccaaacacgccatactgttggtggctgtgtccttcgtcactctcatcacagggaacatgtcttttcgcgacctgggacgagttatggtgatggtaggcgcaaccatgacggatgacattgggatgggagtgacttatctagccctgctcgctgccttcaaggtccggcccacctttgcagcgggcctgcttttgcgtaaactgacaagcaaggaattaatgatgaccactatcggtattgtgctcctgtcacaaagtacaatccctgagaccatacttgagctgacagatgccctagctctcgggatgatggttctgaagatggtgagaaaaatggaaaagtaccagttggccgtcactatcatggcaattctgtgcgtgcccaatgctgttatcttacagaacgcctggaaagtgtcctgtaccattctcgcagtcgtatctgtgagcccactgttccttacgtcctcacagcaaaaggccgactggatccctctggctttgacaataaaaggactcaatcccaccgcgatttttctgactaccctaagcaggacaaacaagaaacgcagttggccactgaatgaggccatcatggcagttggcatggtgtctatccttgcttccagcctcctgaagaacgacattccgatgactggccctttggtcgccgggggactgttaaccgtgtgctatgtactcacgggtcggtcggccgatctggaacttgagagagctgcagacgtgaagtgggaagatcaggccgagatatcaggctctagtcccatcctgtccattacaatcagcgaggacgggtctatgagcattaaaaatgaagaggaagagcagatcttgaccatactcatcaggactggactgctagtcatttccggcctgttcccagtttcaatccccattacagcggctgcctggtgtctttgggaggtgaagaaacagcgagcaggtgtgctctgggatgtccctagtccaccccctgtggggaaggccgaactggaggacggagcttaccgcatcaaacaaaagggcatattgggctatagccagattggggcaggagtttacaaggaaggtacctttcacactatgtggcatgtaacacggggcgccgtgttaatgcacaaagggaagagaatcgagccgtcttgggcggatgtcaaaaaggacctgatctcctatggaggcggttggaaactcgaaggggagtggaaggagggagaagaggtgcaggttctggctcttgaaccaggcaagaaccccagggccgtgcagaccaaacctggcctgttcaagacgaatgcagggactattggagccgtctcattggatttcagtccaggtaccagcggctcccccatcatagacaaaaaggggaaagtggtaggactatacggcaacggtgtcgtgacacgttctggggcttacgtttcggccattgcacaaaccgagaagagcatcgaagataaccctgagattgaggacgatatctttcgcaagcggaaactgacaataatggacctccatccgggagctggcaagactaaaagatatctgcccgccattgtgagggaagcgatcaagcgaggccttcggaccttaatcctggccccaacgcgcgtcgtggcagctgagatggaagaggccctcagagggttgcctattaggtaccagacacccgctatccgggcagaacacactggacgagagattgttgacctgatgtgccatgccaccttcacaatgagactcctgtcaccagtgcgcgtccctaattataaccttataatcatggatgaggcccactttaccgaccccgcttccattgcggcaaggggttacatcagtactcgtgtggaaatgggcgaggccgctgggatcttcatgaccgccacaccaccgggatctcgggatccttttccccagagcaatgcaccaattatggacgaagagagagagatacccgaaaggtcctggtcatctggccacgagtgggtaacggatttcaaaggtaagactgtgtggtttgttcctagcatcaaggccgggaacgacattgctgcgtgtctgcgcaaaaatggaaagaaagtcatccaattgagtcgaaagaccttcgattccgaatatgtgaaaacaagaaccaacgactgggattttgtggtcactacagacattagcgagatgggcgccaatttcaaggcagaacgggtaatcgatccaaggcgctgcatgaaacccgtgatactaaccgacggcgaggagcgtgttatcctggctgggcctatgccggtgacgcattcttcagccgcacagagacggggaaggattggtcgcaacccaaagaatgaaaacgaccagtacatctatatgggcgagcccctcgaaaatgatgaggactgtgcccactggaaggaagctaaaatgttactggataacattaatactcctgaggggatcataccctccatgtttgagccagaacgagagaaggtcgacgccattgatggagaatacagacttcggggcgaggcgaggaaaacattcgtggacctgatgcgcagaggtgatctccctgtttggttggcatacagggtggccgctgaagggatcaactatgccgaccggcgttggtgcttcgatggcattaagaataaccagatcctggaggagaacgtcgaagtggagatatggaccaaagaaggagagcgcaagaagctcaaaccccgatggctggacgctagaatctacagtgatccacttgcactaaaggagtttaaagaattcgccgctggcaggaagagcctgaccttgaatttaattactgagatggggcggctgcctacatttatgacccaaaaagcccgcgacgcactcgataacctggcggtacttcatacagccgaagctggaggtagagcctataatcacgcactgtcggagctcccggaaactttggagacgctgctactgctcacccttctggctacagtgactggcgggatcttcttatttttgatgtctggaaggggcattggtaagatgaccctggggatgtgctgtatcataacagcctccattctcctgtggtacgcacagatccagccccactggatcgccgctagcattatccttgagttctttctgatagttctcttgattccagaacctgagaagcagcggaccccccaagacaaccagctgacttatgtcgtgatcgcgattttaacggtggtcgccgcaaccatggctaatgaaatgggcttcctagagaaaacaaagaaagacctgggactcggctcaatcactacccagcagccagaaagtaacatacttgatatcgacctgcgacctgcctctgcctggacattgtacgcagttgctaccacttttgtgacacccatgctgagacattccattgagaatagctcagtaaacgtgagtctcacggccatcgcgaatcaagctaccgtcctgatggggcttggaaagggttggccgctcagcaaaatggatattggcgtgccactgttggccatcgggtgctattcccaggttaaccctattactctgacagcagccttattcctactggtggctcactacgcaatcataggacccggcctccaggccaaggcgacccgcgaggctcagaagagggccgcagccggtattatgaaaaatccaaccgtcgacgggatcacagtaatcgatcttgaccccattccttacgatccgaagtttgaaaaacaactgggccaggtgatgttgctggttctctgtgtgactcaggtcctgatgatgcggacgacctgggctctttgcgaggccttaacactggcaactggacccatatctaccctctgggaaggcaacccagggcgtttctggaatacaaccatcgctgtgagcatggccaacatttttagaggatcctatttggcgggcgccggtctgctattctcaatcatgaagaatactacgaacacaaggcgcgggaccggaaatattggcgagactctgggtgaaaaatggaagtctcggctcaacgcacttggcaaaagtgagttccaaatctacaagaagtcggggatacaggaggtcgaccgaaccctggctaaagaaggaatcaagagaggcgagacagatcatcacgccgtgagcagggggtccgcaaaattgcgctggtttgttgaacggaacatggtgactcctgagggaaaggtagtggacctgggctgtggtagagggggatggtcttattactgcggcggtctcaaaaatgtccgtgaggttaagggcctgaccaaggggggacccggccatgaagagcctattccaatgtcaacatatgggtggaacttagtgaggcttcagagcggagtcgatgtgttctttacgccccctgaaaaatgtgacaccctgctctgcgatatcggcgagtccagtccaaatcccactgtagaagctggtcggacactacgcgtgctgaacttggttgagaattggctgaacaataacacccagttctgtattaaggtgctcaatccgtacatgccttctgtcatcgagaaaatggaagcccttcaacgaaagtatgggggagccctggtgagaaacccattgagcaggaattcaactcacgagatgtactgggtctccaacgcgagtggcaatatagtgagctctgttaacatgatttcccggatgctgatcaatcgctttacaatgagacacaaaaaggctacctacgaacccgacgtagacctcggctcagggacgaggaacatcggaattgagagcgaaatacctaacttagatatcattggtaagcgaatcgagaaaattaagcaggagcatgaaacctcgtggcactatgaccaggatcatccatacaaaacatgggcatatcacggctcttacgagactaagcagaccgggagtgcctccagcatggtgaatggagtcgtgcggctgcttacaaaaccctgggacgttgtgccgatggtcactcaaatggctatgaccgatacaacccctttcggccagcagcgtgtgtttaaggaaaaggtagacactagaacgcaggagcccaaagaaggtacaaagaaactgatgaagatcaccgccgagtggctatggaaagagctcgggaagaaaaagactccacgcatgtgcaccagggaagagttcacacggaaggtgagatcaaacgcagccctgggagctatatttacggatgaaaataaatggaagtccgcgcgcgaggccgttgaggactctaggttctgggaattggtcgataaagagcgaaacctgcacctcgaaggcaagtgtgagacctgcgtgtataatatgatgggcaaacgggaaaagaagcttggggagtttggaaaagcaaagggtagcagagctatctggtacatgtggctgggcgccaggttcttagagtttgaagcactggggttcttgaacgaggaccattggttcagtcgcgaaaattccctcagcggagtggagggcgaaggtctgcacaaactagggtatattcttcgtgatgtctctaagaaagagggaggcgccatgtacgctgacgacactgccggctgggatacacggatcaccctggaggacctcaagaacgaagagatggttactaatcatatggaaggggagcacaagaaactggcggaagcaatttttaagttgacataccaaaacaaagtggtaagagtgcagaggcctaccccccgcggaacagtcatggatatcatttcacgacgggaccagagaggtagtggccaagtggggacttatggactgaataccttcacgaacatggaggcccagctcataaggcagatggagggcgaaggtgtttttaagtccatccagcatcttaccgtgacagaggaaattgctgtccaaaattggctggcccgcgtggggagagagcggttaagcaggatggcaatctctggagatgactgcgtagttaaaccactggatgaccgtttcgcttcggccttgactgctctcaacgatatgggcaaggtgcgaaaggacatccagcagtgggagccctcacgcggctggaatgattggacccaggtccctttttgtagccaccacttccatgaactgattatgaaagacgggagagtgctagtggtcccatgccggaaccaagatgagcttataggaagggcccgcatctcccagggtgcaggctggagtctgagagaaacagcgtgtctcgggaagtcttacgcccagatgtggagcctgatgtattttcaccggagggacttgcgattagctgccaacgcaatttgctccgctgttccgtcacattgggtgcccactagtcgtaccacgtggtctatccacgccaaacacgagtggatgacaaccgaagacatgctgactgtatggaatagagtgtggattcaggagaacccttggatggaggataagacaccagtcgaaagctgggaggaaatcccctacctcggaaaacgcgaggaccaatggtgtggctcccttataggtctgacctcacgggcaacttgggccaagaatatccagaccgcgattaaccaggtgaggagcctaatcgggaatgaagagtatacagattacatgccttctatgaagagattccgccgggaggaagaggaagctggagttctgtggtga

SEQ ID NO: 14403 - RNA, 9876 nt, synthetic construct
  misc_feature 1..9876: note = derived and/or modified CDS sequence (opt3) from DENV-2__FJ898454__SS-prME
  source 1..9876: mol_type = other RNA
accgccggcgtgatcattatgctgatacccacagctatggcattccacctcactacgagaaacggggagcctcatatgatcgtcagcaggcaggaaaagggaaaatcccttctgtttaagaccgaggacggtgttaatatgtgcacattgatggccatggatttaggcgaactgtgtgaggacactattacctacaactgcccactactccggcaaaatgaaccggaggatatcgactgttggtgcaactctacatcaacctgggtgacttatgggacatgtaccgcgacgggagagcaccgccgagaaaaacgtagtgtagctctggtgccccatgtcggcatgggtcttgagactagaaccgaaacatggatgagctccgagggggcctggaagcacgcacagaggattgagacttggatcctgcggcatcctggattcaccataatggccgctatcttggcatacacaattggcaccacgtattttcagcgcgtgctcatcttcattctgctgactgccgttgctccatctatgacaatgagatgcatcggcatatcgaatagggattttgtggaaggggtctcaggaggtagctgggtggacattgtactcgagcacggcagttgtgttaccactatggccaaaaacaagcccacattagatttcgaactgatcaagaccgaggcgaaacagcctgcaacgcttcggaagtactgcattgaagccaaattgaccaatacaactaccgcttcccgctgtccaacacaaggggagccctctctgaacgaggaacaggacaagcgatttgtgtgcaaacacagcatggtcgatagaggatggggcaatggttgtgggctattcggaaagggcggcatcgtgacttgcgccatgtttacctgcaagaaaaacatggaggggaagatcgtgcagcctgaaaatctcgagtatacaattgtcgttaccccacattccggagaagagaacgcagtgggtaatgacactggcaaacacgggaaggagataaaagtaacgccgcagtcaagtatcacagaagctgagctgaccggatacggcactgtgaccatggaatgtagccccaggacaggtcttgatttcaacgagatggtcctgttgcaaatggaaaataaggcctggctcgtgcatcggcagtggtttctggacttacctctgccatggctccccggggcggatacccagggctctaactggattcagaaagagactcttgttacattcaagaaccctcacgccaagaaacaagacgtggtcgtgctgggatcccaggagggcgcaatgcacacggctttgaccggggccactgaaatccagatgtcaagcggaaatctactgtttacaggtcatctcaagtgccgtctgcgcatggacaaacttcaactgaagggcatgagttattctatgtgtaccgggaaattcaaggtagttaaggagatagctgaaacacagcacggaactattgtggtcagagtgcagtacgagggcgatggttccccatgcaaaatccccttcgagatcatggacttggaaaagaggcatgtcctcgggcggctgattaccgtgaacccgatcgttacggagaaagatagccctgtgaatattgaagccgagcccccatttggcgactcgtacataatcattggagtagaacctggccagttaaagctgtcttggttcaaaaaggggtcctcaatcggacaaatgtttgagaccacaatgcgaggtgcaaagcgcatggccatcctaggcgatactgcttgggacttcgggagtctcggaggcgtctttaccagcattggtaaagcgctgcaccaggtgttcggggcaatatatggcgccgctttttccggagtttcttggacaatgaagatccttattggcgtggtcatcacttggattgggatgaacagcagatcaaccagtttgtccgtgagcctggtactcgtgggagttgtcacgctgtaccttggcgtgatggtgcaggccgattctggttgtgtcgtttcatggaaaaataaggagctgaaatgcgggagtggaatcttcataacagacaacgtgcatacctggactgaacagtataagtttcaacccgagagcccatccaagttggcatctgccatccagaaagcttacgaagagggcatttgtggtatcaggtcggtgacacggctcgaaaatctgatgtggaagcagattacccccgagttaaaccacatcctgagcgagaatgaagccaaactaactataatgaccggcgatattaaggggatcatgcaggcaggaaaacgctccctcagacctcaaccaacagagctgaagtattcatggaaaacgtggggcaaggcgaagatgcttagtaccgaaccgcacaaccagactttcttgattgacgggcccgagacagctgaatgccctaataccaacagggcctggaattctctggaggtagaggattacggatttggcgtcttcacaactaacatctggctcaaactgaaggaacgtcaggacgtgttttgtgacagcaaattaatgtccgcagccataaagaataaccgggctgttcatgccgatatgggttattggatcgagtcagcactgaacgacacctggaaaattgaaaaggctagcttcatcgaggtgaagtcttgccactggccaaaatcccatacgctttggagtaatggggtcttggagagcgaaatgattatccccaagaacttcgccggacctgtgtctcagcacaattaccgaccaggctaccacacacaaaccgcgggtccctggcatctcggcaaactggagatggattttgacttctgtgaagggactaccgttgtggtaacagaggattgcggaaacagaggcccgtccctaaggactaccacagcctcagggaagctgataacggaatggtgctgtcgcagttgcaccctccctccactgcggtatagaggagaggacggctgttggtacggtatggagattaggccccttaaagaaaaggaggaaaatttggtcaacagcctggtgactgctgggcacggacagatcgataatttttcgttaggcgtgctcggtatggcactgttccttgaggaaatgctgcgcacacgagtcggcaccaagcatgccgttttgctcgtggctgtatcctttatgactctgatcacagggaacatgtctttccgggacctaggacgtgtgatggtcatggtgggcgccgcaattaccgatgacatcgggatgggagttacgtatctggcgctcctggccgcttttaaagtgagacctactttcgccgcaggccttttgctgaggaagttaaccagcaaagagctcatgatgacaaccattggtatagtcctgctttcacagagtactatccccgagacaattctggaactaaccgatgctctcgccctggggatgatgatcttgaagattgtgcgcaatatggagaaataccaactggcagttacaatcatggccactttatgcgtgccaaacgctgtcatactccagaatgcgtggaaggtatcctgtaccatcctggccgtggtttctgtgagccctcttctgttgacgtcctcacagcagaaggcagactggattcccctcgctctgacaatcaaaggactaaacccaaccgccatttttctgactacccttagccggacaaataagaaaagaagttggccgctcaacgaagccatcatggctgtcggcatggtgtctatactggcatccagcttgctgaagaatgatattcctatgactggccccttagtagccgggggactcctgaccgtgtgctatgtccttacgggtaggtcggcggacctggagttggaacgagctgccgacgttcgctgggaggatcaagcagagatctcaggctctagtccaatcctctccattacaataagcgaagacgggtctatgagcatcaaaaacgaggaagaggagcagaccctgactattctaatccggacaggactgcttgtgatttccggcctcttccccgtgtcaatccctataaccgccgctgcatggtacctgtgggaagtcaagaaacagagagccggtgtgttgtgggatgttccaagtccccctccggtagggaaggcggagttagaagacggagcttataggatcaagcagaaaggcattctgggctacagccaaatcggggccggagtgtacaaggagggtacttttcacacaatgtggcatgtcacccgtggcgcagtgctcatgcacaaagggaagcgcattgaaccatcttgggccgatgttcggaaagacctgatctcctatggaggcggttggaagcttgagggggagtggaaggaaggagaggaagtgcaggtcctggctttggagcccggcaaaaaccctagagccgtgcagacgaagccaggcctattcaaaactaataccgggacaataggagcagtatcactggattttagtcccggtaccagcggctcccctattgtcgacaagaaagggaaggtggttggactctacggcaacggtgtggtcacaaggtctgggacttatgtgtcggctatcgcccagaccgaaaagagcatcgaggataatccggagattgaagacgatatcttccgaaaaaagcggctgacgataatggaccttcaccccggagcgggcaaaacaaagcgctacttaccagccattgttagagaggcaatcaaaaggggcctgcggactctcattttggctcctacccgagtggtcgccgctgaaatggaggaagcactgagagggctccccatccgctatcaaacaccagccataagggccgagcataccggacgtgagattgtggatctgatgtgtcacgctactttcaccatgcggcttctgtcacctgtaagagtgcccaactacaatttgatcatcatggacgaagcgcattttacagacccagcatccattgccgctaggggttatatcagtacgcgcgttgagatgggcgaagccgcagggattttcatgactgccaccccgcctggatctcgagatccctttccacagagcaacgctcccataatggacgaggagagagaaatccctgagcggtcctggaattcaggccacgaatgggtcacagatttcaagggtaagaccgtgtggtttgtgccatctattaaagcggggaacgacatcgccgcatgcctaaggaagaatggaaaaaaggtcatccagctgagccgcaaaactttcgatagtgagtacattaagacacgtaccaacgactgggattttgtagtgacgactgacatatccgaaatgggcgctaatttcaaggccgagagagttatcgatccccggaggtgtatgaaacctgtgattctcacagacggcgaggaacgcgtcatcttagcagggccgatgccagtgacccatagctctgccgctcaacgaagaggacggattggtaggaaccccaagaatgagaacgatcagtacatctatatgggcgaacctctggagaatgacgaagactgcgcccactggaaagaggcgaagatgcttctggataacataaacacccccgaggggatcattccatcaatgtttgaacctgagcgcgaaaaagttgacgcaatcgatggagagtacagactcaggggcgaagcccggaagactttcgtggacttgatgcgtcgcggtgatctgcccgtctggctcgcttatcgagtggccgctgaggggattaattacgcagacagaaggtggtgttttgatggcatcaaaaacaatcagatactggaggaaaacgtagaggtggaaatttggacaaaggagggagagcggaagaaacttaagccacgctggctagacgccagaatctattccgatcctctggctttgaaagaattcaaggagttcgccgcaggcaggaaaagtttaaccctgaatctcattacagaaatggggcggctgccgacttttatgacgcagaaggcgcgaaacgcccttgacaatctggctgttctccacaccgccgaggcaggaggtagagcttacaaccatgccttgagcgaactgcccgagacactagagactctgctccttctgaccttattggcaacagtcaccggcgggatcttcctgtttctcatgtcgggaaagggcataggtaaaatgactctggggatgtgctgcatcattacggcctctatccttctgtggtatgctcaaattcagccacactggatcgcggcctccataattctcgaattctttttgatcgtgctgttaatccctgagcccgaaaagcagcgcaccccacaggataatcaactaacatacgtggtcattgcaatcctgactgttgtggctgccaccatggccaacgagatgggcttcctcgaaaaaacaaagagggactttggacttggcagcatagcaacccagcagcctgagtcaaatattctggatatcgacttgcggcccgctagtgcctggactctgtacgcggtagctacaacgttcattaccccgatgctccgtcattctatcgagaactccagcgtgaatgtctcactgactgccatagcaaaccaggccacagtgcttatggggctcggaaaaggttggccactgagtaagatggacatcggcgttcctttgctggctattgggtgttatagccaagtgaatcccatcaccttaaccgcagccctactgctccttgtcgcgcactacgctattatcggaccaggcctgcaggccaaggcaacaagagaagcccagaaaagggctgccgcaggtattatgaagaaccccactgtagatgggatcacggtgatagacttggatcctattccgtatgaccccaaatttgagaagcagctgggccaagttatgctcctggtgctttgcgtcacccaggtgttaatgatgcgcacaacttgggctctgtgtgaagccctcaccttggcgacaggaccaatctccaccctgtgggagggcaatcctgggcggttctggaacactacgatcgccgtctctatggcaaacatttttcgaggaagctacctagctggcgccggtctgctcttctccataatgaaaaatacaaccaacactagaagggggaccggaaatacaggcgaaactcttggtgagaagtggaagaaccgcctgaattcattgggcaaatctgagtttcagatctataagcggagtgggattcaagaagtggatagaaccctggcaaaagagggaatcaagcgtggcgaaacagaccaccatgctgtttcgagggggagcgccaaactccggtggttcgtggagcgcaacctggtaacgcccgagggaaaggtggtcgatttaggctgcggtcgagggggatggtcctactattgtggcggtcttaaaaatgttagagaagtgaagggcctgaccaaggggggacctggccacgaggaaccaattcccatgtctacttacgggtggaacctcgtcaggctacagtcaggagtggacgtattctttacacctccagagaaatgcgataccctgttgtgtgacatcggcgaaagctcccccaatccgactgtggaggccggtcggacactgcgcgttctcaaccttgtggagaattggctgaacaataacacccagttctgcataaaggtcttgaatccttacatgccaagtgtgatcgaaaaaatggagacgctgcagagaaagtatgggggagcgctcgtcaggaaccccttatctcgaaacagcacccatgaaatgtactgggtgtcaaatgcttccggcaacattgttagtagcgtaaatatgatctctcggatgctgattaaccgttttacaatgagacacaaaaaggcaacttatgagcctgatgtggaccttggctccgggacccgcaatatcggaatagaatcagagacaccaaacctggatattatcggtaagaggatcgagaaaattaagcaagaacatgagactagctggcactacgaccaggaccacccctataaaacctgggcctaccatggctcgtatgaaacaaagcagaccgggtctgctagttccatggtcaatggagtggttcggctactcactaaaccgtgggatgtgatacctatggtcacgcagatggccatgacagacaccactcccttcggccaacagagagtgtttaaggagaaggtagatacccgcacacaggaaccaaaagagggtacgaagaaactgatgaagatcaccgcagagtggttgtggaaagaactggggaagaagaaaactcctaggatgtgtacacgagaggaattcacccggaaggtgagaagcaacgccgctctcggagcgatttttactgacgagaataaatggaagtcagccagggaggcagttgaagattcccgcttctgggagcttgtcgacaaagaacgtaacctgcacttagagggcaagtgcgaaacatgtgtgtacaatatgatgggcaaacgggagaagaagatcggggagtttggaaaagctaagggttctagagccatttggtacatgtggctgggcgcaaggttcttggaatttgaggccctcgggttcctgaacgaagatcattggtttagccgcgagaatagtctatccggagtggaaggcgagggtcttcacaaactggggtatatcctccgagaggtcagcaagaaagaaggaggcgctatgtacgccgacgataccgcgggctgggacacacggataactctggaggatttgaagaacgaagagatggttaccaatcacatggaaggggagcataagaaactggcagaggccatcttcaagctcacgtatcagaacaaagtggtaagagtgcaaaggcccaccccacgcggaacagtcatggacattatctctagacgggaccagaggggttcaggccaggtggggacttacggacttaacaccttcacaaatatgggcgctcaactgattcgtcagatggaaggtgagggggtttttaagggaatccagcacttaactgccaccgaagaggtggcagtccaggattggctggctcgagtgggccgcgagagattgagtcggatggccatttccggcgacgattgcgtagttaaacccctcgacgataggttcgctagcgccctgacggcactaaacgacatggggaagatacgcaaggatatccaacagtgggaaccttctagaggatggaatgactggacacaggtgccattttgctcgcatcacttccatgagcttattatgaaagatggtcgggtcctggtggtgccgtgtaggaaccaggacgaactcatcggccgagcgcgtatctcacaaggggccggatggagcctgagagagaccgcttgcttgggcaagtcctatgcccagatgtggagtttaatgtactttcaccgccgggatctgaggctcgcagctaatgccatttgttctgcagtccccagccactgggttcctacttccagaacaacctggtcaatacatgcccgccacgaatggatgactaccgaggacatgcttacagtgtggaaccgggtatggatccaggagaatccatggatggaagataaaacgcccgtggagagttgggaagagattccttatctgggtaagagggaagaccagtggtgcgggtctctaatcggactgaccagccgagcgacttgggctaaaaacattcaaacagccatcaatcaggtcagatccctcataggctcagaggagtacaccgactacatgccaagcatgaagcggttcaggcgcgaagaggaagaggcaggcgtgttgtggtga

SEQ ID NO: 14404 - RNA, 9876 nt, synthetic construct
  misc_feature 1..9876: note = derived and/or modified CDS sequence (opt3) from DENV-2__JQ922551__SS-prME
  source 1..9876: mol_type = other RNA
accgtgggcatgatcattatgctgatacccacggcaatggctttccacctcactacgcgaaacggggagcctcatatgatcgtcagcaggcaggaaaagggaaaatcccttctgtttaagaccgaggacggtgttaatatgtgcacattgatggcaatggatttaggcgaactgtgtgaggacactattacctacaactgcccactactcaaacaaaatgaaccggaggatatcgactgttggtgcaactctacatcaacctgggtgacttatgggacatgtaccgcaacgggagagcaccggcgcgaaaagcgaagtgtagcgctggtgccccatgtcggcatgggtcttgagactcgtaccgaaacatggatgagctccgagggggcttgcaaacacgcccagaggattgagacttggatcctgaggcatccttctttcaccataatggcagccatcttggcttacacaattggaaccacgtattttcagcgggtggttttcctcatggtgctgactgcagtcgccctgtcgatgacaatgcgctgtatcggcatttcaaatagagattttgtggaaggcgtaagcgggggaagttgggttgacatcgtgctcgagcacggttcctgcgtcaccactatggctaagaacaagccaacattagatttcgaactgataaaaaccgaggccaagcagcccgcgacgcttaggaaatactgtattgaagcaaagttgaccaatacaactaccgcctctcggtgccctacacaaggcgagccaagcctgaacgaggaacaggacaaacgctttgtgcgaaagcactccatggtggatagagggtggggaaatggctgtggtctattcgggaagggaggcatcgtcacttgcgctatgtttacctgcaaaaagaacatggagggcaaaattgttcagcccgaaaatctcgagtatacactggtgatcacccctcattcaggggaagagaacgccgtaggaaatgacactggtaaccacggcaaggagatcaaagtgacgccacagagtagcattacagaagcagctcttaccgggtacggaactgtcaccatggagtgttctccgaggacaggcctgaatttccatgaaatggtgtccttgcccatggagaacaaggcctggatggttcaccggcaatggtttctcgatctgcctttaccatggctgcccggtgcggacacccaggggtcaaactggatacagaaagaaactctcgtgacattcaagaatcctcacgccaagaaacaggatgtcgtggtacttggcagccaagagggagcaatgcatacggctctgaccggcgccactgagatccagatgagttctgggaacttgctatttacaggacacctgaagtgccgtctccgcatggacaaactgcagcttaagggtatgtcctatagcatgtgtaccggcaaattcaaggttgtgtgggggattgctagaacacaacatggaactatcgtccacagggtgcagtacgaaggcgacggttcgccatgcaagatacccctgaatattatggggttggagaaacggcatgtcctcggccgaccgatcaccgtgaaccctatcgttacgggaaaggattctcccgtgaatattgaagccgagccacctctgggcgactcctacatcattataggggtagagcccggacaggtcaaattaacctgttcacagaagggtagtagcatcggccaaatgttcgaaacaactatgcgcggggcaaaaagaatggccattctgggagataccgcttgggactttggctccctaggtggggtgttcacatctatcggcaaggcgctccaccaggtttttggagcaatctatggcgccgctttcagcggggtgtcatggactatgaagattctgataggagtcgtgatcacctggattggcatgaacagtaggtccacgagcctttctgtatcattggtgctggttggtgtcgtgacactctacctgggggtgatggtccaggccgatagtggatgcgttgtgagctggaaaaataaggagcttaaatgtggctccggtatctttgtgaccgacaacgtacacacttggacagaacagtataagttccaaccagagtctccctcgaaactggcaagcgccattcagaaggctcatgaagagggcatctgcgggatacggtccgtcacccgcttggagaatctcatgtggaagcagatcactcctgaactgaaccacattttatcagagaatgaagtgaaactgaccatcatgacaggagatattaagggcatcatgcaggccgggaaaagaagtctaaggccacaaccgacggagctcaagtactcttggaaaacctggggaaaggcaaaaatgctgagcactgaaccccataaccagacatttcttatagacggccctgagaccgcggagtgtccatccacaaatcgtgcttggaactcattgaagggtggggattatggattcggcgtttttactaccaatatttggctgaagctcaaagaacggcaggacgtgagctgcgattctaagctgatgtccgccgcaatcaaagacaaccgagccgtccacgctgacatgggttactggattgagagtgccttaaacgatacgtggaagatcgaaaaagccagcttcatagaggtgaagtcttgtcactggcccaagtcccatacactgtggtcaaatggcgttcttgaaagtgagatgatcattcctaaaaacttggctgggccagtgagccagcacaattatagacccggataccatacccaaactgccggcccgtggcacctcgggaagctggagatggactttgatctatgcgaaggaaccacagtagtcgtgactgaggactgcggcaacaggggtccttcgctgcgcaccacaacggcgtccgggaaactcatcaccgaatggtgttgccggtcttgtactctgccaccccttagatacaggggagaggatggctgctggtatggtatggagattcgccctttgaaggaaaaagaggaaaatctggtgaacagcttagtcacagccgagcatgaacagatcgacaatttctcactcggcgttctggggatggctctttttctggaggagatgttgcgaacccgggtgggaactaagcacgcagtactcctggtggccgtcagtttcatgacactaataaccggcaacatgtccttccgtgatctggggagagtgatggttatggtgggagctgccatgacggacgatattggcatgggtgtcacttacctcgcactgcttgcggcctttaaggtgaggcccaccttcgctgccgggttgctgttacgcaaactcacatctaaggaactgatgatgaccactatcggaatcgttcttctgagccagtccacaattccagagaccatcctagaactcacagacgcactggctttgggcatgatgattctgaaaatagtgcggaatatggagaagtatcaattagccgtcactatcatggcaattctctgtgtacctaacgccatgatcctgcagaatgcttggaaagtgtcatgcaccattcttgcggttgtgagcgtcagtcccctgttgctcacgtcttcccagcagaaggccgattggatcccactggcactaacaataaagggcctgaacccgaccgctatctttcttactaccctcagcagaacaaataaaaagaggtcgtggcctctgaacgaagccattatggccgtggggatggtatcaatcttggcttctagtctgctaaagaatgacattcccatgactggaccactcgtggccggtggcctgcttaccgtctgttacctgttgcccgggcgatccgccgatctcgagctggagcgcgcggctgacctacggtgggaagaccaagccgagatcagcggatctagccctatactgtccattacgatctcagaagatggcagtatgagcatcaagaaccaggaggaaaaacagacacttaccattctcataaagactggtctgttggttatctctgagttattcccagtgcagattcccatcacagcagccgcttggtatctgtgggaggtgaaaaagcaaagagcaggggtcctctgggacgtgccttccccgccacccgttggaaaggccgaactggaggatggcgcgtacggcattaaacagaaggggatccttggatattcacagataggtgctggcgtatacaaagaagggacctttcacactatgtggcatgtgacaaggggagccgtcctgatgcacaagggcaaacgtatcgagcctagttgggcagacgtgcgcaaggatttgattagctacggtgggggatggaagctagagggcgaatggaaagagggcgaagaggttcaggtgctggccctcgaaccagggaagaacccccgggctgtccaaaccagacctggactgttcaaaacgaatactggtaccatcggcgccgtgtcccttgacttttctccggggacatcgggaagccccattgtagataagaaaggcaaggtcgtgggtttatatgggaacggagttgtgaccaggtcaggcacatacgtctccgcaatcgctcagactgagaagagtatagaggacaatccagaaattgaggatgacatcttccggaaaaagagactgaccatcatggatctccatcctggcgccgggaaaacgaagcgctatttgcccgcgattgtgagagaagccatcaaaaggggactgcggacactcatactggcaccaactcgagttgtggctgccgagatggaagaggctcttagaggtctgcctattcgctaccagacccccgcaatcagggccgagcacacaggccgtgaaattgtcgacttgatgtgccatgccacctttactatgcggctactgtctccagtgagagtaccgaactataatctcatcataatggatgaggctcacttcaccgaccctgcgagcattgcagccagggggtacatctccacacgcgtggaaatgggagaggctgccggcatctttatgacggcaactcccccaggttcacgagaccccttccctcaatctaacgccccaattatggatgaagagagagagatccccgaacggagctggaatagtgggcacgagtgggttaccgactttaagggaaagacagtctggttcgtgccttccattaaagctggcaacgatatagcggcctgtttaaggaagaatggcaaaaaggtgatccagctgagccgcaaaaccttcgactctgaatatattaagactcgtacaaacgattgggactttgtcgtaaccacggatatctcagagatgggggcaaatttcaaggctgagagagtgatcgacccgcggaggtgcatgaaaccagttattcttactgatggagaggaacgcgtgatactggccggtcccatgcctgtcacacattccagtgcagcccagcgaagaggccggatcgggaggaaccccaagaatgaaaacgaccagtacatttacatgggagagccactcgaaaatgatgaggactgtgctcactggaaagaggccaagatgttgctggacaacatcaacacccctgaaggcattatccccagcatgtttgagccagaacgcgagaaagtggatgcgatagacggtgaatatagactcagaggggaagcacggaagaccttcgttgatctgatgcgtcgcggcgaccttcctgtgtggctagcctaccgagtcgctgccgagggaatcaattatgctgatagaaggtggtgctttgacggcattaaaaacaatcaaatcctggaagagaacgtggaagtagagatttggactaaggaaggggagaagaaaaagttgaaaccgcggtggttagatgcacgcatctactcggaccccctggccctcaaggagttcaaagaatttgctgccggaagaaagtctctgacacttaatctgataaccgagatgggtaggctcccaacattcatgactcagaaggcacggaacgcgttggataatctggccgtgctacatacggctgaagccggcgggcgagcatataaccacgctctgtccgagctccctgagacccttgaaacactgttattgctgactctcctggccaccgttacaggaggcatttttcttttcctgatgagcggtaaagggatcggcaagatgaccctcggaatgtgctgtattatcactgcatcaatattgctgtggtacgcccagatccagccccactggattgctgcgagtatcattttagagtttttcctaatcgtcctgctcataccagaacctgagaaacaaagaacgccccaggacaatcagcttacctatgtggtgattgccatcctgacagcagtcgctgccactatggccaacgaaatgggcttcttggagaagaccaaaaaggattttgggctgggatctatcgcaacacagccgccagagtccaatattctcgacatcgatctgcgccctgctagcgcctggaccctttacgcggttgctactacattcataacgtcaatgctcaggcatagtattgaaaacagctccgtgaatgtatctctgaccgccatcgcaaaccaagccactgtgttgatgggtctgggcaaggggtggcccttaagcaaaatggacattggagtcccactactggctatcggctgctactcccaggtgaatcccataacactcaccgcagcccttctgttgctggttgcgcactatgctatcattggtcctgggctccaggccaaggcaacccgggaggcccagaaacgtgctgccgcaggcatcatgaagaacccgacagtggacggaattactgtcatcgatctggaccccattccatacgatcctaaatttgaaaagcaacttggccaggtaatgttactggtgctctgtgttacacaggtgttgatgatgagaaccacatgggctctgtgcgaggccctaactctggcgaccgggcccatctcaacactctgggaaggaaatcctggcaggttctggaacaccactatagccgtctctatggcaaacatttttcgcggtagttatcttgctggggccggactgttgttctcgatcatgaagaatacgacaaacacccggcgaggcactggtaataccggcgagacactgggggagaaatggaagaacagactcaatgcactgggaaaaagcgaatttcaaatctacaagaaatccggcattcaggaggtggacaggactttagctaaggaagggataaaacgcggagagaccgatcatcacgccgtctctcggggctcagccaaacttagatggttcgtggaacgtaacctggttacaccagagggtaaggtggtagacctcgggtgtggaaggggcggttggagctattactgcggcgggctgaaaaatgtgcgggaggtcaagggattaacgaaaggcgggcccggacatgaggagcctatcccaatgtccacctatggctggaacttggttcgcctgcagagtggtgtggatgtctttttcactcccccggaaaagtgtgacacactcctttgcgatattggggagtctagccctaatccaaccgtggaggcgggacgaactctgagagtattgaacctggtggaaaattggctcaacaataacacacagttttgtgttaaagtgttaaatccctacatgccttcagtcatcgagaagatggaaaccctgcaaaggaagtacggcggcgctcttgtgcggaacccactgtcccgcaacagtacgcacgagatgtattgggtcagcaatgcatctgggaacattgtgtcctcagttaatatgatcagcagaatgctaataaacaggttcaccatgcgacacaaaaaggccacatacgaacccgacgtagatctcggatcgggtactcggaatatcggcattgagtctgagaccccgaacctggacatcattgggaaacgtatcgaaaagataaaacaggagcatgaaacaagttggcactatgatcaggaccatccttacaagacttgggcttatcacggatcctacgagaccaagcagacaggcagcgcctcatccatggtgaatggtgtcgtgagattgctgaccaaaccctgggacgttattccaatggtgactcaaatggcaatgacggatacaaccccttttgggcagcagcgcgtcttcaaggaaaaatctgacactaggacccaggagcccaaggagggaaccaaaaagctcatgaagatcacgccaaaatggctttggaaggaactgggcaaaaagaaaacaccccggatgtgcactagagaggagttcacacgcaaggtgaggagcaacgccgctttaggcgcgatctttaccgatgagaataaatggaagagtgcccgagaagcagtagaggactcccggttctgggagctggtggataaggaaagaaacttgcacctcgaggggaaatgtgaaacttgcgtttataatatgatgggaaagagggagaaaaagctgggtgagtttggcaaagctaaggggagccgcgccatttggtacatgtggctaggagcacgtttccttgaatttgaggccctgggcttcctcaacgaagaccattggttttctcgggaaaattcactgagtggtgtcgaaggggagggattgcacaagctgggctacatactcagagatgtgtccaaaaaggagggcggggctatgtatgccgacgatacagcgggatgggacaccaggatcacacttgaagatctgaaaaacgaggaaatgggtgcaaatcatttagagggcgaacctaagaaactgtacgaggccattttcaagttgacttatcaaaacaagggggtgcgcgtccagcgaccaaccccgcggggacccctcatggacatcattctgagaagggaccagggcggtagcgggcaagttggaacgtacggcctaaacacctttacaaatatgggcgctcagcttatccgccagatggagggggaaggagtgttcaaaggtatacagcacctgatcgccactgaggaaattgcagtacaagattggctcgctagagtgggccgggagaggttttctcgtatggccatctcgggggacgattgcgtcgtgaagcctctggacgatcgattcgcttcagccttgaccgcattaaacgacatgggaaaagaacgcaaggttctgcagcagtgggagccaagcagagagtggaatgattggacacaggtgcccttttgttcccatcacttccacgaactcattatgaaagacggccgggtccttgtggtaccttgcaggaaccaagatgagctgatcggtcgcgcgagaattagtcagggggccggatggtctctacgggaaactgcttgtctgggcaagagctatgcccagatgtggtcccagatgtacttccataggcgagacctccgtttggcagctaatgccatatgctcagcagttccaagtcactgggtgcccacctctagaacgacatggagcatccatgcccgccacgagtggatgaccactgaggatatgctgacagtctggaaccgggtgtggattcaagaaaatccttggatggaggacaagaccccggtggaatcctgggaggaaatcccatatcttggcaaaagggaggatcagtggtgtgggtcactgatcggactcactagcagagcgacctgggctaagaacattcagacagccataaatcaggtccgctctttaatcggtaacgaggaatacacggactacatgccctccatgaaacggtttaggcgagaggaagaggaagcaggcgttctgtggtga

SEQ ID NO: 14405 - RNA, 9876 nt, synthetic construct
  misc_feature 1..9876: note = derived and/or modified CDS sequence (opt3) from DENV-2__JQ922550__SS-prME
  source 1..9876: mol_type = other RNA
accgtgggaatgatcattatgctgatacccacagtcatggccagccacctcactacgagaaacggtgggcctcatatgatcgttattgggcagcaaaagaggaaaacctccttctttaagaccaagaagggccacgacatgtgcactcttatggctatggcattcggggagttttgtgaaaataccatcacatacaaatgcccattcctgaagcagaacgagccggaagatattgactgttggtgcaattctacctcaacttgggtgacatatggaacctgtacgactaccggcgagcatcggcgcgaaaagcgaagtgtagccttggtgccccacgtcggtatggggttagagacacgtactgagacctggatgagctccgaaggagcgtggaaacatgctcagagaatcgagacatggatactgaggcaccctggctttaccatcatggccgcaattctagcctacacgatcggcactacacacttccagcgggtgctcatttttatcctgcttaccgctatagcaccatctatgactatgcgctgcattgggatctcgaacagagatttcgttgaaggagtgtcaggtggcagctgggtcgacattgtgctggagcatgggagttgtgtaacaaccatggccaagaataaacccacgttggattttgagctcatcaagaccgaagctaaacaacctgccacactgaggaagtattgcatcgaggcgaagctgactaacaccacaactgactcccggtgtccaacccagggagaacccacactcaatgaggaacaggataaacgcttcgtttgcaagcactctatggtggaccgaggctggggtaacgggtgtggattatttggcaaaggcgggattgtcacatgcgcaatgttcacttgcaagaaaaatatgaagggaaaaatagtgcagcctgagaacctggagtacacggtggtcatcacaccacatagcggtgaagaacacgccgttggcaatgataccgggaagcacggaaaggaagtgaaaattactccgcaatcctcaatcaccgaggctgaacttacaggctatggtaccgtaactatggagtgtagtcccagaacagggttggactttaacgagatggtgctgctacagatggaagataaggcctggctcgtccataggcagtggttcctggaccttcctctgccatggttgcccggcgcagatacgcagggaagcaattggatacaaaaagagaccctcgtgactttcaagaaccctcacgctaaaaagcaggacgttgtggtcctgggctctcaggaaggggccatgcatacagcgttaaccggagccacagagattcaaatgtcctcaggtaatctgctctttactggccaccttaagtgccggctgcgtatggacaaattgcagctaaaggggatgagctacagtatgtgtaccggaaaattcaaggtggtaaaagaaatcgcagagacgcagcatggcaccatcgttattcgcgtgcagtatgagggtgatgggtctccatgcaagatcccctttgaaattaaggacctggagaaaagacacgtcctcggcaggctgataacagtgaacccgatcgtcactgaaaaggattcccctgtgaacattgaggctgagcccccacttggagacagctacatcatcattggcgttgaacctgggcaactgaaattggattggttcaagaaaggatcgtctataggtcagatgtttgagaataccatgcggggcgccaagcgaatggctatcctcggggacacagcctgggatttcggatccctgggcggtgtgtttacttcaattgggaaggcattacaccaggtattcggcgccatctacggagctgcgtttagtggcgtcagctggaccatgaaaattctgatcggggtgataatcacgtggattggaatgaactcccgctctacaagcctatcagttagtctcgtgctggtcggcatcgtgaccctttatttgggtgtaatggtgcaggcagactccgggtgtggaggctgcgaaagaaagactaaaacaaagtgtggtagcggcattttcgttaccgataatgtccatacttggaccgagcaatacaaatttcagcccgaatctccatcaaagctggccagtgctatccagaaagcccacgaggaggggatatgcggaattaggagcgtgacacggctcgaaaacctgatgtggaagcagatcacgcccgagcttaatcatattctgtccgaaaacgaggtgaagttgaccatcatgactggcgacataaaagggatcatgcaagcaggaaagcgctctctcagacctcagccaacagaactgaggtattcgtggaaaacctggggcaaggccaaaatgttaagcacagagctgcacaatcagactttcctaattgatggtccggagaccgctgaatgtcccaacacgaatcgtgcctggaactccctcgaggtcgaagactacgggtttggagttttcacaaccaatatctggctgcggcttcgagagaagcaggacgtgttctgcgattcaaagttgatgagtgcagcgattaaagacaacagagctgtgcacgccgatatgggctattggatcgaatctgcactgaatgacacttggaagatagagaaagccagctttattgaggtaaagtcctgtcattggcctaaatcacacaccctctggggtaacggcgtcctggaaagcgagatggtgatcccaaagaatttcgctgggcccgtttctcaacataacaacaggcctggatactatacacagactgccggcccatggcacttagggaagctggaaatggattttgacttctgcgagggaaccacagtggtcgtgacggaggattgcggcaatcgcggtccctcccttcggaccactacagcaagtgggaaattgatcaccgaatggtgttgcagaagctgtactctcccgcctccaaagtacaggggagaggacggctgctggtacggtatggaaattcgccccctgaaagagaaggaagagaacctagtttcttccctggtgacagctggccatgggcagatcgataatttttcactcggcattctgggcatggcccttttcttggaggaaatgctgcgaacccgggtagggacgaaacacgcgatattactcgtcgccgtgagttttgtgactctgatcaccggaaacatgagcttccgtgaccttggcagagtcatggttatggtgggtgctacaatgaccgatgacattgggatgggagtaacttatctggcattgctcgccgcttttaaggtgaggcctacattcgccgcaggcctgctactgcgcaagctcacctcgaaagagctgatgatgacaactatcggcattgtcctttcctctcaaagctcaatccccgaaaccatattggagctgacggatgcgttagccctcgggatgatggtgctgaagatggttcggaatatggaaaaataccagcttgctgtgacaatcatggccattctgtgtgtcccaaacgcagtgatcctacagaatgcttggaaggttagttgcaccattctcgccgtggtctccgtatctcctctgttgctgactagctcccagcaaaaagcagactggatccccttagccctcaccataaagggactgaacccaacagctatttttcttactaccctgtcaggtacgagcaaaagaaggagttggccgttgaatgaggcgatcatggccgtgggcatggtttctatcctcgcatccagcctgctaaagaacgacattcctatgacagggcccctggtggctggaggccttctcaccgtctgttatgtgctgactggtcgatcggccgatttggagctggaacgcgccacagacgtaaagtgggatgaccaggctgagatatcagggtctagtccaatcttatccattaccatcagcgaagatggatctatgagcattaaaaatgaggaagaggagcagactctcacaatcctgatacggaccggccttctggtgatctccggcttgttccccgtctcaattcctatcacggcagccgcgtggtacctctgggaagttaagaaacagagagctggggtgctgtgggacgtgccaagtccccctctagtcggaaaggccgagctggaagatggtgcatataggattaaacaaaagggcatccttgggtacagccagataggagccggcgtgtataaggagggtacttttcacaccatgtggcatgttacacgtggggctgtactcatgcacaaaggaaagcgcattgagccgtcttgggcagacgtgaaaaaggatctgatctcctacggcggcgggtggaaattggaaggagagtggaaggaaggtgaggaagtccaggtgttagccctggagccaggcaagaacccccgggcggttcagaccaaacctggactcttcagaacaaatactggaaccatcggcgctgtgtcactggacttcagtccaggtacgagcgggtcccccattgtcgataagaaaggaaaggtggtaggcctttacggcaacggggtcgtgacaaggtctggagcctatgtttcggcaatcgcccaaactgagaaaagcatagaagacaatcctgagattgaagatgacatctttcgaaagcggcgcctgaccattatggacttgcatccgggtgctggcaagacaaaaagatacctacccgccatcgtgagggaggcaataaagcgggggctgcgaaccctcattctggctccaactagagtcgtggccgcggaaatggaggaggcccttcgcggattacctatcaggtatcagacccccgcaatccgtgctgaacacacaggccgggagattgttgatctgatgtgccatgccacgttcactatgagactcttgtcaccaatcagggtgcctaactacaacctgattataatggacgaagctcactttaccgatcccgcatccatcgccgcccgcggttatattagtacacgagtcgagatgggggaagctgcgggaatcttcatgaccgcaactccaccgggctctagagacccttttccccagagcaatgccccaatcatggatgaggagcgggaaattcccgagaggtcctggaactcaggccacgaatgggtgacagacttcaaagggaagaccgtatggtttgtgccttctataaaaacgggaaatgatatcgctgcctgtctccgcaagaacggtaagcgtgttattcaactgagcagaaaaactttcgacagtgagtacgtcaagacacggaccaatgattgggactttgtggtgaccactgatatctccgagatgggcgcaaacttcaaagccgaaagggtcattgacccacgccgatgcatgaagcccgtaatccttacagacggggaggaaagagtgatactggctggacctatgccggttacccatagctctgcggcccagcggaggggccgcatcggtagaaatcccaaaaacgagaatgatcagtatatttacatgggggaacccttggagaacgacgaggattgtgcacactggaaggaagctaaaatgctactggacaatatcaacacacctgagggcattatcccctcaatgtttgaaccagagagggaaaaggtggatgccatagacggagagtaccggctccgtggcgaggcacgcaagactttactggaacttattcgagggggacctatccccgtctatctgggttacaaatggccaggcgaggggattaattatgccgattccagactctgcgtgggaaggacgcagaacaatcaaatcttggaagagaacgttgaagtggagatatggaccaaggagggcaaaggtaagaaactgaagcctcggtggctcgacgctcgcatctacagtgatccgctggcccttaaggagttcaaagagttcgcggcagggagaaagagcctaacactgaacttgattactgaaatgggcaggttacccacctttatgacacagaaagcccgggacgctctggataatctcgccgtcctgcataccgctgaggcaggaggcaaggcctataaccacgctctttcggagctgccagaaactctcgagacgttgctgctactgaccctccttgccacagtgactgggggaatcttcctgtttttaatgtctggtcgaggcattgggaaaatgaccttgggaatgtgctgtatcataacagcatccattctgctctggtacgcgcagatccagcctcactggatcgccgctagcattatcctggagttctttcttatagtactgctcattcccgagccagaaaagcaaagaacccctcaggacaatcagttgacttatgtgatcattgccatcctgacagttgtcgcagctacgatggccaacgagatgggcttcttagagaagaccaaaaaggatctaggtctggggaatatagcaactcagcaacccgaatcaaacatcctcgacattgaccttcgcccggccagtgcttggacactgtacgcggtggccaccacctttatcacaccaatgttgaggcattctattgaaaattccagcgtgaacgtctcactgactgcaatcgctaatcaggccacggttctcatgggcctgggaaaaggctggcctcttagtaagatggatattggggtgcccctcctggccatcggatgctacagccaggtaaacccaataaccttgacagcagctctgttactactggtggcccactatgcgattatcggccccggtctccaggctaaagccactcgggaagcacaaaagcgtgccgctgcagggatcatgaagaatcctaccgtcgacggaattacagtgatagatcttgacccgatcccctacgatccaaaattcgagaagcagctgggccaggttatgttgctggtgctctgtgtcacccaagtactgatgatgagaactacgtgggccctttgcgaagcgttaacactggctaccggtcctgtgtccactctctgggagggcaaccccgggaggttttggaataccacaattttgatccagatggccaacattctgcgcggatcttatctagcaggcgccgggcctctgttcagcatcatggagaatactaccggaccacggcgaagaacaggccagctcggtagggaacttctgcgccggtggaaatccagattgaacgctctggggaagtcagagtttcagatatacaaaaagtctggaatccaagaagttgaccgtacgctcgccaaagagggcattaagaggggtgaaaccgatcatcacgcagtgagtcggggctcggctaagctgcgctggttcgtcgagcgaaatttagtgactcccgaggggaaagtcgtggaccttggatgtggcagagggggatggagctattactgcggcggtctgaagaacgttagggaagtgaaagggctcacaaagggaggccctggccatgaggaaccaatccccatgtccacctatgggtggaacctagtacggctgcagtctggagtggatgtctttttcattccgcctgagcgctgtgacactttgctgtgcgatatcggtgagtcaagcccaaatcccacagttgaagccggcagaaccctcagggtgcttaacctggtcgagaattggttgaacaataacacgcagttctgtataaaagtgctgaatccttacatgccatccgtaattgaaaagatggagaccctccagcgaaagtacgggggagcgttagtgcggaaccccctgagtcgtaattctacacacgaaatgtattgggttagcaacgcctcaggcaatatcgtgtccagtgtcaacatgatcagcagaatgcttattaatcgctttactatgaggcacaaaaaggcaacctacgagccggacgtggatctgggttctgggacacggaacataggaatcgagtccgaaattcctaatctagacatcattggcaaaagaatcgagaagataaaacaagaacatgagacttcatggcactatgaccaggatcatccctacaagacctgggcttatcacggcagctacgaaacaaagcagaccgggtcggcctctagtatggtcaacggagtggttcgcctcctgactaaaccatgggacgtagtgcctatggtcacgcagatggcaatgacagataccactcccttcggtcaacagagggtgtttaaggagaaagttgacacccgaatccaggagccaaaggaaggcaccaaaaagttgatgaagattatggctgagtggctgtggaaagaactcgggaagaaaaagacgccccggatgtgcaccagagaggagttcactaaaaaggtgaggtccaacgccgcccttggagcgatctttacagatgagaataaatggaaaagcgctcgcgaggcagtcgaagacggccgtttctgggagctggtggatcgggaaagaaacttacacctggagggtaagtgtgagacctgcgtatataatatgatggggaaaagggaaaagaaattgggagagtttggcaaggccaaaggctcacgcgctatttggtacatgtggctcggggcccgattcctggaatttgaggcactaggattccttaacgaagaccattggttttcccgggaaaattctctgagcggtgtggagggcgaagggctccacaagctgggatacatcttgagagaggttagtaagaaagaaggcggtgccatgtatgctgatgacactgcggggtgggatacaaggattaccctgggagccctcaagaacgagcgcaaatgcacagaacatatggagggcgagcctagaaagccaggccgggggcacttcaaatggaggaatcaaaaccgtgtcgtgggagtgcagggtccgactcccggcgggaccgtcatggacataatctcccgaaagaatcagcgcggaagcggccaggttggtacgtacgggcttaacacctttacaaatatggaagcacaactgattagacagatggagggagaaggcttcttcatcgagcatcagcacttaactgcttctgaagagaacgccgtgcaggactggctggcacgggtaggcagggagaaggtgtcacgcatgcctatcagtggggatgactgtgtcgtgaaaccattggatgacagatttgcccgggctctcaccgccctgaatgatatgggaaaggttaggaaagacattcaacagtgggaaccctcccgaggttggaacgattggacacaggtgcctttctgcagccaccattttcacgagctaataatgaaggacggccgtactcttgtcgtgccatgtagaaatcaggatgaactgatcgggcgcgcgcggatttctcaaggagcaggctggtcgttcggtgagaccgcctgcctcgggaaatcatatgctcagatgtggagcctgatcaactttaggattcccgacttgagattagccgcaaacgtaatctgttccgttgtgcctagtcattgggtcccgacgtctcgcacaacctggagcatacacgctaatcacgagtggatgactacagaagatatgctgaccgtgtggaaccgggtgtggatcctcgagaatccatggatggaagacaagactcccgtcgagtcctgggaagagattccttaccttgagaagagggaagatcagtggtgcggatcactgatcggcctaacaccacagccaccttgggccaaaaacattgagacagctatcaatcaagttcgaagtctgataggcaacgaagagtatattgactacctcccctctatgaagagattccggatcgaagaggaggaaagcgggtttttgtggtga

SEQ ID NO: 14406 - RNA, 9876 nt, synthetic construct
  misc_feature 1..9876: note = derived and/or modified CDS sequence (opt3) from DENV-2__JQ922553__SS-prME
  source 1..9876: mol_type = other RNA
accgccggcatgatcattatgctgatacccacagtgatggctttccacctcactacgagaaacgtcgagcctccaatgatctttagcagacaggaaaaggggaaatccttcctttttaagaccaaagacggacatgatatgtgcacattcatggcaatggacctgggtgagttgtgtgaagatactattacctacaagtgcccgtttttaaaacaaaatgagcccgaagacatcgattgttggtgcaactctacatcaacctgggttacttatggcacatgtaccacgactggggagcaccggcgcgagaagcgaagtgtggccctggtacctcatgtgggaatgggcttagaaacccgtacagagacttggatgagctccgaaggtgcgtggaagcacgtccagagaattgagacctggatcctcaggcatccagggttcacaataatggctgccatcctggcatacaccattggaacgactcactttcagcgggtgcttatcttcattctgttgacaggcgttgccccctctatgcgcatgagatgcatcggcatatcgaatagggactttgtggagggggtctcaggaggtagctgggtggatattgtactcgaacacggcagttgtgttaccactatggctaaaaacaagcctacactggacctggagctcatcaaaaccgaagcaaagcagccagccacgttacggaaatattgcattgaggctaagctgaccaatacaactaccgattcccgctgtcccacacaaggggaacctactcttaacgaggagcaggacaagcgattcgtgtgcaaacattctatggtcgatagaggatggggcaatggttgtgggttgtttggaaagggcgccatcgtgacctgcgcgatgttcacatgcaaaaagagcatgaaaggcaagatcgtgcagccagaaaacctggagtacaccgtcgttattactccgcactccggggaagagtatgcagtgggaaatgacacgggtaaacatggcaaggaagtaaagataacaccccagtcaagtatcaccgaggccgagctaactgggtacggaaccgtgacaatggaatgtagccctaggaccggcctcgattttaacgagatggtcctgcttcaaatggaagacaaggcttggctggtgcaccggcagtggttcttggacctcccactgccctggttacctggtgccgatactcaggggtctaattggattcagaaggagacactggttacgttcaaaaacccacacgcaaagaaacaagacgtggtcgtgctcggctcccaggaaggagctatgcataccgcccttactggcgcgacagagatccagatgtcaagcgggaatctgttgtttaccggacacctaaagtgccgtctgcgcatggataagctccaactgaaaggtatgagttattctatgtgtacaggcaagttcaaagtagttaaggagatagccgaaactcagcatgggaccattgtgatcagagtccagtacgagggagacggctccccctgcaaaatcccgtttgaaattatggatcttgagaagaggcacgtgctgggtcggttgatcacggtcaaccctattgtgaccgagaaggacagccccgttaatatagaagcagagccacctttcggggattcgtacatcattatcggcgtggaacccggacagctcaaactggactggtttaagaaaggatcttccatcgggcaaatgttagagacaactatgcgaggagctaagcgcatggccattctgggtgataccgcttgggacttcggctcactagggggagtatttacaagtataggcaaagccctccatcaggtcttcggtgcaatctatggggccgcttttagcggcgtgtcctggactatgaagattctgatcggagttattatcacctggataggcatgaactctagaagcacgtcacttagtgtgtccttggtcctggtggggatcgtaacactctacctgggagtgatggttcaggcggatagcggctgtgtcgtgtcttggaagaacaaagaacttaagtgcggttcagggattttcgtgaccgacaatgtccacacttggacagagcagtataaatttcaaccagagagtcccagcaagctggcatccgccatccagaaagctcacgaagagggaatttgtggcatcaggtctgttacccggttggaaaacctcatgtggaagcagataactctggagttaaatcatattctgtcggaaaacgaggtgaaactaaccatcatgacaggtgacattaagggcatcatgcaagtggggaagcgcagcctcagacctcaaccaacggagctgaggtactcctggaaaacctggggaaaggccaaaatgctttcaactgaattgcacaatcagacattcctgatagatggcccggagaccgcagaatgccccaacgccaatcgtgcttggaacagtctcgaggtagaagactatgggtttcggaagtacaaaacaaagatctggcctactctgaaggagtggcgaaaagtcttctgtgattctaagttaatgagcgccgcaattaaagacaatagagcggtgcatgctgatatgggatattggatcgagtccgccctgaacgacacctggaagattgaaaaagcatcattcatcgaggttaagagctgccactggccaaagtctcacacgctttggggcaatggtgtgcaggaatccgagatggtcatacccaaaaactttgccgggcctgtgagtcagcataataacaggccaggatactacacacaaaccgctggcccctggcacttgggtaagctcgagatggatttcgacttttgtgaaggcactaccgttgtggtaacagaggattgcgggaatcgcggaccgagcctgcggactaccacagcctctggcaaactaattacggaatggtgctgtagatcctgcaccctgcctccactcaggtatcgcggggaggcaggatgttggtactggatggacatccgacccctgaaggaaaaagagaagaaccttgtctcaagtttggtgactgctggccatggtcagatcgataacttcagcctgcggattttagggatggccctctttctggagaagatgcttatgacacgtctgggaaccaaacacgcgatcttgctcgtggccgtctcgttcgttactctgattacaagaaatatgtcctttaaggacctaggcagggtgatggtaatggtgggtgctaccatgacggatgacatgcgcatgggcgtcacttatctggcactcctgcctgccttcaaagtgcggcccacctttgctacagggcttttgctgagaaagttaacctctaaagaactcatgatgactacaataggaatcgttctgttcagccagtcaagtattccagagaccatccttgaactgacagacgccctagcactcggcatgatggtgctgaagatggtcaggaacatggagaaataccaattggcggtgactattatggccatcctgtgcgttcctaatgctgtgatattacagaacgcctggcgagtctcctgtaccatcctcgcagtagtgtctgttagccccctgtttcttacgtcctcacgccagaaggctgattggattccactggccttgacaatcaaggggctcaatccgaccgcaattttcctgactaccctaagccggacaagtaaaaagagatcttggcctctgaacgaagccatcatggctgtgggaatggtctccatacttgcgagctcgctcctgaaaaatgacattcccatgactggcccattggtggccggtgggctgttaaccgtatgctatgtgctcacgggaaggtcagcagatctggagcttgagcgtgctgccgacgtcaagtgggatgaccaggccgaaatctctggcagttcccccatcctgagcattacaatatctgaggatggcagcatgtccatcaaaaacgaagaggaagaacagaccttgactattctcatccgcacagggctgctagttatttcaggactgtttcctgtgagtatcccaataaccgctgcagcctggtacctttgggaggtgaagaagcagcgggcgggtgtcctctgggacgtgcccagccctccgccagttggcaaagctgaactggaggatggggcctatagaatccagcagaagggaattttcggctactctcaaatcggtgcaggggtatacaaagaaggaactttccccacaatgtggcatgtgaccaggggcgccgtcttgatgcacaagggcaaacgaattgagccttcctgggctgacgtgaagaaggatttaatctcatatgggggaggttggaaactggagggcgaatggaaggagggggaagaggttcaggtgctcgcactggaaccaggcaaaaatccccgggccgtccagacgaagcctggcctttttaaaactaacaccggtacaataggggcggtgagtctggacttcagcccgggaacctccggctctcccattgtagataagaagggcaaagtcgtggggttgtacggaaatggtgttgtgacacgctcgggcgcttatgtcagcgccatcgcacagactgagaagtcaatcgaggactacccagaagtggagatggacatttttaggaagaaaaggctaaccatcatggatttccaccctggggccggacggcaaaaacgatattttcccgctatagttagagaagccattaaacgcggcctgaggacgctcatcctggcaccaacacgtgtggtcgctgccgagatggaagaggcgcttcggggtttacctattagataccagactcccgccatcagggcagagcataccgggcgcgaaatagtggacctgatgtgtcacgctacattcaccatgcgactcttgtccccaattagagtaccgaactataatctgatcatcatggatgaggcccattttactgaccctgctagtattgcagcccggggatacatctctaccagggtggaaatgggcgaggccgctggcattttcatgacagcgacgcccccagggagccgcgatccctttcctcagtccaacgcaccaataatggacgaagaacgtgagatccccgaaagatcatggaactctggacacgagtgggttactgatttcaagggtaaaattgtctggtttgtgcctagcctcaagaccggcaaatacatcgccgcttgcctgcggaagaatgggaaaagggtgatccaacttagtcgcaagacattcgactccgaatatgtcaaaacccgaactaacgattgggacttcgtagtgacaaccgatattagcgagatgggagccaattttaaggcagagagagttatagacccgcggaggtgtatgaagccagtgatcctgacggacggcgaagaacgcgtcattttggccggtcccatgcctgtgactcattcttcagctgcgcagagaagggggcggatcggacgtaaccccaaaaatgaaaacgatcagtacatttatatgggcgagccactagaaaatgacgaggattgcgcccactggaaggaggcaaaaatgctgctcgacaacatcaatacacctgaaggcataatcccctccatgttcgagccagaacgcgagaaggttgatgctattgacggggaataccgattaagaggagaggccaggaaaaccctgcttgagctgatccggggtggccctattccggtgtatctcgggtacaagtggcccggagaaggcatcaactatgcagatagtcgcttgtgttttgacggtataaagaataaccagattctggaggaaaatgtcgaggtggaaatctggaccaaagagggggagagaaaggaactcaaaccaaggtggctggatgcccggatttacagcgaccctcttgctctaaaggagttcaaagaatttgccgcgggccgaaagtcgctgactttgaacttaatcacagagatgggaagactgcccaccttcatgacacaaaaggcacgcggcgccctcgcttctctgatggtacttcacactgccgaggctgggggaagggcatacaatcatgccctgtccgaactcccagagacgttggaaaccctgctactgctcacacttctggctactgtgaccggtggcatatttttattcttgatgagcgggcggggaatcggcaaaatgacactgggtatgtgctgcattatcaccgcctcaattctcctgtggtatgcacagatccagcctcactggatagcggccagtattatccttgagtttttcctgactgttctcttgatccccgaaccggagaagcagcgtacgccacaagataaccagctgacctacgtcattatcgctatattaacagtggtggccgcaactatggctaatgagatggggtttctagagaaaaccaagaaagacctgggcctcggaaacattgccacacagcagtcttgtaagaagatccttgatatttatctgggccctgcattgccctggaaactgtacgccgggggaaccactttcatcacaccaatgctcagacattccatagagaacagctcagtcaatgttagtctgacggctatcgcgaaccaagccaccgtgcttatgggtctcggcaaggggtggcccctgagcaaaatggacattggagtacctttgctggcaatcggctgctattcccaggtgaatccgattactttaacagctgccctatttctgctcgtcgcccactacgcaatcattggtcccgggcttcaggctaagccaaccagggaagcccagaaacgcgcggctgccggcatcatgaagaaccctaccgtggacggaataacagttattgatctggaccccatcccttatgatccaaaattcgagaagcaattgggccaggtgatgctgctcgtcctgtgtgtaactcaggtgcttatgatgcggacgacctgggcattatgcgaagccctgacactcgctactgggcccgtttctaccttgtgggagggaaatcctggccgattctggaacacaaccatcgcagtgagcatggccaatatttttagaggttcctacctggcgggggctggactactgttctcaataatgaagaacactacgtctacaaggcgcggcaccggtaatatcggcgagactctcggggaaaaatggaagagtcggcttaacgccctgggaaaatcggagtttcaaatttacaagaaaagcggcatccaggaagtcgacagaaccttggcaaaggaggggattaagcgtggagaaacagatcaccatgccgtgtccaggggctctgctaaactgcggtggttcgacgagcgcaatctcgtcactccagagggtaaggtggttgatctggggtgtggacgaggcggttggtcatttttctgcggcgggcttaaaaacgtgagagaagtaaaggccctaaccatcggaggccccgggcacgaggaaccgatactgatgagcacatatggaaggaatctcgtgcggtcccagagtggcgtcgttgtgtttcatacgcctccagagaaatgtgacacctctctacgcgatatcggtgagagctcacccaaccctactgtcgaagcagggagaacactgagggtgttgaatctggtagagaactggctcaataacaacacccagttctgcattaaggtgcttaatccatacatgccctccgttatcgaaaagatggaggctctgcaacgaaaatatggaggcgccttggtgcggaacccgctgagtcgtaatagcactcacgaaatgtactgggtctctaacgcgtccggcaatattgtgtcaagcgtcaacatgatctcgagaatgctcataaatcgctttacaatgaggcataagaaagccacctatgagcctgacgtggatttagggtctggaacgcggaacattggtatcgagagtgaaacccccaatctggacatcattggcaagagaatagagaaaatcaagcaggaacacgagacatcctggcactacgatcaggaccatccatataagacttgggggagccacggatcatacgaaaccaaacagacaggctccgcatctagcatggttaacggtgtagtgcgccttctgactaagccttgggacgtcgtgcccatggttacccaaatggctatgacagataccactccattcgggcagcagagggtgtttaaagagaaggtcgacacgcgaacacaggagcccaaagaaggaaccaagaaactaatgaagattactgccgagtggctctggaaggaactgggcaaaaagaaaacccctcggatgtgtacaagagaggagttcatcaagaaagtgaggagtaatgcagctttgggcgccatttttacggatgagaacaagtggaagtccgcccgcgaggcggtagaagacgggcgtttctgggagctggtggataaagaacggaatctccatcttgagggaaagtgcgagacctgtgtttacaacatgatgggtaaaagagaaaagaaactgggcgagttcgggaaggctaagggaagcagggcaatctggtatatgtggttaggcgcccgctttctggagttcgaggctttgggttttctcaatgaagaccactggttctctcgagagaactcactgagtggggtcgagggagaaggcctacacaaacttggctacatactgcgggaggtgtccaagaaagaagggggagccatgtatgcagatgacactgccggttgggatacaagaatcaccctcgaggacctgaagaacgaagagaggaaaactaatcatatgggcggggagcaccgcaagttggctagaggaatttttaagatgaacctgacaaataaagtggtccgggttcaaaggccaaccccgggcggtacactcatggatatcattagccgtaagactcagcgagggtctgaacaggtgggaacctacggccttacgaccctgacaaacttagaggcgccccctatccgccaaatggaaggcaaaggggtattcaagggacatcagcacagaactgcctcggaggaaaatgcagtgcaggactggctggctcgggtcggtggcgagaggttgtcacgcctcgccattagcggggacgattgcgtggttaaaccactggacgatagatttgcacgggccctaaccgctcttaacgacatgggaaaggtgaggaaggatatacagcaatgggagccctcccgaggctggaatgactggacacaggtccctttctgcagtcatcactttcacgaactgatcatgaaagatggtcgtactctcgtggtaccatgtagaaaccaggacgagctgattgggcgcgcccggatctctcagggagcgggctggagcttgagggaaaccgcatgcttaggcaagttctatgcccaaagatggtccctgatgtactttcatcgccgggatctcaggcttgctcccaatgccatctgttcagcagttcgaacgcactgggtgcctacaagtagaaaaacctggccgattcatgcttctcacgactggatgactacagaggtcatgctgaccgtgtggaacaagctatggttccaggagaatccatggatggaagataaaactcccgtggggttttgggaggaaatacctttcctggagaagggaaaagaccagtggggtggcagcctcatcgggttgacctcccggcccccatgggccaagaacttccagcctgctattaatcaagtcaggtcactgctttgcaacgaagagagcgccgattttatgccctctatgaagcgcttccgtagagaggaagaggaagcaggagttctgtggtga

SEQ ID NO: 14407 - RNA, 9876 nt, synthetic construct
  misc_feature 1..9876: note = derived and/or modified CDS sequence (opt3) from DENV-2__JQ922549__SS-prME
  source 1..9876: mol_type = other RNA
accgcaggagtgataattatgctgatacccacagctatggcattccacctcactacgcggaatggggaacctcatatgatcgtcagcaggcaggaaaaggggaaatcccttctgttcaagaccgaagacggtgttaatatgtgcacattgatggccatggatttaggcgaactgtgtgaagacactattacctacaattgcccactgctccggcaaaatgaaccggaggatatcgactgttggtgcaactctacatcaacctgggtgacttatgggacatgtaccgcgcccggagatcaccgccgagagaaacgtagtgtagctctggtgcctcatgtcggcatgggtcttgaaacgagaactgagacctggatgagctccgaaggggcctggaagcacgcacagaggattgagacatggatcctgcggcatccaggattcactataatggccgctatcttggcatacaccattggcacaacctattttcagcgcgtgctcatcctgattctgctcacggccgttgctccctctatgactatgagatgcatcggcatatcgaatagggacttcgtggagggggtctcaggaggtagctgggtggatattgtattagaacacggcagttgtgttacaaccatggccaaaaacaagcctactctggactttgagcttatcaagacagaagcgaaacagccagcaaccttgacgaagtactgcattgaggccaaactgaccaatacaactaccgcttcccggtgtcccacacaaggggaaccttctctaaacgaggagcagcacaagcgcttcgtgtgcaaacatagcatggtcgatcgaggatggggcaatggttgtgggctctttggaaagggcggcatcgtgacttgcgccatgtttacctgcaagaaaaacatgaaggggaaaatcgtgcagccagaaaatctggagtatacaattgtcgttaccccgcactccggagaagagaacgcagtgggtaatgacactggcaagcatgggaaagaaataaaggtaagaccccagtcaagtatcacggaggctgagcttacaggatacggcaccgtgactatggaatgtagccctaggaccggttttgccttcaacgagatggtcctgttgcaaatggaaaataaagcgtggctcgtgcaccggcagtggtttctggatttaccactgccctggctccctggggccgacacacagggctctaactggattcagaaggagacccttgttactttcaagaacccacacgccaagaaacaagatgtggtcgtgctgggatcccaggaaggcgctatgcatacagccttgacgggggctaccgagatccagatgtcaagcggaaatctactgtttactggtcacctcaaatgccgtctgcgcatggacaaacttcaactgaaaggcatgagttattctatgtgtacagggaagttcaaggtagttaaagagatagccgaaacccagcatggaacaattgtgatcagagtccagtacgagggcgacggttccccctgcaagatcccgttcgaaattatggatttggagaaaaggctcgtgctggggcggttaatcactgtcaaccctattgtgaccgagaaggacagccccgttaatatagaagcagagccaccttttggcgattcgtacatcattatcggagtggaacccggccagctgaaaccatcttggttcaagaaggggtcctcaatccgacaaatgtttgagacgaccatgcgcggagccaaaagaatggctattctaggtgacacagcgtgggatttcggcagtctcgggggagtatttactagcataggcaaggcactgcaccaggtcttcggtgccatctatggggctgccttttccggcgtgtcttggaccatgaaaattcttatcggagttgtgattacatggatcggcactaacagcaggtcaaccagtttgtccgtcagcctggtgctcgtaggggtggttacgctgtaccttggagtcatggtgcaggcagactctggctgtgtggtctcatggaagaataaagaactgaagtgcggtagtgggatattcatcacagataacgttcatacctggactgagcagtataagtttcaacccgagagcccttccaaattggcctctgctattcagaaggcccacgaagagggaatctgtggcattcggtcggtgacacgcctcgaaaatctgatgtggaaacagatcaccccagagttaaaccacatactgagcgaaaatgaggtgaagctaactattatgaccggtgacatcaaaggcattatgcaggcagggaagagatccctcaggccgcaacccacagagctgaaatactcatggaagacgtggggaaaggcgaaaatgcttagtaccgaacctcataaccagactttcttgatcggcgggccagagacagctgaatgccccaataccaaccgtgcctggaactctctggaggtagaagattatggatttggcgtcttcacaactaacatatggctcaagctgaaagagcggcaggacgtgttttgtgatagcaagttaatgtccgcagccatcaaagacaatcgagctgttcacgccgacatgggttactggattgagtcagcactgaacgatacctggaagatcgaaaaggctagcttcattgaggtgaaatcttgccattggcctaagtcccacacgctttggagtaacggggtcttggaaagcgagatgatcatacccaagaatttcgccggacccgtgtctcagcacaactatagaccgggctaccatacacaaaccgcgggtccttggcacctcggcaagctggagatggactttcatttctgtgaagggactaccgttgtggtaacagaggattgcggaaataggggcccatccctacgcactaccacagcctcagggaaactgattacggaatggtgctgtcggagttgcaccctcccacctctgagatacaggggagaggacggctgttggtatggtatggaaatccgcccccttgagggggaggaaggagatttggtccacagcctggtgactgctggccatggtcagatcgacaacttttcgttaggcgtgctcgggatggcactgttccttgaggaaatgctgcgaacacgggtcggaaccaagcacgccgttttgctcgtggctgtatcctttatgactctgattacaggcaatatgtctttccgtgatctagggagagtgatggtcatggtgggagccgcaatgaccgacgatatcggcatgggtgttacgtacctggcgctcctggccgcttttaaggtgaggccaactttcgccgcagggcttttgctgcgcaaattaaccagcaaggagctcatgatgacaaccattggaatagtcctgctttcacagagtactatccctgaaacaattctggagctaaccgacgctctcgccctgggccggatgatcttgaaaattgtgagaaacatggagaagtatcaactggcagttacaatcatggccatattatgcgtgcccaatgctgtcatcctccagaacgcgtggaaagtatcctgtactattctggccgtggtttctgtgagcccacttctgttgacctcctcacagcagaaggcagattggatcccgctcgctctgacgattaagggcctaaatcctacagccatctttctgaccactcttagcaggaccaacaaaaagcgaagttggcccctcaatgaagccataatggctgtcgggatggtgtctattctggcatccagcttgctggagaacgacatcccaatgacaggacccttagtagccggtggcctcctgactgtgtgctacgtccttaccgggcgctcggcggatctggaattggagcgggctgccgacgttagatgggaagaccaagcagagatctcaggatctagtcctattctctccataacgatcagcgaggatggctctatgagcattaaatatgaagaggaagaaccaacactgaccatcctaattaggactggtctgcttgtgatctccggactcttccccgtgtcaatacctatcacagccgctgcatggtacctgtgggaggtcaagaaacagcgtgccggagtgttgtgggacgttccgagtccaccccctgtaggcaaggcggaattagaggatggcgcttatcgcattaaacagaaggggatcctgggaagctctcagattggtgcccgggtgtacaaggaaggcacctttcacactatgtggcatgtcacaagaggggcagtgctcatgcacaaaggaaagaggatcgagccatcctgggccgacgttcgaaaagatctgatatcatacggcggtgggtggaaacttgaaggagagtggaaagagggcgaagaggtgcaagtcctggctttggaacccggcaagaatcctcgggccgtgcagaccaagccggggctattcaaaacgaacactggaaccattggtacagtaagtctggactttagccccggcacctccgagtctccaatcgtcgataagaaagggaaggtggttggactctatggcaatggtgtggtcacacgctcggggacttacgtgagcgcaatcgctcagaccgaaaaatcaattgaggacaaccctgagatcgaagatgacatattcagaaagaagaggctgacgattatggatcttcatcccggagccggcaaaacaaagcggtatttaccagcgatcgttcgagaggccattaaaagaggcctgcgcactctcatcttggcacctaccagggtggtcgctgccgaaatggaggaagctctgcgtgggctccccatacggtaccagacaccagcaattagagccgagcacaccggaagggagatcgtggacctgatgtgtcatgccactttcaccatgcgccttctgtccccggtacgagtgcctaactataatttgatcattatggatgaagctcactttacagaccccgcgagtatcgcagccagaggttacatttctacgcgggttgagatgggcgaagctgccgggatattcatgactgcaaccccacccggaagcagggacccttttccacaatccaacgcccccatcatggatgaggagcgcgaaattcctgagcgttcatggaactctggccacgaatgggtcacagacttcaagggtaaaaccgtgtggtttgtgccgagcatcaaggctgggaacgatatcgcggcctgcctaagaaagaatggcaagaaggtcattcagctgagtcggaaaactttcgactccgagtatataaagacaaggaccaacgattgggactttgtagtgacgactgatatcagcgaaatgggcgcaaatttcaaagctgagcgcgttattgacccacgaagatgtatgaagcccgtgatcctcacagatggcgaggaacgggtcattttagccgggcctatgcccgtgacccattcttcagcagcccagaggcgcggaagaatcggtaggaacccaaagaatgagaacgaccaatacatatacatgggcgaacctctggagaatgatgaagactgcgctcactggaaagaggccaagatgcttctggacaacatcaatacccccgaggggattatcccatccatgtttgaacctgagcgggaaaaagttgatgcgattgacggagagtatcgtctccgcggcgaagcacgaaagactttcgtggatttgatgagaaggggtgacctgccggtctggctcgcctaccgggtggctgccgaggggatcaactatgctgatcgcagatggtgttttgacggcatcaaaaataaccagattctggaggaaaacgtagaggtggaaatctggacaaaggagggagagaggaagaaacttaaaccccggtggctagatgcacgaatttacagtgacccactggccttgaaagagttcaaggagttcgctgccggcagaaagagcttaaccctgaatctcatcacagaaatggggcgcctgcctacttttatgacgcagaaggcaaggaacgcgcttgataatctggccgttctccataccgctgaggccggaggtcgggcatataaccacgctttgtcggaactgcccgagacactagagactctgctccttctgaccttattggccacagtcaccggcgggatattcctgtttctcatgtctggaaaaggcatcggtaagatgactctggggatgtgctgcattatcacggcatccattcttctgtggtacgcccagatccaaccacactggatagctgcgagcattatcctcgagttctttttgatcgtgctgttaattcctgagcccgaaaagcagcgtaccccgcaggacaatcagctaacatatgtggtcatcgccatactgactgttgtggcagctaccatggccaacgagatgggcttcctcgagaaaacaaagaaagattttggacttggctcaattgccacccaacagccagagagtaatatcctggacattgatttgagacctgcatctgcttggactctgtacgccgtagcgacaacgttcatcacccccatgctcaggcattccatagagaacagcccagtgaatgtctcactgactgctatcgccaaccaggcaacagtgcttatggggctcggaaagggttggcccctgagtaaaatggacattggcgttcctccgttggccatcgggtgttacagccaggtgaatcccattaccctgaccgctgcattactactgctcgtcgcccactatgcgatcattggaccaggccttcaagtaaaggctacacgcgaagcccagaagcgggcagccgctggtatcatgaaaaaccctactgtggacgggataacggttattgatctggaccccatcccttacgatccaaagtttgagaaacagttgggccagatcatgctgcgagtgctctgcgtcacccaagtgctgatgatgagaacaacttgggccctttgtgaagcattaaccctggctacaggacccatttccaccctctgggagggcaatcctgggaggttgggaaacactacgatagccgtctctatggcgaatatcttccgcggcagctatctggccggtgcagggctactgttttccattatgaagaacacaaccaatactcggagaggaacctcaaacctcggcgaaacacttggtgagaaatggaagaaccgtctaaattctttgggcaagagtgagttccagatctacaaaaagtcggggattcaggaagtggacaggactctggctaaagagggaatcaagaaaggcgaaaccgatcatcacgccgttagccgggggtccgcaaagctccgctggtttgtggagcgaaacctggtaacaccagagggaaaagtggtcgacttaggctgcggtagagggggatggtcttattactgtggcggtcttaagaatgttagggaagtgaagggcctgacgaaagggggacccggccatgaggaaccgatacctatgtcaacctatgggtggaacctcgtccggctacaaagcggagaggatgtgttcttcactccacccgaaaagtgcgacacactgttgtgtgatatcggcgagtccagtcctaatccaaccgtagaggctggtcgcactctgagagtgctcaacatggttgaaaattggcttaacaataacacacagttttgcattaaagtgctgaatccctacatgccgtctgtcatcgagaagatggaagccttgcagaggaaatacgggggagccctggtgcgaaaccctctcagcagaaattcaacccacgagatgtattgggtctccaacgcgagtggcaatattgtgagctctgttaacatgatctcccgtatgttaataaacagattcacgatgcgccacaagaaggctacctacgaacccgacgtagatctgggctcagggacaaggaatattggaatcgagagcgagactccaaaccttgacatcattggtaaacggatagaaaagatcaaacaggagcatgaaacctcgtggcactatgatcaagaccatccttacaagacatgggcatatcacggctcttacgagactaaacagaccgggagtgcctccagcctggtgaatggagtcgtgagactactcacaaagccctgggacgttattccaatggtgacccagatggctatgactgatacgacaccctttggccagcaacgcgtcttcaaggaaaaagtggacaccaggactcaggagcctaaggagggtaccaaaaagctgatgaaaatcacagccgaatggttgtggaaggagctggggaagaaaaagacgccacgaatgtgtacccgggaagagttttcaagaaaagtaaggtccaacgcagccctcggagctattttcactgatgagaataagtggaaatctgcgcgcgaagccgtggaggacggccgtttttgggaacttgttgataaggagcggatcctgcacttagaaggcaaatgcgagacatgtgtctataacatgatggggaagagagagaagaaaataggagagttcggtaaggcaaaaggcagcagggctatctggtacatgtggctgggggcccgctttttggagttcgaagcactcggatttctgaatgaggaccattggttcagtcgagaaaactccctaagcggcgtggagggtgaggggcttcacaagctgggatacattctccgggaagtgtctaaaaaggagggcggcgccatgtatgctgatgacaccgccgggtgggatactagaatcacactggaagacttgaagaatgaggaaatggtcaccaaccatatggagggagagcacaaaaagctggcggaagcaatttttaaactcacataccagaataaggttgtgagggtacagcgcccgactcccagaggtaccgtgatggatatcatttcacggagggaccaacgtggcagtgggcaggtcggaacgtatggccttaacaccttcacaaatatgggtgcccagctgatacgacaaatggagggggaaggagtgttcaaaggcatccagcatttaactgctaccgaggagattgccgttcaggactggctggcacgcgtgggcagagaacggttgtccaggatggctatcagcggggatgactgcgtcgtgaagcctctcgatgaccgctttgcctctgctctgacagccctaaacgatatgggaaaggtaagaaaagacatccagcaatgggagccatcgcggggttggaatgattggactcaggttcccttctgctcacaccactttcatgaacttattatgaaggacggcagggtgctggtcgtgccttgtcgaaaccaggatgagctcatagggcgtgcaagaatcagccagggagcgggctggtccctgcgcgaaaccgcctgcttgggtaaaagttacgctcaaatgtggtctttaatgtatttccaccggagggacctgagactcgccgcaaacgctatttgtagcgccgtgccatcccattgggtccccacgtcacgcacaacccggagtatccacgcaaggcaggagtggatgactacagaggttatgcttaccgtgtggaatcgagtatggattcaggaaaacccttggatggaggataagactccggtggaatcttgggaggaaatcccatacctggggaaaagagaggaccagtggtgcggaagcctaataggcctgacctcccgggccacatgggcgaagaatatccaaacggctattaaccaggtcaggtcactcatcggcagcgaggaatataccgattacatgccctctatgaagcgctttcgtagagaggaagaggaagccggggtgttgtggtga

SEQ ID NO: 14408 - RNA, 9876 nt, synthetic construct
  misc_feature 1..9876: note = derived and/or modified CDS sequence (opt3) from DENV-2__JQ922552__SS-prME
  source 1..9876: mol_type = other RNA
accgccggcatgatcattatgctgatacccaccgtgatggctttccacctcactacgaggaatggggaacctccaatgatcgtcagcaggcaggaaaagggaaaatcccttctgtttaagaccgaagacggtgttaatatgtgcgcattgatggccatggatttaggcgaacggtgtgaggacacaattacttacaactgcccgctgctaaatcagaacgaacccgaggatatcgactgttggtgcaattctacctcaacatgggtgacctatgggacttgtacaaccacgggagagctccgccgagagaagattagtgtagcgctggtgcctcatgtcggcatgggtcttgagactcgtaccgaaacatggatgagctccgagggggcttggaagcacgcccagagaatcgagatatggatcctgaggcatccaggattcactattatggcagccatcttggcttacaccattggcacatctcactttcagcgggtgctcatcttcatactgctgaccgcaattgccccctcgatgacgatgcgctgcatcggcatttcaaacagagattttgttgaaggggtgagcggaggtagttgggtcgacatcgtgctcgagcatggctcctgtgtaactacaatggctaaaaataagcctaccttagatttcgaactgatcaagactgaggccaaacagccagcgacacttaggaagtattgcattgaagcaaaattgaccaacacgaccacagactctcggtgtcccactcaaggggagcctaccctgaatgaggaacaggataagcgctttgtttgcaaacacagcatggtggaccgaggatggggcaacggttgtgggctattcggaaagggcggcatagtcacatgcgccatgtttacttgcaagaaaatcatgaaggggaaaattgtgcagccagagaatctcgaatacaccgtggtcatcacaccgcactccggagaggaacatgctgttggtaacgataccggcaagcacgggaaagaggtgaagataactccccagtcaagtattacggaggccgaactgacaggatatggcaccgtaactatggagtgtagccctagaaccggtcttgacttcaatgaaatggtgctgttgcaaatggaggataaagcatggctcgtccataggcagtggtttctggacttaccactgccctggctccctggggctgacacacagggctctaactggatccagaaggaaacccttgtgactttcaagaatccacacgccaaaaagcaagatgttgtggtcctgggatcccaggagggcgcgatgcacacagccttgacgggggcaaccgagatccagatgtcaagcggaaacctactgtttactggtcatctcaaatgccggctgcgtatggacaaacttcaactgaaaggcatgagttactctatgtgtacagggaagttcaaggtggtaaaagaaattgctgagacccagcacggaacaatcgttattcgcgtgcagtatgaaggcgatggttccccctgcaagataccgttcgagatcatggacttggagaaaagacatgtcctcgggaggctgattactgtgaaccctatcgtcaccgaaaaggatagccccgtgaatatcgaggccgaaccaccttttggcgactcgtacattataatcggagttgagcccggccagttaaaactgaactggttcaagaaggggtcttccattggacaaatgctagaaacgaccatgcggggtgctaaacgaatggccatcctcggcgatacagcatgggactttgggtcactgggaggcgtgttcacaagtattggtaaggcccttcaccaggtatttggggctatctacggcgcggcattcagcggagtctcctggaccatgaaaatattgacaggcgtgatcattacttggatcgggatgaactctcgcagcacctcactgagtgtttccctcgtgctggtcggaattgtgacgctttatctgggcgtaatggtgcaggccgatagcggttgtgttgtctcttggaagaacaaagagttgaagtgcgggtcaggaatctttgtgacagacaatgtgcatacctggactgagcagtacatgttccaaccagaaagtcccagcaagctcgcttccgccatacagaaagcacacgaggaaggcatttgtggtatcagatctgtcacaaggctggagaacttaatgtggaagcagattacccctgaactgaatcacatcctatcggagaacgaggttaaactcactataatgaccggcgatatcaaggggattatgcaagtgggaaaacggagcctgcgcccacaaccgacagaacttagatattcctggaagacgtggggccagcccaaaatgttgtcacctgagctgcatcaccagacctttctcatcgacgggccagaaactgccgagtgccccaatacaaacaggacctgggacagtctggaagtggaggattacggattcggcgtatttacaactaagatttggttacgtctgcgggagaagcaggacgtcttctgtgattctaaacttatgagcgctgccatcaaggacaatcgagcagtgcatgcggatatgggttattggatagaatccgctttgaacgacacctggaaaattgagaaggcctcatttatcgaagttaaaagctgccactggcctaagtctcacacgctctggtccatgggggtgctggagagtgagatggtcatcccaaagaatttcgcaggacccgtgagccaacataaccacagaccgggcattcctacacagaccgccggtccatggcatctaggcaaactggaaatggatttcgacttttgtgaggggactaccgttgtggtaacagaagattgcggaaataggggcccctctctccgcacttccaccgcttcagggaagctgatcacagagtggtgctgtcggagttgcacgcttcctcccttgagatacaggggagaagacggctgttggtatggtatggagattcgcccactgaaagagaaggaagagaacttagtcagctcgctcgtgaccgccgggcacggacagatagataacttctccctgggcatccttggtatggcactgtttttggaagagatgctccgaactcgggtgggcacaaaacatgctattctgctagtcgccgtttctttcgtgaccctgatcactgggaatatgagcggacgtgacctcggcagagtaatggtgatggtcggggcgacaatgaccgatgacattggaatgggcgtgacgtacctggcccttttggctgcatttaaggttaggcctactttcgccgctggtctgttactccgcaagctgacctcaaaagaacttatgatgacaaccatcgggatagtgctgctaagtcaatcctctatccccgagactattctcgagctgacagacgccttggcactgggaatgatggtcttaaagatggtgcggaacatggaaaaataccagctcgcggttaccatcatggccattctgtgcgtgccaaatgctgtcatccttcagaacgcctggaaggtaagctgtacaatactggcattggtgtccgtttcaccgctctttctgactagcagtcagcaaaaagctgattggattcctctagccctgaccatcaagggccttaatcccacggcaatcttcctcacaaccctgtctagaacttccaagaaaaggagctggccattgaacgaggccattatggctgtgggcatggtctcgatactggcgtcatctttactcaagaatgacatccccatgaccgggcctctggtggccggaggtcttctgacagtatgctatgtgttgactggccgaagtgcagatctcgaactggagcgcgctgccgacgtcaaatgggatgaccaggccgaaatttccgggagctctccaatcctaagcattaccatctccgaggatggatcaatgagtataaagaacgaggaagaggaacagacgctgacaatccttattcggaccgagctcctggttatcagcggcttgtttcccatttctatccctataactgctgcagcctggtacttatgggaggtgaaaaagcagagagcgggtgtgctgtgggacgtcccgtccccaccccctgtggggaaagctgaactcgaggatggagcctataggattaagcaaaagggcatcctgggctactcacagatcggggcaggagtttataaagaaggtacattccacaccatgtggcacgtaactcgtggcgccgtgcttatgcataaggggaaacgcattgagccaagttgggctgacgtcaagaaagatctgatcagctacggaggcggttggaagttggaaggggagtggaaggagggagaagaggtgcaggttctagcactggaacccggcaaaaatcctcgggccgtgcagacaaagccgggcctctttaaaaccaacacggggactataggagcggtctccctggacttctctcccggtacctcgggcagcccaattgtggataagaaagggaaggtagtcggactttatggcaatggtgtggttacaagatcaggggcttacgtgtccgccatcgcacaaaccgagaagagtattgaagacaaccctgagatcgaggacgatatatttaggcggaaaaagttaacaattatggacctgcaccccggagccggcaaaactaagcggtacctcccagctatcgtccgcgaagccatcaaaagaggcttgaggaccctgattctcgcacctacgcgggtggttgctgccgagatggaagaggcgctgcgagggcttcccatcagatatcagacaccagccattcgcgcagaacatactggaagggagatagtggatctgatgtgtcacgctaccttcacaatgcgtttgctatctccgatccgggtccctaattacaacctgattatcatggacgaggcccatttcaccgatcccgctagcatcgcagccagaggttatatttccactagggtggaaatgggcgaggccgctgggatatttatgaccgcgacaccacccggatcacgcgaccctttcccacagtctaatgcacccatcatggatgaagaacgagagattcctgaaagaagctggaacagtggccacgagtgggtaacggactttaagggtaagactgtgtggttcgttccgtccatcaaaaccgggaacgatattgccgcttgcctccggaagaatggaaaaagggtcatccaattaagccgcaagacatttgactctgaatacgtgaaaacccgtactaacgattgggacttcgtggtcacaaccgacatatcagagatgggcgccaattttaaggcagaaagagtaatcgatccacggaggtgtatgaagcccgtgattctgacggacggcgaggagcgcgttatccttgccgggcctatgcccgtgactcactccagtgctgcgcagcgaagaggacggattggtaggaaccccaaaaatgaaaacgatcagtatatctacatgggcgagcctctggaaaatgacgaggattgcgcccattggaaggaagcaaaaatgctcttggacaacataaatacacccgaggggattatcccaagcatgttcgagcctgaacgcgagaaggtcgatgctattgacggagaatatagactgaggggcgaggcccggaaaacctttgtggatctcatgcgtcgcggtgacctgccggtttggcttgcataccgagggcccgccgaaggcatcaactacgctgatagaaggtggtgtttcgacggaataaagaactcgcagtttctagaggagaatgtggaagtcgagatctggccatctggcggggaacggaaagagctgaagcctcgctggttggatgccagaatttattccgaccccttagcgctgaaggagttcaaagagttcgcagccggaagaaagagcctcaccctgaatcttatcactgagatgggtcggctgccaacatttatgacccaaaaagctcgaaacgccctcgacaatttggctgtgctgcacacagcagaagccggcgggagagcttacaaccatgccctatcagagctgcctgaaactctcgagacgcttctgttattgaccctgctcgcaacagtaactggaggcattttcctgtttcttatgagtggtcgcgggatcggcaagatgaccctgggaatgtgctgcataattacagcgtctatcctcttgtggtatgcccagatccagccccactggattgctgcctccatcatactggagttctttttaattgtgctactgatcccggaaccagagaaacagaggacccctcaagataaccagctcacttacgttattatcgcaatacttacggtcgtggctgccaccatggcaaatgaaatgggcttcctggagaagacaaagaaagacttggggctgggaaacatcgtgactcagcagcccgaaagcaatattctcgatatcgacctgcggccagcctcagcttggaccctttatgcggccgcaacaacctttattactcccatgctccgtcacagtatcgagaacagctccgtcaatatgtctctgacagctattgccaaccaagccacggttttgatgggtctgggcaaggggtggcctttaagcaaaatggatatcggagtgccgctactggcaataggctgttactcccaggtaaatcccattaccctcactgctgcccttttcctgttggtggcgcattatgctatcaagggtccagggctgcaggccaaagcaacaagagaggcccagaagagggctgcagccggcatcatgaagaaccctaccgtcgacggaattaccgtgatagatctcgaccccatcccttacgatccaaaatttgaaaagcaactgggccaggttatgcttttagtgctgtgcgtcacacaggtactcatgatgcgcactacgtgggcgttgtgtgaggctctgaccctagccacagggcccgtgtcaactctgtgggaaggaaatcctggccggttctggaacaccacaattgcagtttctatggccaatatctttcgaggtagttacctcgctgggtcgagccaagtgtggccatccattaacaatcttaaaggaggcagaaggggtaccggcgcccagggggagactctgggagaaaagtggaaacgccagttgaaccagctgtctaagtcagagttcaatacgtataagcggagcggcatcatggaggtcgacagatccgaagcaaaagaggggctcaagcgtggagaaacaaccaaacacgctgtgagtaggggcactgccaagctgcggtggtttgtcgagcgcaacttagtgaaacccgagggtaaggttatagatcttgggtgcggacgaggcggttggtcttactattgtgcgggcctgaaaaaggtgaccgaagtaaaggggtacacaaaaggaggcccggggcatgaggaacctatcccaatggccacttatggatggaatctcgtgaagctacacagcggcaaagacgtcttcttcacaccacctgagaagtgcgatacactgttgtgtgacattggtgaatcatccccaaaccccacggttgaggcagggagaaccctgagggtgctcaaccttgtcgagaattggctgaacaataacactcaattttgcatcaaagtgttgaatccgtacatgcctagtgtaattgaaaagatggagacactgcagcggaagtatggaggcgctctcgtgcgcaaccccttaagcagaaattctacccatgaaatgtactgggtttccaacgcctcaggcaatatcgtgagctcggtcaacatgatatctaggatgctgattaatcgattcactatgcggcacaaaaaggcaacatacgagccagacgtggatcttgggagtggaacccgtaacatcggtatcgaatccgagacgcctaatctggacattataggcaaaagaatcgagaagattaaacaggaacacgagaccagctggcattatgatcaggaccacccctacaagacatgggcttatcatgggtcatacgaaactaagcaaaccggatccgcctctagcatggtcaacggcgtggttcgcctactcacaaaaccatgggatgtagtgcccatggtcactcagatggccatgaccgacacaaccccttttggtcagcagagggtgttcaaggagaaagttgatactcggacgcaagaaccaaaggaggggactaaaaagctgatgaagatcaccgcggagtggttgtggaaagaactgggaaagaaaaagactccgagaatgtgtccccgcgaggaatttaccaaaaaggtgaggagtaatgctgcactcggcgccattttcacagacgctacgaaatggaagtccgcccgagaggcagtcgaggatggccggttttgggaacttgtggacaaggagagaaacctgcacttagaagggaaatgcgagacctgtgtatataacatgatgggaaagagggagaaaaagctgggtgagttcggcaaagccaaggggagccgcgctatctggtacatgtggttgggagcgcgttttctcgagttcgaagccctgggctttctaaatgaggatcactggttctctcgggaaaactcacttagtggtgtggagggggaaggactgcataagctcggctatatactgagagaggttaggaaaaaggagggcggggcaatgtacgctgacgactccgccggatgggatactcgcatcacattggaagacctgaaaaatgaggaacgaattaccaaccacatggaggtcgaacataagaaactcgcagtgggtcactttatccttacttaccctaataaggtggtccgggttcagagaccaacacccgtgggcaccgtaatggatattatcagcaggaagtctcagcgcgggtcgggacaagtgggcacatatggtctgaacactttcaccaatttagaggggcctcgaattagacagatggagggagaagagtcattcaaaagccatcagctgcagacggccaccgaaaggaacgctgtccaagactggttggcccgtgtgggccgagagcgcctctccagaatggcgataagtggcgatgactgcgttgtgaagccactggatgaccggtttgcaagggccctaacagctcttaatgatatggggaaagtccgcaaggacatccagcagtgggagccctctagaggatggaacgattggactcaggtgcctttctgcagccaccactttcatgaactgattatgaaagacggtcggaccctcgtagttccgtgtaggaatcaagatgagctgatcggccgagcccgtatctcccagggggcaggatggtcattgagagaaacagcttgcttaggcaagagttacgcccagatgtggtctctgatgtatttccaccgccgggacctcaggcttgctgccaacgcaatttgtagcgcggtgccatcccattgggtccccacttcaagaaccacgtggagcatacacgcctctcacgagtgggtggctacagaagacatgctgaccgtgtggaatcgcgtctggatccaggagaacccttggatggaggataagactcccgttgaatcctgggaggaaattccatacctaggtaaacgggaggaccaatggtgcgggagtctgatcggactcacaagcagggccacctgggcaaagaatattcagactgctatcaaccaggtgcgatcgttgataggcaacgaagagtataccgattacatgccttccatgaaaagatttcggagggaggaagaggaagccggcgtactgtggtga

SEQ ID NO: 14409 - RNA, 9876 nt, synthetic construct
  misc_feature 1..9876: note = derived and/or modified CDS sequence (opt3) from DENV-2__GU131896__SS-prME
  source 1..9876: mol_type = other RNA
agcgccggaatgatcattatgctgatacccaccgtgatggctttccacctcacaactagaaacggggagcctcatatgatcgtcggtattcaagaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggctctcattttcatcctgctgactgcagtggccccatctatgacaatgcgctgcatagggatttcgaacagagattttgttgaaggagtgtcaggtggcagctgggtcgacatcgtgctcgagcacgggagttgtgttaccactatggctaagaataagcccacattagatttcgaactgattaaaaccgaggccaagcagcctgcgacgcttaggaaatattgcatcgaagcaaagttgaccaacacaactaccgagtcccggtgtccaacacaaggagagccctctctgaaagaagaacaggacaagcgctttgtttgcaagcatagcatggtggatcgaggctggggtaatgggtgtggactattcggcaaaggcgggatcgtcacttgcgccatgtttacctgcaagaaaaacatggaaggaaagattgtgcagcctgagaatctcgaatacacaatagtggtcaccccacactccggtgaggagcatgctgttggcaacgacactgggaaacacggaaaggaaatcaaagtgacgccgcagtcaagtattacagaggccgaactgaccggctatggtactgtaaccatggagtgtagccccagaacagggcttgatttcaatgaaatggtgctgttgcaaatggagaacaaggcatggctcgtccacaggcagtggtttctggacttacctctgccatggctccccggcgctgataagcagggatctaattggatccagaaagagacccttgtgactttcaagaaccctcatgccaaaaagcaagacgttgtggtcctgggctcccaggaaggggcgatgcacacagccttgacgggagcaaccgagatacagatgtcaagcggtaatctactgtttactggccatctcaaatgccggctgcgtatggacaaacttcaactgaaggggatgagttactctatgtgtacaggaaaattcaaggtggtaaaagaaattgctgagacccagcacggcacaatcgttatccgcttgcagtatgagggtgatgggtccccatgcaagattcccttcgaaatcatggacctcgagaaaagatacgtgctgggcaggttaattactgtcaacccgatagtgaccgaaaaggatagccctgtcaacatcgaggccgaacccccatttggagactcgtacattatcatcggcgtggagcctgggcagctgaagctaaattggttcaaaaagggatcttccattggtcaaatgtttgagacgaccatgcggggcgctaaacgaatggccatactcggggatacagcatgggacttcggatcactgggcggtgtttttacaagtgtggggaaggcccttcatcagatcttcggcgctatttatggagcggcatttagcggcgtatcctggaccatgaaaatcttgattggggtcatcataacatggatcggaatgaactctcgcagcacttcactgagtgtgtccctcgttctggtgggcattgtcaccctttacctgggtgtgatggtacaggccgatagcgggtgtgtggtttcttggaagaataaggaattgaaatgcggatcaggcatcttcattacggacaacgtccacacatggaccgagcagtataagtttcaacccgaaagtccaagcaaactcgcttccgccatccagaaggcacaggaggaaggtatatgtggcattagatctgtgactaggctggagaatttaatgtggaaacagatcacacccgagctgaaccacattctagccgaaaatgaggtgaagctcaccatcatgactggggatataaaaggaatcatgcaagctggcaagcggtcgctgcgccctcagccaaccgaacttaagtacagctggaaaacatgggggaaggccaaaatgttgtccacggagtcacataaccagaccttcctgattgacggaccggaaactgcagagtgccccaatacaaacagagcgtggaatagtctcgaggtcgaagattatggctttggtgttttcaccacaaacatctggctgaagttaaaagagaagcaggacgctttttgtgactctaagctgatgagcgccgcaattaaagataatagggccgtgcacgctgacatggggtactggatcgaatccgcccttaacgatacttggaagatagagaaagcatcattcattgaggtgaagaattgccattggcctaaaagccacaccttgtggtctaacggagtactcgaatccgagatgatcatcccaaagaacctggctggccccgtcagtcaacacaattatcgtcctggttaccatacgcagacagccggcccatggcacctagggaagctggaaatggacttcgatttttgtgacggaaccactgtgattgttaccgaggattgcggcaaccgggggcccagcctccgaacaactaccgcgtctggaaaactgatcacagaatggtgctgtagatcctgcacgcttccgcctttgaggtaccgcggcgaggacggttgttggtatgggatggagattcggccactgaaggaaaaagaggaaaatttagtgaactcactcgtcaccgccggacatggccaggtggataatttcagtctgggtgttcttggcatggctctgtttttggaggaaatgctcagaactagggtggggacaaagcacgcaatactgctagtagccgtcagcttcgtgaccctgatcactggaaacatgtcgtttaaagacctcggccgcgtggtcgttatggtgggggctacaatgaccgatgacattggaatgggcgtaacgtacctggcccttttggcagcgttcaaggtgcgacccacttttgccgctggtctgttactccggaagctgacctccaaagagcttatgatgacaaccatcgggattgtcctgctatctcaaagcactatccctgagacaatactcgaactgaccgatgccttggcactgggaatgatggtgttaaagatcgttcgtgacatggagaaatatcagctcgctgtgacaattatggccatcctgtgcgtccccaatgcagtgattcttcagaacgcctggaaggtttcatgtactatcctggctgtggtcagtgtatccccattgctcctgacctctagccagcagaagacggactggatacctctagcgctgacaattaagggccttaatcccaccgccatcttcctcactaccctgtccagaacaaacaaaaagaggtcatggccattgaatgaagcaatcatggctgtgggcatggttagcattctggccagttctttactcaagaacgatataccgatgactgggcctctggtggccggaggtcttctgaccgtctgctacgtgttgacgggccgctccgctgacctcgagctggaacgggcaacagatgtaaaatgggaggaccaggccgagatcagcgggtcgtcacccattctatctatcaccattagtgaagatggatccatgagcatcaagaatgaggaagaggagcagactctgacaatacttatcagaaccggcctcctggtgatttctggtttgtttccagtcagcatccccattactgcggctgcctggtatttatgggaagttaaaaagcagagggcaggggtgctgtgggacgtgccttccccaccccctatgggaaaagccgagctcgaagatggcgcttaccgaatcaagcaaaagggcatactggggtattcacagattggagcaggagtctacaaagagggcacattccataccatgtggcacgtgacgcgcggggccgttcttatgcacaagggaaaacggatcgaaccgagttgggcggacgtaaagaaagatctgatcagctacggcggtgggtggaagttggagggagagtggaaggaaggcgaggaagtgcaggtcctagctctggagccaggcaaaaaccccagagccgtgcagactaagcctgggctctttaaaaccaatacaggaaccattggtgcagtttctctggacttctccccaggcacatcagggagtcccatcatagataagaaaggaaaggtggtcggcctttatggtaacggggtggtaactaggagcggagcctacgtctccgctattgcccaaaccgaaaagtctatcgaggacaaccctgagattgaagatgacatctttcgtaaacgccggttaacgataatggacctgcatccgggcgcaggcaagacaaaaagatatctccccgctattgtgagggaggccatcaagcgagggttgcggactctgatcctcgcgccaacccgcgttgtggccgcagaaatggaggaagctctgagaggacttcctattaggtaccagacacccgccatccgggctgagcacaccggtcgagagattgtcgatctgatgtgtcatgcaactttcaccatgagattgctatcgccagtgcgcgttcctaattataacctgataatcatggacgaagcccacttcacagatcccgccagcattgctgcgaggggctacatctcaacgcgtgtggagatgggggaagcagccggaatctttatgactgctaccccaccgggctcccgggaccctttcccccagagtaatgccccaattatagatgaggagagagaaatccccgagaggtcttggaacagcggtcatgaatgggtcacagactttaaagggaagaccgtgtggttcgtaccttccattaaggcaggaaatgatatcgccgcttgcctccgcaaaaacggcaagaaagtgattcaattatcacgaaagacttttgactctgagtatgttaaaacaagaaccaatgattgggacttcgtcgtgacgactgatatcagcgaaatgggcgcgaactttaaggccgaccgggtgatagacccaaggcgctgtatgaaacccgtcatcctgacagatggggaggagcgtgtaattcttgcaggacctatgccggtgacccacagttccgctgcccagagacggggtaggatcggccgcaatccaaagaacgaaaatgaccagtacatttacatgggggagcccctggaaaacgatgaggactgcgcacactggaaggaagccaaaatgctcttggataatatcaacacccctgagggaataattcccagcatgttcgagccagaacgagagaaggttgacgctatcgatggcgaatatagactgcggggtgaggccaggaaaacttttgtggacctcatgcgcagaggggatctgcctgtctggcttgcgtacaaggtggcagccgaaggcattaattatgctgacaggcggtggtgtttcgatggaatcaaaaacaaccagatactagaggagaatgttgaagtggagatctggacaaaggaaggcgagcgtaagaaactgaagccccgctggttggacgcccgaatttactctgatccattagctctgaaagagtttaaggagttcgcagccgggagaaaatcactcaccctgaaccttatcacagagatgggaaggctgcctactttcatgacgcaaaagacccgggacgctctcgacaatttggccgtcctgcatacagcagaagcgggtggccgcgcctataaccacgctctatccgagctgccggaaactctcgagacccttctgttattgacactgctcgccaccgtgactgggggaatttttctgttccttatgagtggcagaggtatcgggaagatgacgctgggcatgtgctgcataattaccgcaagcatcctcttgtggtacgctcagatccagccccattggattgccgcatcgatcatactggagtttttcttaattgtactactgatcccagaacctgagaaacagaggacaccccaagataatcagctcacttatgtggttattgccatccttaccgtcgtggctgcgacaatggccaacgaaatgggatttctggagaagaccaaaaaggacttgggcctggggtctatagcaactcagcagccagaatccaatatcctcgatattgacctgcggcctgctagcgcctggacactttacgccgtggcaacgaccttcgtcactcccatgctccgacactcaatcgagaacagttctgttaatgtgtccctgacagctattgccaaccaagcgaccgtattgatgggactgggtaaaggctggccgttaagcaagatggatatcggggtgccactactggctattggatgttactcacaggtcaatcctatcaccctcacagccgcacttctgttgctggtggcccactatgctataattggccccggtctccaggcaaaggccactagagaggcgcagaaacgcgctgccgcagggatcatgaagaacccaacggttgacggcatcaccgtgattgatctggaccccataccttacgatccgaaatttgaaaagcaacttggacaggtcatgttactgatcctctgcgtaacacaggtgttgatgatgaggactacctgggccctgtgtgaggctctaacactggccaccggccccattagtactctctgggaagggaatccaggacggttctggaacacgacaatcgcagttagcatggctaatatttttcgtggctcctatcttgccggtgcggggctgttgttctctatcatgaaaaacaccactaataccagaaggggaacaggcaacataggtgagactctgggcgaaaagtggaaaagccgcctcaacgccctggggaagtccgagtttcaaacctacaagaaatcaggaatccaggaggtggaccggacattagcaaaggaaggcattaaacgaggggagacggatcatcacgctgtctctagaggaagtgccaaacttaggtggttcgtggaacgcaatatggtcacccctgagggcaaagtggttgacctgggttgcgggcggggaggctggtcgtattactgtggtggcctcaagaacgtgagagaggtaaaggggctaactaaaggaggccccgggcatgaagaacctatcccaatgagcacatatggatggaatctggtgcgtttgcagtccggcgtcgatgtatttttcattccccctgaaaagtgcgacaccctgctctgtgacatcggtgagtcttcaccaaaccccactgtggaagcagggaggacacttcgggtcctgaatttggtggagaactggctgaataacaatacccagttctgcataaaagtactcaacccgtacatgcctagcgtgattgagaagatggaggctttacaacgcaaatacggaggcgccctggttcgaaatccactttccagaaacagtacgcacgagatgtattgggtgtctaatgccagcggcaacatcgtctcatccgtgaatatgatcagtaggatgctgattaaccggtttaccatgcgccataagaaggcgacatacgaacccgatgtcgacctagggagcggaactagaaacataggtatcgagtctgaaattcctaatctcgatatcattggcaaaaggatcgagaagataaaacaggagcacgaaacctcctggcactatgaccaggatcatccatacaagacatgggcttatcacgggtcatacgagactaaacagaccggaagcgcatcgtctatggtgaacggcgttgtacgactgttgacaaagccctgggacgtgctgccgaccgtcactcaaatggccatgacggatacaacccctttcggtcagcagcgggtgtttaaggaaaaagttgacactcgtacccaggagcccaaggaagggactaagaagctcatgaaaatcacggctgagtggctttggaaggagctgggcaaaaagaagaccccaagaatgtgtactcgcgaagagttcacaaggaaagtgcggagtaatgccgcattaggcgccatttttaccgatgaaaacaagtggaaatccgctagagaggcggtcgaggacagccgcttctgggaactggtggataaggagaggaatttgcatctcgaaggcaaatgcgagacttgtgtatataacatgatggggaagcgagaaaagaaactgggagagtttggtaaggccaaaggctcacgggcaatctggtacatgtggctaggggctagattccttgagtttgaagccctgggattcctcaatgaggaccactggttttccagggaaaactctctgagcggcgtggagggtgaagggttgcacaagctgggatacattctccgcgacgttagtaaaaaggagggcggcgcaatgtatgccgatgacacagctgggtgggatacccgtatcacacttgaggacctgaagaatgaagagatggtcactaaccatatggaaggagagcacaaaaagttagccgaagcgattttcaaactgacctaccaaaataaggtggtgcgggtccagagacctacgcccaggggtaccgttatggatataatctcccgccgagaccagcggggcagcgggcaagtgggaacatatggcttgaacacttttaccaatatggaggcacagctcattagacagatggagggtgaaggggtattcaaaaacatccagcatctgacagccactgaggaagtggctgtccaaaattggctagccagggtgggacgcgagagactttctcggatggcaatctcaggcgatgactgcgttgtgaagccactggatgacaggttcgctaacgccctcaccgctctgaacgatatgggcaagattcgtaaagacatacagcagtgggagcccagtaaggggtggaatgattggacgcaggtccctttttgctcccaccatttccacgaattgatcatgaaagacggacgagtgttagtagttccatgtcgcaaccaagacgagctgattggtagagcccggatcagccagggcgcagggtggtctctcagggaaacagcgtgccttggaaagtcgtacgcccagatgtggtcactgatgtattttcaccgcagagatctacggctggctgccaatgcaatttgtagcgctgtgccgtcccattgggtccccaccagtaggactacatggtctatccacgccaaacatgagtggatgaccactgaagacatgctcaccgtgtggaaccgagtgtggatacgtgagaatccttggatggaggataagacaccagtcgaaagctgggaggaaatcccctacttgggcaagagagaggaccagtggtgcggttccctgattgggcttacgtcacgcgcaacctgggccaaaaacatccaagcggctattaatcaggttcggagtctgatcggaaacgaagagtatactgattacatgccttctatgaagaggttcagacgcgaggaagaggaagccggcgtgctctggtga

SEQ ID NO: 14410 - RNA, 9876 nt, synthetic construct
  misc_feature 1..9876: note = derived and/or modified CDS sequence (opt3) from DENV-2__GU131897__SS-prME
  source 1..9876: mol_type = other RNA
agcgccggaatgatcattatgctgataccaaccgtgatggctttccacctcactactcggaacggggagcctcatatgatcgtcggcattcaggaaaagggtaaatcccttctgtttaagacggaggacggagttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccacatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaggaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaatggaaatcaaggtaacgccgcagtcaagtattacagaggctgaactgaccggctatggtactgtgaccatggagtgtagccccagaacagggcttgatttcaatgaaatggtcctgttgcaaatggagaacaaagcctggctcgtgcacaggcagtggtttctggacttacctctgccatggctccccggcgcagataagcaggagtctaattggatccagaaggaaacccttgttactttcaaaaaccctcatgctaagaaacaagacgtggtcgtgctgggatcccaggagggcgccatgcacacagcgttgacgggggccaccgaaatacagatgtcaagcggaaatctactgtttactggtcatctcaagtgccggctgcgtatggacaaacttcaactgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccagttaaagctgaattggttcaagaaagggtcttccattggacaaatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacagtataaatttcaacccgagagtccaagcaagttggcctccgctatccagaaagcccaggaagagggcatatgtggtattagatctgtcactaggctcgagaatctgatgtggaagcagatcacacccgaattaaaccacattctggcagagaatgaagttaaactaaccatcatgactggcgatataaaggggatcatgcaagccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaggacgcgttttgtgactctaagttaatgagcgctgccattaaggataatagggcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatccccaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaagctcattaccgagtggtgctgtagatcctgcacactgccgcctcttaggtatcgcggagaggacggctgttggtacggtatggaaatacggccattgaaagagaaggaagagaatctgatcaactcattagtgacggcggggcacggacaggttgataatttcagtctcggcgtgctgggtatggccctttttctggaagagatgttgagaaccagggtaggcactaaacatgctattctcctggtcgcagtgagcttcgtgacactaatcaccgggaacatgtcgtttaaggacctgggacgcgtcgttgtgatggtaggcgccactatggctgatgacattgggatgggagtgacatatctcgccctgcttgcagcgttcaaagtccgacccacctttgccgctggcttgctgttacggaagctcacgtccaaggagctgatgatgactaccatcggtatagtgcttctgtctcaaagcacaatccctgaaaccgttctagagctcactgatgccctggcattggggatgatggtgctgaaaattgtccgtaatatggaaaagtaccagttagctgtgacaatcatggccattctctgcgttcccaacgcagtgatcctgcagaatgcctggaaagtctcatgtaccatacttgctgtagtgagtgtttccccactgttgctcacatctagccagcaaaagactgactggattcctctggcgctaaccatcaaaggactgaaccccacggccatcttccttacaaccctctccagaactaataagaaaaggtcatggccactgaacgaggcaattatggctgtgggcatggtcagcatattggccagttctctgttaaagaatgacatcccgatgaccggccctctcgtggccgggggactgcttacagtatgctatgtgctgactggtcgctccgctgatttggaactcgagcgggcaaccgacgtcaagtgggaggatcaggccgaaattagcggctcgtcacccatcctgtctattacgatcagtgaggacgggtccatgagcatcaagaacgaagaggaggaacagacactaaccatcctgattagaactggacttctcgttatctctggcctgtttccaattagcatccccataacagcggctgcctggtacttgtgggaggtgaagaaacagagggccggtgtgttatgggatgtcccttccccaccccctatggggaaggccgaactggaggacggagcttatcgaattaaacaaaagggcatcctcggctactcacagatcggggcaggagtgtacaaggaaggtaccttccacactatgtggcatgttacacgcggcgccgtactgatgcacaaagggaagcggattgagccgagttgggcggatgtgaaaaaggaccttatcagctatggaggcggttggaaactggagggggaatggaaggagggagaagaggtccaggtgttggctctagaaccaggcaagaatcccagagccgttcagaccaaacctggcctgtttaagacgaacactgggaccataggagcagtgtctctcgatttctccccaggtacatcaggcagtcccattatcgacaaaaaggggaaagtcgtgggactgtacggcaacggtgtagtcaccaggagcggggcctatgtgtccgctattgcccaaacagagaagtctatcgaggataatcctgaaatagaggacgatatttttcgtaagcgccggcttactatcatggacttacacccgggagcaggcaaaaccaagagatacctgcccgctatcgttagggaagccattaaacgaggcctccggacgttgatcctggcgccaacacgcgtggtcgccgcagagatggaagaggctctcagagggctgcctattaggtatcagactcccgccatacgggctgagcataccggacgagaaatcgtggaccttatgtgtcacgcaacattcaccatgagactgttgtcgccagttcgcgtgcctaactacaatctaattatcatggatgaggcccatttcactgaccccgccagcatcgctgcgaggggttatatttcaacccgtgtcgaaatgggcgaggcagccgggatatttatgacagctacgccaccgggatcccgggatcctttcccccagagtaacgccccaatcattgacgaggaaagagagatccccgaaaggtcttggaatagcggccacgagtgggtgatggattttaagggtaaaactgtatggttcgtgccttccattaaggcagggaacgacatcgccgcttgcctgcgcaagaatggcaaaaaggttatacaactctcacgaaaaacctttgattctgaatacgtcaagacaagaaccaacgactgggatttcgtggtgactacagacatcagcgagatgggcgcgaattttaaagccgagcgggtcattgatccaaggcgctgtatgaagcccgtaatcttaaccgacggcgaggaacgtgtgattctggcagggcctatgccggttacgcatagttccgctgcccagagacggggaaggatcggtcgcaaccccaaaaatgaaaacgaccagtacatatatatgggcgagccccttgaaaatgatgaggactgcgcacactggaaggaggccaagatgctgctcgataacattaatactcctgaagggatcattcccagcatgttcgagccagaacgagagaaagtggacgctatcgatggagaatacagattgcggggcgaggccaggaagacatttgtcgacctgatgcgcagaggtgatctccctgtgtggctggcgtataaagttgcagccgaggggataaactacgctgacaggcggtggtgtttcgatggcatcaagaacaatcagattcttgaagagaacgtggaagtcgagatctggaccaaagagggagaacgtaagaagctaaaaccccgctggctggacgcccgaatttattctgatccattggctttaaaggagtttaaagagttcgcagccggcagaaagtcactgaccctcaatctgatcactgagatggggaggcttcctacattcatgacccagaaaactcgggacgctctggataacctcgccgtgttgcacactgcagaagcgggaggtcgcgcctacaatcatgctctgtccgagctaccggagacgctggaaaccctccttctgttaacattgctggccactgtaaccggcgggatatttctcttcctgatgagtggaagaggcattggtaagatgacacttgggatgtgctgcatcatcaccgcaagcattctgctctggtatgctcaaatccagccccactggatagccgcatcgattatcttggagtttttcctgattgtgttactaatcccagaacctgagaagcagaggactccccaagacaaccagctgacgtacgttgtcatagccatcctcaccgtggtggctgcgacaatggccaatgaaatgggctttcttgagaaaactaagaaagacctgggattgggctctattgcaacccagcagccagagtccaacatcctggatattgacctccggcctgctagcgcctggacactgtacgccgtcgcaaccactttcgttacacccatgcttcgacattcaatcgaaaatagttctgtgaacgtatccctcacggctattgccaatcaagcgaccgtgctgatggggttgggaaagggttggccgctgagcaaaatggatatcggcgtcccattactagctatagggtgttattcacaggtgaaccctattactctgacagccgcactccttctgttggttgcccactacgctatcatcggacccggcctgcaggcaaaggccaccagagaggcgcagaagcgcgctgccgcaggtattatgaaaaatccaaccgtggacgggataacagtcatcgatctcgaccccattccttatgatccgaagtttgaaaaacaactgggccaggtaatgcttttaatcctgtgcgtgactcaggttctcatgatgaggacgacctgggccttgtgtgaggctctgacactagccactggacccattagtaccctgtgggaaggcaacccagggcggttctggaatacaaccatcgcagtgagcatggctaacatatttcgtggatcctacctcgccggcgcgggtcttctgttctctatcatgaagaatactacgaacacaagaagggggaccggaaacattggcgagactttgggtgagaaatggaaaagccgcctgaatgccctcggcaaatccgaatttcaaatctataagaagtcagggattcaggaggtcgaccggaccctggcaaaagaaggaatcaagcgaggcgagacagatcaccatgctgtgtctagagggagtgccaaattaaggtggttcgtcgagcgcaacatggtgactcctgaaggaaaggttgtggaccttggctgcggtagagggggatggtcgtactattgtggcggtctgaaaaatgtaagagaggtgaagggcctcaccaaagggggacccggccacgaggaacctataccaatgagcacatacgggtggaacctagtccgtctgcagtccggagttgatgtgtttttcattccccctgaaaaatgcgacacgttgctgtgtgatatcggcgagtcttcaccaaatcccaccgtcgaggcaggtaggactctccgggtgcttaacctggtagaaaattggttgaacaataacacacagttctgcatcaaggtgctgaatccgtacatgcctagcgttattgagaaaatggaagctctccaacgcaagtatgggggagccttagtgcgaaacccactgtccagaaatagtacccatgagatgtactgggtctctaacgccagcggcaatatagtgtcatccgtcaacatgatcagtaggatgcttattaaccggtttactatgcgccacaaaaaggcgacatatgaacccgacgtggacctgggcagcgggaccagaaatatcggaattgagtctgagatccctaacctagatataatcggtaagaggattgagaaaataaaggaagaacatgagacgtcctggcactacgaccaggatcacccatataaaacctgggcttaccatggctcatatgaaacaaagcagactgggagcgcatcgtctatggttaatggagtagtgcgactcctgaccaaaccctgggacgtcttgccgacagtgactcagatggccatgaccgatacaacccctttcggccaacagcgggtttttaaggagaaggtggacactcgtacgcaggagcccaaagaaggtacaaagaaactgatgaagattaccgctgagtggctctggaaagaacttgggaagaaaaagactccaagaatgtgtacccgcgaggagttcacaaggaaggtccggagtaacgccgcactgggagccatctttacggatgaaaataaatggaagtccgctagagaggcggtggaagacagccgcttctgggagttagtagataaagaaaggaacctgcacttggagggcaagtgcgagacctgtgtgtacaatatgatgggcaaacgagaaaagaagctcggggagtttggaaaagccaagggttcacgggcaatttggtacatgtggctgggcgctagattcctagaatttgaggcccttgggttcctgaacgaagaccattggttttccagggaaaattctctcagcggagttgagggcgaaggtctgcacaaattggggtatatactgcgcgatgtcagtaagaaagagggaggcgcaatgtacgccgacgacactgctggctgggatacacgtatcaccctcgaagaccttaagaacgaggaaatggtgactaatcacatggagggggagcataagaaactggccgaagcgattttcaagttaacatatcagaacaaagtggtccgggttcaaagacctacccccaggggaacagtgatggatatcatctcccgccgagaccagcggggtagcggccaggtagggacttacggactgaatacctttacgaacatggaggcacaattgattagacagatggaaggcgagggtgtgttcaagaatatacagcacctcaccgtcacagaggaagccgctgtgcagaactggctggccagggttgggcgcgagagactatctcggatggcaatctcaggagatgactgcgtggtcaaaccacttgatgacaggttcgctaacgccctgactgctctcaatgatatgggcaagattcgtaaggacatccaacagtgggaacccagtaaaggctggaacgattggacccaggtgcctttttgctcccatcacttccatgagctgattatgaaggacgggcgagtattggttgtgccatgtcgcaatcaggatgaattaatcggtagagcacggataagccaaggagcaggctggtctctgagggagacagcgtgcctcgggaaatcgtatgcccagatgtggtcacttatgtactttcaccgcagagacctgcggctagctgccaacgcaatctgtagcgctgtcccgtcccactgggtgcccacaagtaggaccacgtggtctattcatgccaagcacgagtggatgacaaccgaagacatgctgactgtgtggaatcgagtctggatccgtgagaacccttggatggaagataaaacaccagttgagagctgggaagagattccctatctcggaaagagagaggaccagtggtgcggctccttgatcggtctgacctcacgcgcaacttgggccaagaatatacaggcggctattaaccaagtgcggagtcttatcgggaatgaagagtacaccgattacatgccttctatgaaaaggttcagacgcgaagaggaagaggccggagtactgtggtga

SEQ ID NO: 14411 - RNA, 9876 nt, synthetic construct
  misc_feature 1..9876: note = derived and/or modified CDS sequence (opt3) from DENV-2__GQ868631__SS-prME
  source 1..9876: mol_type = other RNA
agcgccggcatgataattatgctgatacccaccgtgatggctttccacctcaccactagaaacggggagcctcatatgatcgtcggtattcaagaaaagggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccaagggcgagcaccggcgcgaaaaacgaagtgtagccctggtgccccatgtcggtatggggcttgagacgcgtactgaaacctggatgagctccgagggagcgtggaagcacgctcagagaatcgagacatggatactgaggcatcctggcttcactatcatggccgcaattttggcctacaccatcggcacaacccactttcagcgggtgctcattttcatcctgctgacggctgttgcaccatctatgactatgcgctgcatagggatttcgaacagagattttgtggaaggagtctcaggtggcagctgggtggacatcgtactcgagcacgggagttgtgttacaaccatggccaagaataaacccactttagatttcgaactgattaagacagaggctaaacagcctgccacccttaggaagtattgcatcgaagcgaaattgacgaacaccacaactgagtcccggtgtccaacccaaggagagccctctctgaaggaggaacaggacaagcgctttgtgtgcaaacatagcatggtcgatcgaggctggggtaatgggtgtggactattcggcaagggcgggatcgtgacatgcgcaatgtttacttgcaaaaagaacatggaaggaaaaattgtgcagcctgagaatctcgaatacaccatagtcgttacaccacactccggtgaggagcatgccgtgggcaacgacaccgggaagcacggaatggaaatcaaagtaactccgcagtcaagtattacggaggctgaactgacaggctatggtaccgtgactatggagtgtagccccagaaccgggcttgatttcaatgaaatggtcctgttgcaaatggagaacaaggcctggctcgtgcacaggcagtggtttctggacttacctctgccatggctccccggcgcagataagcaggagtctaattggatccagaaagaaacacttgttaccttcaagaaccctcatgctaaaaagcaagacgtggtcgtgctgggatcccaggagggcgccatgcacactgcgttgacaggggccacggaaatacagatgtcaagcggaaatctactgtttaccggtcatctcaaatgccggctgcgtatggacaaacttcaactgaagggcatgagttactctatgtgtactgggaaattcaaggtagttaaagagattgcagagacacagcacggaaccatcgtgatccgcgtccagtatgaaggcgatggttccccatgcaagattcccttcgagatcatggacttggagaagagatacgtgctcgggaggctgattacagtcaacccgatagtgactgagaaggatagccctgttaacatcgaagctgagcccccatttggcgactcgtacattatcatcggagtggagcctggccagttaaagctgaattggttcaaaaaggggtcttccattggacaaatgtttgaaaccacgatgcggggtgccaaacgaatggctatactaggcgataccgcctgggacttcgggtcactcggaggcgtatttacaagtatcggtaaggcactgcatcaggtcttcggggccatttatggcgtggcttttagcggagtttcctggactatgaaaatccttattggcgtgatcataacctggatcgggatgaactctcgcagcacatcattgagtgtctccctggtgctcgtaggaattgtgactctgtaccttggcgttatggtccaggcggatagcggttgtgtggtgtcttggaagaataaggagctgaaatgcgggtcaggaatcttcattaccgacaacgtccacacgtggacagaacagtataagtttcaacccgagagtccaagcaaattggcatccgccatccagaaggctcaggaagagggcatatgtggtattagatctgttaccaggctcgagaatctgatgtggaaacagatcactcccgaattaaaccacattctggccgagaatgaagtgaagctaacaatcatgaccggcgatataaaagggatcatgcaagcaggaaagcggtcgctccgccctcagccaactgagctgaagtacagctggaaaacctggggcaaggccaaaatgctttccacagaatcatataaccagacgttcttgattgacgggccggagaccgctgagtgccccaatactaacagagcctggaatagtctggaagtggaggattacggatttggcgtattcacaaccaacatctggctcaagctgaaagaaaagcaggacgcattttgtgactctaagttaatgagcgcggctattaaagataatagggccgtccatgcagacatgggttattggatcgagtccgccctgaacgatacatggaagatagagaaggcttcattcattgaagtgaagaattgccactggcctaaaagccatactctttggtctaacggggttttggagtccgaaatgatcatcccaaagaacctcgccggacccgtgagtcaacacaattaccgtcctggctaccacacccagattgcaggtccatggcatctgggcaagctagagatggacttcgatttttgtgacgggacgacagtcatcgtgaccgaagattgcggaaaccggggccccagcctgcgaactaccacagcttctgggaaactcattactgagtggtgctgtagatcctgcaccctgccgcctcttaggtatcgcggagaggacggctgttggtacggtatggaaatacggccattgaaggagaaagaagagaatctggttaactcattagtgacagccgggcacggacaggtagataatttcagtctcggcgtcctgggtatggcgctttttctggaagagatgttgagaacgagggtgggcaccaagcatgccatcctcctggtggctgtcagcttcgttactctaattacagggaacatgtcgtttaaagacctgggacgcgtggtagtgatggtcggcgcaaccatggccgatgacatcgggatgggagtgacttatctcgctctgcttgccgcattcaaggttcgacccacatttgcggccggcttgctgttacggaagctcacctccaaagagctgatgatggctacgattggtatcgtgcttctgtctcaaagcactatacctgaaaccgtcctagagctcacagatgccctggcattggggatgatggctctgaagatcgtgcgtaatatggaaaaataccagttagccgttaccattatggcaatcctctgcgtgcccaacgccgtcattctgcagaatgcttggaaggtatcatgtactatccttgcggtggttagtgtgtccccactgttgctcacatctagccagcagaagacagactggatacctctggccctaacaattaagggactgaaccccactgcaatcttccttaccacgctctccagaacaaataaaaagaggtcatggccactgaacgaggctatcatggccgtcggcatggtgagcattttggccagttctctgttaaagaatgacataccgatgaccggccctctcgtagctgggggactgcttactgtgtgctatgtcctgaccggtcgctccgcagatttggaactcgagcgggccacagacgttaaatgggaggatcaggcggaaatcagcggctcgtcacccattctgtctatcactattagtgaggacgggtccatgagcatcaagaacgaagaggaggaacagaccctaacgatactgatcagaacaggacttctcgtgatttctggcctgtttccaatcagcattcccatcaccgctgccgcatggtacttgtgggaggtgaaaaagcagagggccggtgtcttatgggatgtgccttccccaccccctatggggaaagctgaactggaggacggagcatatcgaataaagcaaaagggcattctcggctactcacagatcggggccggagtttacaaagaaggtactttccacacaatgtggcatgtaacccgcggcgcggtgctgatgcacaaggggaaacggatcgagccgagttgggctgatgtcaagaaagaccttattagctatggaggcggttggaagctggagggggaatggaaggagggagaagaggtgcaggttttggccctagaaccaggcaaaaatcccagagcagtgcagactaagcctggcctgtttaaaacaaacaccgggacgatcggagccgtctctctcgatttctccccaggtacttcaggcagtcccataattgacaagaaagggaaggtggtaggactgtacggcaacggtgtcgtgaccaggagcggggcttatgtttccgccatcgcacaaacagagaagtctattgaggataatcctgaaatcgaggacgatatatttcgtaaacgccggcttaccattatggacttacacccgggagctggcaagacaaaaagatacctgcccgccatcgtgagggaagcgatcaagcgaggcctccggactttgattctggccccaacccgcgtcgtggcagctgagatggaagaggccctcagagggctgcctatcaggtatcagacgcccgctattcgggcagagcatacaggacgagaaatagttgaccttatgtgtcacgccactttcaccatgagactgttgtcgccagtgcgcgtccctaactacaatctaatcattatggatgaggcccatttcacagaccccgctagcatcgcggcaaggggttatatctcaacccgtgtggaaatgggcgaggccgctgggatttttatgactgccaccccaccgggatcccgggatcctttcccccagagtaacgcaccaataatcgacgaggaaagagagattcccgaaaggtcttggaatagcggccacgagtgggtaacagattttaaaggtaagacggtgtggttcgttccttccatcaaggccgggaacgacattgctgcgtgcctgcgcaaaaatggaaagaaagtcatccaactctcacgaaagacttttgattctgaatacgtgaaaaccagaacaaacgactgggatttcgtggtcaccactgacataagcgagatgggcgccaattttaaggcagagcgggtaatcgatccaaggcgctgtatgaaacccgtgattttaacagacggcgaagaacgtgttatcctggctgggcctatgccggtgacccatagttccgccgcacagagacggggaaggattggtcgcaacccaaagaatgaaaacgaccagtacatctatatgggcgagccccttgaaaatgatgaggactgcgcccactggaaggaggctaaaatgctgctcgataacataaatacgcctgaagggattatccccagcatgttcgagccagaacgagagaaggtcgacgccattgatggagaatacagattgcggggcgaggcgaggaaaacttttgtggacctgatgcgcagaggtgatctccctgtttggctggcatataaggtggccgctgaggggatcaactacgccgacaggcggtggtgtttcgatggcatcaaaaacaatcagatccttgaagagaacgtcgaagtggagatttggacaaaggagggagaacgtaagaaactaaagccccgctggctggacgctcgaatctattctgatccattggcattaaaagagtttaaggagttcgccgctggcagaaaatcactgaccctcaatctgattaccgagatggggaggcttcctactttcatgacacaaaagacccgggacgccctggataacctcgcagtattgcacacagcggaagccggaggtcgcgcttacaatcatgccctgtccgagctaccggagactctggaaacgctccttctgttaaccttgctggcaacagtgactggcgggatctttctcttcctgatgagtggaagaggcataggtaagatgacccttgggatgtgctgcattatcacagctagcatcctgctctggtatgcccagattcagccccactggatcgcagcctcgataattttggagtttttcctgatcgttttactaattccagaacctgagaaacagaggacaccccaagacaaccagctgacttacgtcgtgatcgctatactcacggtggtcgcggccaccatggcaaatgaaatgggctttcttgagaagaccaagaaagacctgggattgggctctatcgctactcagcagccagagtccaacattctggatatcgacctccggcctgccagcgcctggaccctgtacgcagttgctacaaccttcgtgactcccatgcttcgacattcaattgaaaatagttctgtaaacgtgtccctcacagccatcgcgaatcaagctacggtcctgatggggttgggaaaaggttggccgctgagcaaaatggatattggcgtgccattactagccatcgggtgttattcacaggttaaccctataaccctgactgcagccctccttctgttggtggctcactacgcaattatcggacccggcctgcaggccaaggcgacaagagaggctcagaaacgcgccgcagccggtatcatgaagaatccaaccgtcgacgggattaccgtaatagatctcgaccccatcccttatgatccgaaatttgaaaagcaactgggccaggtgatgcttttaattctgtgcgttacacaggtgctcatgatgaggactacgtgggctttgtgtgaggccctgaccctagcaacaggacccatcagtactctgtgggaaggcaacccagggcggttctggaataccacaattgctgtcagcatggccaacatctttcgtggatcctacctcgcgggcgccggtcttctgttctctataatgaaaaataccactaacacgagaagggggacaggaaacatcggcgagaccttgggtgagaagtggaaaagccgcctgaatgcactcggcaagtccgaatttcaaatttataagaaatcagggatccaggaggtggaccggactctggctaaggaaggaattaaacgaggcgagaccgatcaccatgccgtctctagagggagtgcaaagttaaggtggttcgtggagcgcaacatggttacacctgaaggaaaagtggtagaccttggctgcggtagagggggatggtcgtactattgtggcggtctgaagaatgtgagagaggtcaagggcctcactaaagggggacccggccacgaggaacctatcccaatgagcacctacgggtggaacctagttcgtctgcagtccggagtggatgtctttttcataccccctgaaaagtgcgacacattgctgtgtgatattggcgagtcttcaccaaatcccacggtggaggctggtaggaccctccgggtacttaacctggtggaaaattggttgaacaataacactcagttctgcatcaaagttctgaatccgtacatgcctagcgtgatcgagaagatggaagccatgcaacgcaaatatgggggagccctcgtccgaaacccattatccagaaatagtacacatgagatgtactgggtgtctaacgcgagcggcaatattgtctcatccgtgaacatgataagtaggatgctgatcaaccggtttaccatgcgccacaagaaggctacttatgaacccgacgttgaccttggcagcgggacaagaaatattggaatcgagtctgagattcctaacctggatatcataggtaaaaggatcgaaaagattaaagaggaacatgagacctcctggcactacgaccaggatcacccatataagacgtgggcataccatggctcatatgaaaccaaacagacagggagcgcctcgtctatggtaaatggagtggtccgactactcactaagccctgggacgtgctgccgaccgttacacagatggctatgactgataccacacctttcggccaacagcgggtgtttaaggagaaagtcgacacccgtactcaggagcccaaggaaggtacgaaaaagttgatgaaaatcacagccgagtggctgtggaaggaactcgggaaaaagaagaccccaagaatgtgtactcgcgaggagttcaccaggaaagtgcggagtaacgcagcccttggagctatttttacagatgaaaataagtggaaatccgcgagagaggccgtagaagacagccgcttctgggagctggtggataaggaaaggaacttacacctggagggcaaatgcgagacgtgtgtttacaatatgatgggcaagcgagaaaagaaattgggggagtttggaaaggcaaaaggttcacgggctatctggtacatgtggctcggcgccagattcctggaatttgaggcactagggttccttaacgaagaccattggttttccagggaaaattctctgagcggagtcgagggcgaaggtctccacaagctggggtatattttgcgcgatgtgagtaaaaaggagggaggcgccatgtacgctgacgacaccgccggctgggatactcgtataacactggaagacctcaagaacgaggaaatggtgaccaatcacatggagggggagcataagaaacttgcggaagcaatcttcaaactgacttatcagaacaaagtcgttcgggtgcaaagacctacacccaggggaaccgtaatggatattatctcccgccgagaccagcggggtagcggccaggtggggacatacggattaaatacttttaccaacatggaggcccaactgatcagacagatggaaggcgagggtgtcttcaaaaatattcagcacttgacggtgaccgaggaagctgccgttcagaactggctcgcaagggtggggcgcgagagactgtctcggatggctatatcaggagatgactgcgtcgtgaagccactagatgacaggttcgccaacgctcttacagccctgaatgatatgggcaagatccgtaaagacattcaacagtgggaacccagtaagggctggaacgattggactcaggtacctttttgctcccatcacttccatgagctcatcatgaaagacgggcgagttctggtggtcccatgtcgcaatcaggatgaattgattggacgggcacggatcagccaaggtgcgggctggtctttaagggagaccgcctgcctggggaagtcgtatgctcagatgtggtcactcatgtactttcaccgcagagaccttcggctggccgcaaacgctatatgtagcgccgtgccgtcccactgggtgcccacaagtaggactacctggtctatccatgcaaaacacgagtggatgacgacagaagacatgctaaccgtctggaatcgagtttggattcgtgagaacccttggatggaagataagactccagtggagagctgggaagagatcccctatctgggaaagagagaggaccagtggtgcggctccctcattggtttgacatcacgcgccacctgggcgaaaaatatccaggctgccataaaccaagtacggagtctgattgggaatgaagagtacactgattacatgccttctatgaagaggttcagacgcgaagaggaagaggcaggagtgctttggtga

SEQ ID NO: 14412 - RNA, 9876 nt, synthetic construct
  misc_feature 1..9876: note = derived and/or modified CDS sequence (opt3) from DENV-2__GU131899__SS-prME
  source 1..9876: mol_type = other RNA
agcgcaggcatgatcattatgctgatacccaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacacgatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagcactggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactgccgagtgccccaatacaaacagagcatggaatagtctggaagtggaggattacggatttggcgtgttcaccacaaacatctggctcaagctgaaagaaaagcaggacgcgttttgtgactctaagttaatgagcgctgccattaaagataatagggcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaaactcattaccgagtggtgctgtagatcctgcacactgccgcctcttaggtatcgcggagaggacggctgttggtacggtatggaaatacggccattgaaggagaaagaagagaatctggtgaactcattagttacggcggggcacggacaggtggataatttcagtctcggcgtactgggtatggccctttttctggaagagatgttgagaaccagggtcggcactaagcatgctatcctcctggtggcagtgagcttcgtcacactaattaccgggaacatgtcgtttaaagacctgggacgcgttgtggtaatggtgggcgccactatggctgatgacatcgggatgggagtcacatatctcgccctgcttgcagcgttcaaggtgcgacccacctttgccgctggcttgctgttacggaagctcacgtccaaagagctgatgatgactaccattggtatcgttcttctgtctcaaagcacaatacctgaaaccgtgctagagctcactgatgccctggcattggggatgatggtcctgaagatcgtgcgtaatatggaaaaataccagttagctgttacaattatggccatcctctgcgtgcccaacgcagtcattctgcagaatgcctggaaggtatcatgtaccatccttgctgtggttagtgtgtccccactgttgctcacatctagccagcagaagactgactggatacctctggcgctaaccattaagggactgaaccccacggccatcttccttacaaccctctccagaactaataaaaagaggtcatggccactgaacgaggcaatcatggctgtcggcatggtgagcattttggccagttctctgttaaagaatgacataccgatgaccggccctctcgtagccgggggactgcttacagtgtgctatgtcctgactggtcgctccgctgatttggaactcgagcgggcaaccgacgttaaatgggaggatcaggccgaaatcagcggctcgtcacccattctgtctatcacgattagtgaggacgggtccatgagcatcaagaacgaagaggaggaacagacactaaccatactgatcagaactggacttctcgtgatttctggcctgtttccaatcagcattcccgtgacagcggctgcctggtacttgtgggaggtcaaaaagcagagggccggtgtgttatgggatgttccttccccaccccctatggggaaagccgaactggaggacggagcttatcgaatcaagcaaaagggcatactcggctactcacagattggggcaggagtatacaaagaaggtaccttccacactatgtggcatgtgacacgcggcgccgtcctgatgcacaaggggaaacggatcgagccgagttgggcggatgtgaagaaagaccttatcagctatggaggcggttggaagctggagggggaatggaaggagggagaagaggttcaggtgttggctctagaaccaggcaaaaatcccagagccgtccagaccaagcctggcctgtttaaaacgaacactgggaccattggagcagtgtctctcgatttctccccaggtacatcaggcagtcccatcatagacaagaaagggaaggtagtcggactgtacggcaacggtgtggttaccaggagcggggcctatgtgtccgctattgcccaaacagagaagtctatcgaggataatcctgaaattgaggacgatatctttcgtaaacgccggcttactataatggacttacacccgggagcaggcaagaccaaaagatacctgcccgctattgtcagggaagccatcaagcgaggcctccggacgttgatcctggcgccaacacgcgtggttgccgcagagatggaagaggctctcagagggctgcctattaggtatcagactcccgccatccgggctgagcataccggacgagaaattgtggaccttatgtgtcacgcaacattcaccatgagactgttgtcgccagtccgcgtgcctaactacaatctaataatcatggatgaggcccatttcactgaccccgccagcattgctgcgaggggttatatctcaacccgtgtagaaatgggcgaggcagccgggatctttatgacagctacgccaccgggatcccgggatcctttcccccagagtaacgccccaattatagacgaggaaagagagatccccgaaaggtcttggaatagcggccacgagtgggtgactgattttaaaggtaagaccgtttggttcgtcccttccattaaggcagggaacgacatcgccgcttgcctgcgcaaaaatggaaagaaagtgattcaactctcacgaaagacatttgattctgaatacgtgaaaaccagaactaacgactgggatttcgtcgtaacaaccgacatcagcgagatgggcgcgaattttaaggccgagcgggtgatagatccaaggcgctgtatgaaacccgttatcttaacggacggcgaagaacgtgtgattctggcagggcctatgccggtcactcatagttccgctgcccagagacggggaaggatcggtcgcaacccaaagaatgaaaacgaccagtacatttatatgggcgagccccttgaaaatgatgaggactgcgcacactggaaggaggccaaaatgctgctcgataacatcaatacacctgaagggataattcccagcatgttcgagccagaacgagagaaggtggacgctatcgatggagaatacagattgcggggcgaggccaggaaaacctttgttgacctgatgcgcagaggtgatctccctgtgtggctggcgtataaggtcgcagccgaggggattaactacgctgacaggcggtggtgtttcgatggcatcaaaaacaatcagatacttgaagagaacatggaagtggagatctggaccaaggagggagaacgtaagaaactaaagccccgctggctggacgcccgaatttattctgatccattggctttaaaagagtttaaggagttcgcagccggcagaaaatcactgactctcaatctgatcacagagatggggaggcttcctaccttcatgacacaaaagactcgggacgctctggataacctcgccgtattgcacacggcagaagcgggaggtcgcgcctacaatcatgctctgtccgagctaccggagaccctggaaacactccttctgttaactttgctggccaccgtgacaggcgggatttttctcttcctgatgagtggaagaggcatcggtaagatgacccttgggatgtgctgcataattactgcaagcatcctgctctggtatgctcagatccagccccactggattgccgcatcgatcatattggagtttttcctgattgttttactaatcccagaacctgagaaacagaggacgccccaagacaaccagctgacctacgtcgtgattgccatcctcacagtggtcgctgcgactatggccaatgaaatgggctttcttgagaagaccaaaaaggacctgggattgggctctatagcaacacagcagccagagtccaacatcctggatattgacctccggcctgctagcgcctggaccctgtacgccgttgcaactacattcgtgacgcccatgcttcgacattcaatcgaaaatagttctgtaaacgtgtccctcaccgctattgccaatcaagcgactgtcctgatggggttgggaaaaggttggccgctgagcaagatggatatcggcgtgccattactagctattgggtgttattcacaggttaaccctatcacactgaccgccgcactccttctgttggtggcccactacgctataattggacccggcctgcaggcaaaggccaccagagaggcgcagaaacgcgctgccgcaggtatcatgaagaatccaacagtcgacgggatcactgtaattgatctcgaccccataccttatgatccgaaatttgaaaagcaactgggccaggtgatgcttttaatcctgtgcgttacacaggtgctcatgatgaggaccacatgggccttgtgtgaggctctgactctagccaccggacccattagtacactgtgggaaggcaacccagggcggttctggaataccactatcgcagtcagcatggctaacatttttcgtggatcctacctcgccggcgcgggtcttctgttctctatcatgaaaaatacgacaaacaccagaagggggactggaaacatgggcgagaccttgggtgagaagtggaaaagccgcctgaatgccctcggcaagtccgaatttcaaatatataagcggtcagggatccaggaggtggaccgaacactggcaaaagaaggaattaagagaggcgagactgatcaccatgctgtctctagggggagtgccaaattacgctggttcgtggagcggaacatggttacccctgaaggaaaggtggtagaccttggctgcggtagagggggatggtcgtactattgtggcggtctgaaaaatgtgcgtgaggtcaagggcctcacaaaagggggacccggccacgaagaacctatcccaatgagcacgtacgggtggaacctagttaggctgcagtccggagtggatgtctttttcattccccctgaaaaatgcgacaccttgctgtgtgatatcggcgagtcttcaccaaatcccactgtggaggcaggtcggacactccgcgtacttaacctggtggaaaattggttgaacaataacacccagttctgcataaaggttctgaatccgtacatgcctagcgtgattgagaaaatggaagctctccaacgaaagtatgggggagccttagtcagaaacccactgtccaggaatagtactcatgagatgtactgggtgtctaacgccagcggcaatatcgtctcatccgtgaacatgatcagtcggatgcttattaaccgctttacaatgagacacaaaaaggcgacctatgaacccgacgttgacctgggcagcgggacgaggaatataggaatcgagtctgagattcctaacctagatatcattggtaagcgaatcgagaaaataaagcaggagcatgaaacctcctggcactacgaccaggatcacccatataaaacatgggcttaccatggctcatatgagactaagcagaccgggagcgcatcgtctatggtaaatggagtggtccggctcctgacaaaaccctgggacgtgttgccgactgttacccaaatggccatgacagataccactcctttcggccagcagcgtgtgtttaaggaaaaggtcgacacgagaacacaggagcccaaagagggtaccaagaaactgatgaagatcactgctgaatggctctggaaagagcttgggaagaaaaagaccccacgcatgtgtacaagggaagagttcacgcggaaggtgagaagtaacgccgcactgggagccatttttaccgatgagaataaatggaagtccgctcgcgaagcggtagaggacagcaggttctgggaattagtggataaagagcgaaacctgcacttggaaggcaagtgcgagacttgtgtttacaatatgatgggcaaacgggagaagaagctcggggaatttggaaaagccaagggttcaagagcaatctggtacatgtggctgggcgctaggttcctagagtttgaagcccttgggttcctgaacgaggaccattggttttcccgcgaaaattctctcagcggagtcgagggcgagggtctgcacaaattggggtatattctgcgtgatgtgagtaagaaagaaggaggcgcaatgtacgccgacgacacagctggctgggatacccggatcactctcgaggaccttaagaacgaagagatggtgacaaatcacatgaagggggaacataaaaagctggccgaggcgattttcaaattaacctatcaaaacaaggtcgttagagtgcagaggcctacaccccgcggaactgtaatggatataatctcccgacgggaccagagaggtagcggccaagtggggacctacggactgaatacgtttaccaacatggaggcacagttgattaggcagatggaaggcgagggtgtcttcaaaaatatccagcacctcacagtgactgaagaggttgccgtgcaaaactggctggctcgcgtcgggagagagcggctatctaggatggccatctcaggagatgactgcgtggtaaagccacttgatgaccgtttcgcaaacgctctgaccgccctcaatgatatgggcaagattcgaaaagacatacagcagtgggaacccagtaagggctggaacgattggacacaggttcctttttgctcccatcacttccatgagctgatcatgaaagacgggcgcgtgttggtcgtgccatgtagaaatcaagatgaattaattggacgggctaggatcagccagggtgccggctggtctctgcgcgagactgcatgcctcgggaagtcgtatgcgcagatgtggtcacttatgtactttcacagacgggacctgaggctagccgctaacgccatttgtagcgcagtgccgtcccactgggtccccaccagtcgaacgacatggtctatccatgctaaacacgaatggatgaccactgaggacatgctgacagtttggaatcgtgtgtggataagagagaacccttggatggaagataagaccccagtagagagctgggaagagatcccctatctcggaaagcgcgaagaccagtggtgcggctccttgattggtctgacttcacgggccacctgggccaaaaatatccaagccgcgattaaccaggtgaggagtcttatcgggaatgaggagtacacagattacatgccttctatgaagagattccgccgggaagaggaagaggctggagtcctgtggtga

SEQ ID NO: 14413 - RNA, 9876 nt, synthetic construct
  misc_feature 1..9876: note = derived and/or modified CDS sequence (opt3) from DENV-2__GU131900__SS-prME
  source 1..9876: mol_type = other RNA
agcgccggaatgatcattatgctgataccaaccgtgatggctttccacctcactactcggaacggggagcctcatatgatcgtcggtattcaagaaaagggaaaatcccttctgtttaagacggaggacggcgttaatatgtgcaccttgatggcaatggatttaggggaactgtgtgaggacacgatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccacatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaatggaaatcaaggtaacgccgcagtcaagtattacagaggctgaactgaccggctatggtactgtgaccatggagtgtagccccagaacagggcttgatttcaatgaaatggtcctgttgcaaatggagaacaaagcctggctcgtgcacaggcagtggtttctggacttacctctgccatggctccccggcgcagataagcaggagtctaattggatccagaaggaaacccttgttactttcaaaaaccctcatgctaagaaacaagacgtggtcgtgctgggatcccaggagggcgccatgcacacagcgttgacgggggccaccgaaatacagatgtcaagcggaaatctactgtttactggtcatctcaagtgccggctgcgtatggacaaacttcaactgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccagttaaagctgaattggttcaagaaagggtcttccattggacaaatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacagtataaatttcaacccgagagtccaagcaagttggcctccgctatccagaaagcccaggaagagggcatatgtggtattagatctgtcactaggctcgagaatctgatgtggaagcagatcacacccgaattaaaccacattctggcagagaatgaagttaaactaaccatcatgactggcgatataaaggggatcatgcaagccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaggacgcgttttgtgactctaagttaatgagcgctgccattaaggataatagggcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatccccaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaagctcattaccgagtggtgctgtagatcctgcacactgccgcctcttaggtatcgcggagaggacggctgttggtacggtatggaaatacggccattgaaagagaaggaagagaatctggtgaactcattagttacggcggggcacggacaggtggataatttcagtctcggcgtactgggtatggccctttttctggaagagatgttgagaaccagggtcggcactaaacatgctatcctcctggtggcagtgagcttcgtcacactaattaccgggaacatgtcgtttaaggacctgggacgcgttgtggtaatggtgggcgccactatggctgatgacatcgggatgggagtcacatatctcgccctgcttgcagcgttcaaagtgcgacccacctttgccgctggcttgctgttacggaagctcacgtccaaggagctgatgatgactaccattggtatcgttcttctgtctcaaagcacaatacctgaaaccgtgctagagctcactgatgccctggcattggggatgatggtcctgaaaatcgtgcgtaatatggaaaagtaccagttagctgttacaattatggccatcctctgcgtgcccaacgcagtcattctgcagaatgcctggaaagtatcatgtaccatccttgctgtggttagtgtgtccccactgttgctcacatctagccagcaaaagactgactggatacctctggcgctaaccattaaaggactgaaccccacggccatcttccttacaaccctctccagaactaataagaaaaggtcatggccactgaacgaggcaatcatggctgtcggcatggtgagcattttggccagttctctgttaaaggacgatataccgatgaccggccctctcgtagccgggggactgcttacagtgtgctatgtcctgactggtcgctccgctgacttggaactcgagcgggcaaccgatgttaagtgggaggaccaggccgaaatcagcggctcgtcacccattctgtctatcacgattagtgaggatgggtccatgagcatcaaaaatgaagaggaggaacagacactaaccatactgatcagaactggacttctcgtgatttctggcctgtttccaatcagcattcccatcacagcggctgcctggtacttgtgggaggtgaagaaacagagggccggtgtcttatgggacgtgccttccccaccccctatggggaaggccgaactggaggatggagcttatcgaataaaacaaaagggcattctcggctactcacagatcggggcaggagtttacaaggaaggtaccttccacactatgtggcatgtaacacgcggcgccgtgctgatgcacaaagggaagcggatcgagccgagttgggcggacgtcaaaaaggatcttattagctatggaggcggttggaaactggagggggaatggaaggagggagaagaggtgcaggttttggctctagaaccaggcaagaaccccagagccgtgcagaccaaacctggcctgtttaagacgaatactgggaccatcggagcagtctctctcgacttctccccaggtacatcaggcagtcccataattgataaaaaggggaaagtggtaggactgtacggcaacggtgtcgtgaccaggagcggggcctatgtttccgctatcgcccaaacagagaagtctattgaggacaaccctgaaatcgaggatgacatatttcgtaagcgccggcttactattatggacttacacccgggagcaggcaaaaccaagagatacctgcccgctatcgtgagggaagccatcaaacgaggcctccggacgttgattctggcgccaacacgcgtcgtggccgcagagatggaagaggctctcagagggctgcctatcaggtatcagactcccgccattcgggctgagcataccggacgagaaatagttgatcttatgtgtcacgcaacattcaccatgagactgttgtcgccagtgcgcgtccctaattacaacctaatcattatggacgaggcccatttcactgatcccgccagcatcgctgcgaggggttatatctcaacccgtgtggaaatgggcgaggcagccgggatttttatgacagctacgccaccgggatcccgggaccctttcccccagagtaatgccccaataatcgatgaggaaagagagattcccgaaaggtcttggaacagcggccacgagtgggtaactgactttaagggtaaaaccgtgtggttcgttccttccatcaaggcagggaatgatattgccgcttgcctgcgcaagaacggcaagaaggtcatccaactctcacgaaaaacatttgactctgaatacgtgaagaccagaactaatgattgggacttcgtggtcacaaccgatataagcgagatgggcgcgaactttaaagccgagcgggtaatcgacccaaggcgctgtatgaagcccgtgattttaacggacggcgaagaacgtgttatcctggcagggcctatgccggtgactcatagttccgctgcccagagacggggaaggattggtcgcaatcccaaaaacgaaaatgatcagtacatctatatgggcgagccccttgaaaacgacgaggattgcgcacactggaaggaggccaagatgctgctcgacaatataaacacacctgaagggattatccccagcatgttcgagccagaacgagagaaagtcgatgctattgacggagaatacagattgcggggcgaggccaggaagacctttgtggatctgatgcgcagaggtgacctccctgtttggctggcgtataaagtggcagccgaggggatcaattacgctgataggcggtggtgtttcgacggcataaagaacaaccagatccttgaagagaatgtcgaagtggagatttggaccaaagagggagaacgtaagaagctaaaaccccgctggctggatgcccgaatctattctgacccattggctttaaaggagtttaaagagttcgcagccggcagaaagtcactgactctcaacctgattacagagatggggaggcttcctaccttcatgacacagaaaactcgggatgctctggacaatctcgccgtattgcacacggcagaagcgggaggtcgcgcctacaaccatgctctgtccgagctaccggagaccctggaaacactccttctgttaactttgctggccaccgtgacaggcgggatctttctcttcctgatgagtggaagaggcataggtaagatgacccttgggatgtgctgcattatcactgcaagcatcctgctctggtatgctcagattcagccccactggatcgccgcatcgataattttggagtttttcctgatcgttttactaattccagaacctgagaagcagaggacgccccaagacaatcagctgacctacgtcgtgatcgccatactcacagtggtcgctgcgactatggccaacgaaatgggctttcttgagaaaaccaagaaagatctgggattgggctctatcgcaacacagcagccagagtccaatattctggacatcgatctccggcctgctagcgcctggaccctgtacgccgttgcaactacattcgtgacgcccatgcttcgacattcaattgaaaacagttctgtaaatgtgtccctcaccgctatcgccaaccaagcgactgtcctgatggggttgggaaagggttggccgctgagcaaaatggacattggcgtgccattactagctatcgggtgttattcacaggttaatcctataacactgaccgccgcactccttctgttggtggcccactacgctattatcggacccggcctgcaggcaaaggccaccagagaggcgcagaagcgcgctgccgcaggtatcatgaaaaacccaacagtcgatgggattactgtaatagacctcgatcccatcccttatgacccgaagtttgaaaaacaactgggccaggtgatgcttttaattctgtgcgttacacaggtgctcatgatgaggaccacatgggccttgtgtgaggctctgactctagccaccggacccatcagtacactgtgggaaggcaatccagggcggttctggaacaccactattgcagtcagcatggctaatatctttcgtggatcctacctcgccggcgcgggtcttctgttctctataatgaagaacacgacaaataccagaagggggactggaaacatcggcgagaccttgggtgagaaatggaaaagccgcctgaacgccctcggcaaatccgaatttcaaatttataagaagtcagggatccaggaggtggatcggacactggcaaaagaaggaattaagcgaggcgagactgaccaccatgctgtctctagagggagtgccaaattaaggtggttcgtggagcgcaatatggttacccctgaaggaaaggtggtagatcttggctgcggtagagggggatggtcgtactattgtggcggtctgaaaaacgtgagagaggtcaagggcctcacaaaagggggacccggccacgaggaacctatcccaatgagcacgtacgggtggaatctagttcgtctgcagtccggagtggacgtctttttcataccccctgaaaaatgcgataccttgctgtgtgacattggcgagtcttcaccaaaccccactgtggaggcaggtaggacactccgggtacttaatctggtggaaaactggttgaataacaatacccagttctgcatcaaggttctgaacccgtacatgcctagcgtgatcgagaaaatggaagctctccaacgcaagtatgggggagccttagtccgaaatccactgtccagaaacagtactcatgagatgtactgggtgtctaatgccagcggcaacattgtctcatccgtgaatatgataagtaggatgcttatcaaccggtttacaatgcgccacaaaaaggcgacctatgaacccgacgttgatctgggcagcgggacgagaaacattggaatcgagtctgagattcctaatctagacatcataggtaagaggatcgagaaaattaaggaggaacatgagacctcctggcactacgatcaggaccacccatataaaacatgggcttaccatggctcatatgaaactaagcagaccgggagcgcatcgtctatggtaaacggagtggtccgactcctgacaaaaccctgggatgtgttgccgactgttacccagatggccatgacagacaccactcctttcggccaacagcgggtgtttaaggagaaggtcgatacgcgtacacaggagcccaaagaaggtaccaagaaactgatgaagatcactgctgagtggctctggaaagaacttgggaagaaaaagaccccaagaatgtgtacacgcgaggagttcacgaggaaggtgcggagtaatgccgcactgggagccatttttaccgacgaaaacaaatggaagtccgctagagaggcggtagaagatagccgcttctgggagttagtggacaaagaaaggaatctgcacttggagggcaagtgcgagacttgtgtttacaacatgatgggcaaacgagaaaagaagctcggggagtttggaaaagccaagggttcacgggcaatctggtacatgtggctgggcgctagattcctagaatttgaggcccttgggttcctgaatgaagatcattggttttccagggagaactctctcagcggagtcgagggcgaaggtctgcacaaattggggtatattctgcgcgacgtgagtaagaaagagggaggcgcaatgtacgccgacgatacagctggctgggacacccgtataactctcgaagatcttaagaatgaggaaatggtgacaaaccacatggagggggagcataagaaactggccgaagcgatcttcaagttaacctatcagaataaagtcgttcgggtgcaaagacctacacccaggggaactgtaatggacattatctcccgccgagatcagcggggtagcggccaggtggggacctacggactgaacacgtttaccaatatggaggcacaattgatcagacagatggaaggcgagggtgtcttcaagaacattcagcacctcacagtgactgaggaagccgctgttcagaattggctggccagggtggggcgcgagagactatctcggatggcaatatcaggagacgattgcgtcgtgaaaccacttgacgataggttcgctaacgccctgaccgctctcaacgacatgggcaagatccgtaaggatattcaacagtgggaacccagtaaaggctggaatgactggacacaggtacctttttgctcccatcacttccatgagctgatcatgaaggatgggcgagttttggtggtcccatgtcgcaaccaggacgaattaattggtagagcacggatcagccaaggagcaggctggtctctgagggagactgcgtgcctcgggaaatcgtatgcccagatgtggtcacttatgtactttcaccgcagagacctgcggctagctgccaatgcaatatgtagcgctgtgccgtcccactgggtgcccaccagtaggacgacatggtctatccatgccaagcacgagtggatgaccactgaagatatgctgacagtctggaaccgagtttggattcgtgagaatccttggatggaagacaaaaccccagtggagagctgggaagagatcccctatctcggaaagagagaggatcagtggtgcggctccttgattggtctgacttcacgcgcaacctgggccaagaacatccaggcggctataaatcaagtacggagtcttattgggaacgaagagtacacagactacatgccttctatgaaaaggttcagacgcgaagaggaagaggccggagtgctgtggtga

SEQ ID NO: 14414 - RNA, 9876 nt, synthetic construct
  misc_feature 1..9876: note = derived and/or modified CDS sequence (opt3) from DENV-2__GU131901__SS-prME
  source 1..9876: mol_type = other RNA
agcgccggaatgatcattatgctgataccaaccgtgatggctttccacctcactactcggaacggggagcctcatatgatcgtcggtattcaagaaaagggaaaatcccttctgtttaagacggaggacggcgttaatatgtgcaccttgatggcaatggatttaggggaactgtgtgaggacacgatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaggaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaatggaaatcaaggtaacgccgcagtcaagtattacagaggctgaactgaccggctatggtactgtgaccatggagtgtagccccagaacagggcttgatttcaatgaaatggtcctgttgcaaatggagaacaaagcctggctcgtgcacaggcagtggtttctggacttacctctgccatggctccccggcgcagataagcaggagtctaattggatccagaaggaaacccttgttactttcaaaaaccctcatgctaagaaacaagacgtggtcgtgctgggatcccaggagggcgccatgcacacagcgttgacgggggccaccgaaatacagatgtcaagcggaaatctactgtttactggtcatctcaagtgccggctgcgtatggacaaacttcaactgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccagttaaagctgaattggttcaagaaagggtcttccattggacaaatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacagtataaatttcaacccgagagtccaagcaagttggcctccgctatccagaaagcccaggaagagggcatatgtggtattagatctgtcactaggctcgagaatctgatgtggaagcagatcacacccgaattaaaccacattctggcagagaatgaagttaaactaaccatcatgactggcgatataaaggggatcatgcaagccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaggacgcgttttgtgactctaagttaatgagcgctgccattaaggataatagggcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatccccaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaagctcattaccgagtggtgctgtagatcctgcacactgccgcctcttaggtatcgcggagaggacggctgttggtacggtatggaaatacggccattgaaagagaaggaagagaatctggtgaactcattagttacggcggggcacggacaggtggataatttcagtctcggcgtactgggtatggccctttttctggaagagatgttgagaaccagggtcggcactaaacatgctatcctcctggtggcagtgagcttcgtcacactaattaccgggaacatgtcgtttaaggacctgggacgcgttgtggtaatggtgggcgccactatggctgatgacatcgggatgggagtcacatatctcgccctgcttgcagcgttcaaagtgcgacccacctttgccgctggcttgctgttacggaagctcacgtccaaggagctgatgatgactaccattggtatcgttcttctgtctcaaagcacaatacctgaaaccgtgctagagctcactgatgccctggcattggggatgatggtcctgaaaatcgtgcgtaatatggaaaagtaccagttagctgttacaattatggccatcctctgcgtgcccaacgcagtcattctgcagaatgcctggaaagtatcatgtaccatccttgctgtggttagtgtgtccccactgttgctcacatctagccagcaaaagactgactggatacctctggcgctaaccattaaaggactgaaccccacggccatcttccttacaaccctctccagaactaataagaaaaggtcatggccactgaacgaggcaatcatggctgtcggcatggtgagcattttggccagttctctgttaaagaatgacataccgatgaccggccctctcgtagccgggggactgcttacagtgtgctatgtcctgactggtcgctccgctgatttggaactcgagcgggcaaccgacgttaagtgggaggatcaggccgaaatcagcggctcgtcacccattctgtctatcacgattagtgaggacgggtccatgagcatcaaaaacgaagaggaggaacagacactaaccatactgatcagaactggacttctcgtgatttctggcctgtttccaatcagcattcccatcacagcggctgcctggtacttgtgggaggtgaagaaacagagggccggtgtcttatgggatgtgccttccccaccccctatggggaaggccgaactggaggacggagcttatcgaataaaacaaaagggcattctcggctactcacagatcggggcaggagtttacaaggaaggtaccttccacactatgtggcatgtaacacgcggcgccgtgctgatgcacaaagggaagcggatcgagccgagttgggcggatgtcaaaaaggaccttattagctatggaggcggttggaaactggagggggaatggaaggagggagaagaggtgcaggttttggctctagaaccaggcaagaatcccagagccgtgcagaccaaacctggcctgtttaagacgaacactgggaccatcggagcagtctctctcgatttctccccaggtacatcaggcagtcccataattgacaaaaaggggaaagtggtaggactgtacggcaacggtgtcgtgaccaggagcggggcctatgtttccgctatcgcccaaacagagaagtctattgaggataatcctgaaatcgaggacgatatatttcgtaagcgccggcttactattatggacttacacccgggagcaggcaaaaccaagagatacctgcccgctatcgtgagggaagccatcaaacgaggcctccggacgttgattctggcgccaacacgcgtcgtggccgcagagatggaagaggctctcagagggctgcctatcaggtatcagactcccgccattcgggctgagcataccggacgagaaatagttgaccttatgtgtcacgcaacattcaccatgagactgttgtcgccagtgcgcgtccctaactacaatctaatcattatggatgaggcccatttcactgaccccgccagcatcgctgcgaggggttatatctcaacccgtgtggaaatgggcgaggcagccgggatttttatgacagctacgccaccgggatcccgggatcctttcccccagagtaacgccccaataatcgacgaggaaagagagattcccgaaaggtcttggaatagcggccacgagtgggtaactgattttaagggtaaaaccgtgtggttcgttccttccatcaaggcagggaacgacattgccgcttgcctgcgcaagaatggcaagaaggtcatccaactctcacgaaaaacatttgattctgaatacgtgaagaccagaactaacgactgggatttcgtggtcacaaccgacataagcgagatgggcgcgaattttaaagccgagcgggtaatcgatccaaggcgctgtatgaagcccgtgattttaacggacggcgaagaacgtgttatcctggcagggcctatgccggtgactcatagttccgctgcccagagacggggaaggattggtcgcaaccccaaaaatgaaaacgaccagtacatctatatgggcgagccccttgaaaatgatgaggactgcgcacactggaaggaggccaagatgctgctcgataacataaatacacctgaagggattatccccagcatgttcgagccagaacgagagaaagtcgacgctattgatggagaatacagattgcggggcgaggccaggaagacctttgtggacctgatgcgcagaggtgatctccctgtttggctggcgtataaagtggcagccgaggggatcaactacgctgacaggcggtggtgtttcgatggcataaagaacaatcagatccttgaagagaacgtcgaagtggagatttggaccaaagagggagaacgtaagaagctaaaaccccgctggctggacgcccgaatctattctgatccattggctttaaaggagtttaaagagttcgcagccggcagaaagtcactgactctcaatctgattacagagatggggaggcttcctaccttcatgacacagaaaactcgggacgctctggataacctcgccgtattgcacacggcagaagcgggaggtcgcgcctacaatcatgctctgtccgagctaccggagaccctggaaacactccttctgttaactttgctggccaccgtgacaggcgggatctttctcttcctgatgagtggaagaggcataggtaagatgacccttgggatgtgctgcattatcactgcaagcatcctgctctggtatgctcagattcagccccactggatcgccgcatcgataattttggagtttttcctgatcgttttactaattccagaacctgagaagcagaggacgccccaagacaaccagctgacctacgtcgtgatcgccatactcacagtggtcgctgcgactatggccaatgaaatgggctttcttgagaaaaccaagaaagacctgggattgggctctatcgcaacacagcagccagagtccaacattctggatatcgacctccggcctgctagcgcctggaccctgtacgccgttgcaactacattcgtgacgcccatgcttcgacattcaattgaaaatagttctgtaaacgtgtccctcaccgctatcgccaatcaagcgactgtcctgatggggttgggaaagggttggccgctgagcaaaatggatattggcgtgccattactagctatcgggtgttattcacaggttaaccctataacactgaccgccgcactccttctgttggtggcccactacgctattatcggacccggcctgcaggcaaaggccaccagagaggcgcagaagcgcgctgccgcaggtatcatgaaaaatccaacagtcgacgggattactgtaatagatctcgaccccatcccttatgatccgaagtttgaaaaacaactgggccaggtgatgcttttaattctgtgcgttacacaggtgctcatgatgaggaccacatgggccttgtgtgaggctctgactctagccaccggacccatcagtacactgtgggaaggcaacccagggcggttctggaataccactattgcagtcagcatggctaacatctttcgtggatcctacctcgccggcgcgggtcttctgttctctataatgaagaatacgacaaacaccagaagggggactggaaacgtgggcgagaccttgggtgagaaatggaaaagccgcctgaatgccctcggcaaatccgaatttcaaatctataagaagtcagggattcaggaggtcgaccggacactggcaaaagaaggaatcaagcgaggcgagactgatcaccatgctgtgtctagagggagtgccaaattaaggtggttcgttgagcgcaacatggtgacccctgaaggaaaggtagtggaccttggctgcggtagagggggatggtcgtactattgtggcggtctgaaaaatgtcagagaggttaagggcctcacaaaagggggacccggccacgaggaacctattccaatgagcacgtacgggtggaacctagtgcgtctgcagtccggagtcgatgtgtttttcatcccacctgaaaaatgcgacaccttgctgtgtgatataggcgagtcttcaccaaatcccactgtagaggcaggtaggacactccgggtgcttaacctggttgaaaattggttgaacaataacacccagttctgcattaaggtgctgaatccgtacatgcctagcgtcatcgagaaaatggaagctctccaacgcaagtatgggggagccttagtgcgaaacccactgtccagaaatagtactcatgagatgtactgggtctctaacgccagcggcaatatcgtgtcatccgttaacatgattagtaggatgcttataaaccggtttacaatgcgccacaaaaaggcgacctatgaacccgacgtagacctgggcagcgggacgagaaatatcggaattgagtctgagatccctaacctagatattatcggtaagaggatagagaaaatcaaggaggaacatgagacctcctggcactacgaccaggatcacccatataaaacatgggcttaccatggctcatatgaaactaagcagaccgggagcgcatcgtctatggtgaatggagtcgtgcgactcctgacaaaaccctgggacgttttgccgactgtgacccagatggccatgacagataccactcctttcggccaacagcgggtctttaaggagaaggtggacacgcgtacacaggagcccaaagaaggtaccaagaaactgatgaagattactgctgagtggctctggaaagaacttgggaagaaaaagaccccaagaatgtgtacacgcgaggagttcacgaggaaggtacggagtaacgccgcactgggagccatctttaccgatgaaaataaatggaagtccgctagagaggcggtggaagacagccgcttctgggagttagttgataaagaaaggaacctgcacttggagggcaagtgcgagacttgtgtctacaatatgatgggcaaacgagaaaagaagctcggggagtttggaaaagccaagggttcacgggcaatttggtacatgtggctgggcgctagattcctagaatttgaggcccttgggttcctgaacgaagaccattggttttccagggaaaattctctcagcggagtggagggcgaaggtctgcacaaattggggtatatcctgcgcgatgtgagtaagaaagagggaggcgcaatgtacgccgacgacacagctggctgggatacccgtattactctcgaagaccttaagaacgaggaaatggtcacaaatcacatggagggggagcataagaaactggccgaagcgatattcaagttaacctatcagaacaaagttgtgcgggtacaaagacctacacccaggggaactgtgatggatatcatttcccgccgagaccagcggggtagcggccaggtcgggacctacggactgaatacgtttaccaacatggaggcacaattgatcagacagatggaaggcgagggtgtgttcaagaatatccagcacctcacagttactgaggaagccgctgtgcagaactggctggccagggtcgggcgcgagagactatctcggatggcaatttcaggagatgactgcgtggtaaaaccacttgatgacaggttcgctaacgccctgaccgctctcaatgatatgggcaagatacgtaaggacatccaacagtgggaacccagtaaaggctggaacgattggacacaggttcctttttgctcccatcacttccatgagctgattatgaaggacgggcgagtgttggtcgtgccatgtcgcaatcaggatgaattaatcggtagagcacggattagccaaggagcaggctggtctctgagggagactgcgtgcctcgggaaatcgtatgcccagatgtggtcacttatgtactttcaccgcagagacctgcggctagctgccaacgcaatctgtagcgctgtgccgtcccactgggtccccaccagtaggacgacatggtctatacatgccaagcacgagtggatgaccactgaagacatgctgacagtttggaatcgagtgtggatccgtgagaacccttggatggaagataaaaccccagtagagagctgggaagagattccctatctcggaaagagagaggaccagtggtgcggctccttgatcggtctgacttcacgcgcaacctgggccaagaatattcaggcggctatcaaccaagtgcggagtcttatagggaatgaagagtacacagattacatgccttctatgaaaaggttcagacgcgaagaggaagaggccggagtcctgtggtga

SEQ ID NO: 14415 - RNA, 9876 nt, synthetic construct
  misc_feature 1..9876: note = derived and/or modified CDS sequence (opt3) from DENV-2__GU131902__SS-prME
  source 1..9876: mol_type = other RNA
agcgccggaatgatcattatgctgataccaaccgtgatggctttccacctcactactcggaacggggagcctcatatgatcgtcggcattcaggaaaagggtaaatcccttctgtttaagacggaggacggagttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccacatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaggaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaatggaaatcaaggtaacgccgcagtcaagtattacagaggctgaactgaccggctatggtactgtgaccatggagtgtagccccagaacagggcttgatttcaatgaaatggtcctgttgcaaatggagaacaaagcctggctcgtgcacaggcagtggtttctggacttacctctgccatggctccccggcgcagataagcaggagtctaattggatccagaaggaaacccttgttactttcaaaaaccctcatgctaagaaacaagacgtggtcgtgctgggatcccaggagggcgccatgcacacagcgttgacgggggccaccgaaatacagatgtcaagcggaaatctactgtttactggtcatctcaagtgccggctgcgtatggacaaacttcaactgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccagttaaagctgaattggttcaagaaagggtcttccattggacaaatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacagtataaatttcaacccgagagtccaagcaagttggcctccgctatccagaaagcccaggaagagggcatatgtggtattagatctgtcactaggctcgagaatctgatgtggaagcagatcacacccgaattaaaccacattctggcagagaatgaagttaaactaaccatcatgactggcgatataaaggggatcatgcaagccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaggacgcgttttgtgactctaagttaatgagcgctgccattaaggataatagggcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatccccaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaagctcattgcggagtggtgctgtagatcctgcaccctgccgcctcttaggtatcgcggagaggacggctgttggtacggtatggaaatacggccattgaaagagaaggaagagaatctggtgaactcattagttacagccgggcacggacaggtggataatttcagtctcggcgtactgggtatggctctttttctggaagagatgttgagaacgagggtcggcaccaaacatgcaatcctcctggtggccgtgagcttcgtcactctaattacagggaacatgtcgtttaaggacctgggacgcgttgtggtaatggtgggcgctaccatggccgatgacatcgggatgggagtcacttatctcgcactgcttgcggccttcaaagtgcgacccacatttgctgccggcttgctgttacggaagctcacctccaaggagctgatgatgacgactattggtatcgttcttctgtctcaaagcaccatacctgaaacagtgctagagctcaccgatgcactggctttggggatgatggtcctgaaaatcgtgcgtaatatggaaaagtaccagttagccgttactattatggcaatcctctgcgtgcccaacgccgtcattctgcagaatgcttggaaagtatcatgtacaatccttgcggtggttagtgtgtccccactgttgctcacctctagccagcaaaagacagactggatacctctggccctaactattaaaggactgaaccccaccgcaatcttccttacgacactctccagaaccaataagaaaaggtcatggccactgaacgaggctatcatggccgtcggcatggtgagcattttggccagttctctgttaaagaatgacataccgatgactggccctctcgtagctgggggactgcttaccgtgtgctatgtcctgacaggtcgctccgcagatttggaactcgagcgggccactgacgttaagtgggaggatcaggcggaaatcagcggctcgtcacccattctgtctatcaccattagtgaggacgggtccatgagcatcaaaaacgaagaggaggaacagacgctaacaatactgatcagaaccggacttctcgtgatttctggcctgtttccaatcagcattcccatcactgctgccgcatggtacttgtgggaggtgaagaaacagagggccggtgtcttatgggatgtgccttccccaccccctatggggaaggctgaactggaggacggagcatatcgaataaaacaaaagggcattctcggctactcacagatcggggccggagtttacaaggaaggtacattccacaccatgtggcatgtaactcgcggcgcggtgctgatgcacaaagggaagcggatcgagccgagttgggctgatgtcaaaaaggaccttattagctatggaggcggttggaaactggagggggaatggaaggagggagaagaggtgcaggttttggccctagaaccaggcaagaatcccagagcagtgcagacaaaacctggcctgtttaagaccaacacggggactatcggagccgtctctctcgatttctccccaggtacctcaggcagtcccataattgacaaaaaggggaaagtggtaggactgtacggcaacggtgtcgtgacaaggagcggggcttatgtttccgccatcgcacaaaccgagaagtctattgaggataatcctgaaatcgaggacgatatatttcgtaagcgccggcttacaattatggacttacacccgggagctggcaaaactaagagatacctgcccgccatcgtgagggaagcgatcaaacgaggcctccggaccttgattctggccccaacgcgcgtcgtggcagctgagatggaagaggccctcagagggctgcctatcaggtatcagacacccgctattcgggcagagcatactggacgagaaatagttgaccttatgtgtcacgccaccttcacaatgagactgttgtcgccagtgcgcgtccctaactacaatctaatcattatggatgaggcccatttcaccgaccccgctagcatcgcggcaaggggttatatctcaactcgtgtggaaatgggcgaggccgctgggatttttatgaccgccacaccaccgggatcccgggatcctttcccccagagtaacgcaccaataatcgacgaggaaagagagattcccgaaaggtcttggaatagcggccacgagtgggtaacggattttaagggtaaaactgtgtggttcgttccttccatcaaggccgggaacgacattgctgcgtgcctgcgcaagaatggcaagaaggtcatccaactctcacgaaaaacctttgattctgaatacgtgaagacaagaaccaacgactgggatttcgtggtcactacagacataagcgagatgggcgccaattttaaagcagagcgggtaatcgatccaaggcgctgtatgaagcccgtgattttaaccgacggcgaagaacgtgttatcctggctgggcctatgccggtgacgcatagttccgccgcacagagacggggaaggattggtcgcaaccccaaaaatgaaaacgaccagtacatctatatgggcgagccccttgaaaatgatgaggactgcgcccactggaaggaggctaagatgctgctcgataacataaatactcctgaagggattatccccagcatgttcgagccagaacgagagaaagtcgacgccattgatggagaatacagattgcggggcgaggcgaggaagacatttgtggacctgatgcgcagaggtgatctccctgtttggctggcatataaagtggccgctgaggggatcaactacgccgacaggcggtggtgtttcgatggcataaagaacaatcagatccttgaagagaacgtcgaagtggagatttggaccaaagagggagaacgtaagaagctaaaaccccgctggctggacgctcgaatctattctgatccattggcattaaaggagtttaaagagttcgccgctggcagaaagtcactgaccctcaatctgattactgagatggggaggcttcctacattcatgacccagaaaactcgggacgccctggataacctcgcagtattgcacactgcggaagccggaggtcgcgcttacaatcatgccctgtccgagctaccggagacgctggaaaccctccttctgttaacattgctggcaactgtgaccggcgggatctttctcttcctgatgagtggaagaggcataggtaagatgacacttgggatgtgctgcattatcaccgctagcatcctgctctggtatgcccaaattcagccccactggatcgcagcctcgataattttggagtttttcctgatcgttttactaattccagaacctgagaagcagaggactccccaagacaaccagctgacgtacgtcgtgatcgctatactcaccgtggtcgcggccacaatggcaaatgaaatgggctttcttgagaaaactaagaaagacctgggattgggctctatcgctacccagcagccagagtccaacattctggatatcgacctccggcctgccagcgcctggacactgtacgcagttgctaccactttcgtgacacccatgcttcgacattcaattgaaaatagttctgtaaacgtgtccctcacggccatcgcgaatcaagctaccgtcctgatggggttgggaaagggttggccgctgagcaaaatggatattggcgtgccattactagccatcgggtgttattcacaggttaaccctataactctgacagcagccctccttctgttggtggctcactacgcaattatcggacccggcctgcaggccaaggcgaccagagaggctcagaagcgcgccgcagccggtatcatgaaaaatccaaccgtcgacgggattacagtaatagatctcgaccccatcccttatgatccgaagtttgaaaaacaactgggccaggtgatgcttttaattctgtgcgttactcaggtgctcatgatgaggacgacctgggctttgtgtgaggccctgacactagcaactggacccatcagtaccctgtgggaaggcaacccagggcggttctggaatacaaccattgctgtcagcatggccaacatctttcgtggatcctacctcgcgggcgccggtcttctgttctctataatgaagaatactacgaacacaagaagggggaccggaaacatcggcgagactttgggtgagaaatggaaaagccgcctgaatgcactcggcaaatccgaatttcaaatttataagaagtcagggatccaggaggtggaccggaccctggctaaagaaggaattaagcgaggcgagacagatcaccatgccgtctctagagggagtgcaaaattaaggtggttcgtggagcgcaacatggttactcctgaaggaaaggtggtagaccttggctgcggtagagggggatggtcgtactattgtggcggtctgaaaaatgtgagagaggtcaagggcctcaccaaagggggacccggccacgaggaacctatcccaatgagcacatacgggtggaacctagttcgtctgcagtccggagtggatgtctttttcataccccctgaaaaatgcgacacgttgctgtgtgatattggcgagtcttcaccaaatcccaccgtggaggctggtaggactctccgggtacttaacctggtggaaaattggttgaacaataacacacagttctgcatcaaggttctgaatccgtacatgcctagcgtgatcgagaaaatggaagccctccaacgcaagtatgggggagccttagtccgaaacccactgtccagaaatagtacccatgagatgtactgggtgtctaacgcgagcggcaatattgtctcatccgtgaacatgataagtaggatgcttatcaaccggtttactatgcgccacaaaaaggctacatatgaacccgacgttgacctgggcagcgggaccagaaatattggaatcgagtctgagattcctaacctagatatcataggtaagaggatcgagaaaattaaggaggaacatgagacgtcctggcactacgaccaggatcacccatataaaacctgggcataccatggctcatatgaaacaaagcagactgggagcgcctcgtctatggtaaatggagtggtccgactcctgaccaaaccctgggacgtgttgccgacagttactcagatggctatgaccgatacaacccctttcggccaacagcgggtgtttaaggagaaggtcgacactcgtacgcaggagcccaaagaaggtacaaagaaactgatgaagatcaccgccgagtggctctggaaagaacttgggaagaaaaagactccaagaatgtgtacccgcgaggagttcacaaggaaggtgcggagtaacgcagccctgggagctatttttacggatgaaaataaatggaagtccgcgagagaggccgtagaagacagccgcttctgggagttagtggataaagaaaggaacctgcacttggagggcaagtgcgagacctgtgtttacaatatgatgggcaaacgagaaaagaagctcggggagtttggaaaagcaaagggttcacgggctatctggtacatgtggctgggcgccagattcctagaatttgaggcacttgggttcctgaacgaagaccattggttttccagggaaaattctctcagcggagtcgagggcgaaggtctgcacaaattggggtatattctgcgcgatgtgagtaagaaagagggaggcgccatgtacgctgacgacactgccggctgggatacacgtataaccctcgaagaccttaagaacgaggaaatggtgactaatcacatggagggggagcataagaaactggcggaagcaatcttcaagttaacatatcagaacaaagtcgttcgggtgcaaagacctacccccaggggaacagtaatggatattatctcccgccgagaccagcggggtagcggccaggtggggacttacggactgaatacctttacgaacatggaggcccaattgatcagacagatggaaggcgagggtgtcttcaagaatattcagcacctcaccgtgacagaggaagctgccgttcagaactggctggcaagggtggggcgcgagagactatctcggatggctatatcaggagatgactgcgtcgtgaaaccacttgatgacaggttcgccaacgctctgactgccctcaatgatatgggcaagatccgtaaggacattcaacagtgggaacccagtaaaggctggaacgattggacccaggtacctttttgctcccatcacttccatgagctgatcatgaaggacgggcgagttttggtggtcccatgtcgcaatcaggatgaattaattggtagagcacggatcagccaaggagcgggctggtctctgagggagacagcctgcctcgggaaatcgtatgctcagatgtggtcacttatgtactttcaccgcagagacctgcggctagccgcaaacgctatatgtagcgccgtgccgtcccactgggtgcccacaagtaggaccacgtggtctatccatgcaaagcacgagtggatgacaaccgaagacatgctgactgtctggaatcgagtttggattcgtgagaacccttggatggaagataaaacaccagtggagagctgggaagagatcccctatctcggaaagagagaggaccagtggtgcggctccttgattggtctgacctcacgcgccacttgggcgaagaatatccaggctgccataaaccaagtacggagtcttattgggaatgaagagtacaccgattacatgccttctatgaaaaggttcagacgcgaagaggaagaggcaggagtgctgtggtga

SEQ ID NO: 14416 - RNA, 9876 nt, synthetic construct
  misc_feature 1..9876: note = derived and/or modified CDS sequence (opt3) from DENV-2__GU131924__SS-prME
  source 1..9876: mol_type = other RNA
agcgccggaatgatcattatgctgataccaaccgtgatggctttccacctcactactcggaacggggagcctcatatgatcgtcggtattcaagaaaagggaaaatcccttctgtttaagacggaggacggcgttaatatgtgcaccttgatggcaatggatttaggggaactgtgtgaggacacgatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccacatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaggaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaatggaaatcaaggtaacgccgcagtcaagtattacagaggctgaactgaccggctatggtactgtgaccatggagtgtagccccagaacagggcttgatttcaatgaaatggtcctgttgcaaatggagaacaaagcctggctcgtgcacaggcagtggtttctggacttacctctgccatggctccccggcgcagataagcaggagtctaattggatccagaaggaaacccttgttactttcaaaaaccctcatgctaagaaacaagacgtggtcgtgctgggatcccaggagggcgccatgcacacagcgttgacgggggccaccgaaatacagatgtcaagcggaaatctactgtttactggtcatctcaagtgccggctgcgtatggacaaacttcaactgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccagttaaagctgaattggttcaagaaagggtcttccattggacaaatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacagtataaatttcaacccgagagtccaagcaagttggcctccgctatccagaaagcccaggaagagggcatatgtggtattagatctgtcactaggctcgagaatctgatgtggaagcagatcacacccgaattaaaccacattctggcagagaatgaagttaaactaaccatcatgactggcgatataaaggggatcatgcaagccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaggacgcgttttgtgactctaagttaatgagcgctgccattaaggataatagggcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatccccaaaaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaagctcattaccgagtggtgctgtagatcctgcacactgccgcctcttaggtatcgcggagaggacggctgttggtacggtatggaaatacggccattgaaagagaaggaagagaatctggtgaactcattagttacggcggggcacggacaggtggataatttcagtctcggcgtactgggtatggccctttttctggaagagatgttgagaaccagggtcggcactaaacatgctatcctcctggtggcagtgagcttcgtcacactaattaccgggaacatgtcgtttaaggacctgggacgcgttgtggtaatggtgggcgccactatggctgatgacatcgggatgggagtcacatatctcgccctgcttgcagcgttcaaagtgcgacccacctttgccgctggcttgctgttacggaagctcacgtccaaggagctgatgatgactaccattggtatcgttcttctgtctcaaagcacaatacctgaaaccgtgctagagctcactgatgccctggcattggggatgatggtcctgaaaatcgtgcgtaatatggaaaagtaccagttagctgttacaattatggccatcctctgcgtgcccaacgcagtcattctgcagaatgcctggaaagtatcatgtaccatccttgctgtggttagtgtgtccccactgttgctcacatctagccagcaaaagactgactggatacctctggcgctaaccattaaaggactgaaccccacggccatcttccttacaaccctctccagaactaataagaaaaggtcatggccactgaacgaggcaatcatggctgtcggcatggtgagcattttggccagttctctgttaaagaatgacataccgatgaccggccctctcgtagccgggggactgcttacagtgtgctatgtcctgactggtcgctccgctgatttggaactcgagcgggcaaccgacgttaagtgggaggatcaggccgaaatcagcggctcgtcacccattctgtctatcacgattagtgaggacgggtccatgagcatcaaaaacgaagaggaggaacagacactaaccatactgatcagaactggacttctcgtgatttctggcctgtttccaatcagcattcccatcacagcggctgcctggtacttgtgggaggtgaagaaacagagggccggtgtcttatgggatgtgccttccccaccccctatggggaaggccgaactggaggacggagcttatcgaataaaacaaaagggcattctcggctactcacagatcggggcaggagtttacaaggaaggtaccttccacactatgtggcatgtaacacgcggcgccgtgctgatgcacaaagggaagcggatcgagccgagttgggcggatgtcaaaaaggaccttattagctatggaggcggttggaaactggagggggaatggaaggagggagaagaggtgcaggttttggctctagaaccaggcaagaatcccagagccgtgcagaccaaacctggcctgtttaagacgaacactgggaccatcggagcagtctctctcgatttctccccaggtacatcaggcagtcccataattgacaaaaaggggaaagtggtaggactgtacggcaacggtgtcgtgaccaggagcggggcctatgtttccgctatcgcccaaacagagaagtctattgaggataatcctgaaatcgaggacgatatatttcgtaagcgccggcttactattatggacttacacccgggagcaggcaaaaccaagagatacctgcccgctatcgtgagggaagccatcaaacgaggcctccggacgttgattctggcgccaacacgcgtcgtggccgcagagatggaagaggctctcagagggctgcctatcaggtatcagactcccgccattcgggctgagcataccggacgagaaatagttgaccttatgtgtcacgcaacattcaccatgagactgttgtcgccagtgcgcgtccctaactacaatctaatcattatggatgaggcccatttcactgaccccgccagcatcgctgcgaggggttatatctcaacccgtgtggaaatgggcgaggcagccgggatttttatgacagctacgccaccgggatcccgggatcctttcccccagagtaacgccccaataatcgacgaggaaagagagattcccgaaaggtcttggaatagcggccacgagtgggtaactgattttaagggtaaaaccgtgtggttcgttccttccatcaaggcagggaacgacattgccgcttgcctgcgcaagaatggcaaaaaggtcatccaactctcacgaaaaacatttgattctgaatacgtgaagaccagaactaacgactgggatttcgtggtcacaaccgacataagcgagatgggcgcgaattttaaagccgagcgggtaatcgatccaaggcgctgtatgaagcccgtgattttaacggacggcgaggaacgtgttatcctggcagggcctatgccggtgactcatagttccgctgcccagagacggggaaggattggtcgcaaccccaaaaatgaaaacgaccagtacatctatatgggcgagccccttgaaaatgatgaggactgcgcacactggaaggaggccaagatgctgctcgataacataaatacacctgaagggattatccccagcatgttcgagccagaacgagagaaagtcgacgctattgatggagaatacagattgcggggcgaggccaggaagacctttgtggacctgatgcgcagaggtgatctccctgtttggctggcgtataaagtggcagccgaggggatcaactacgctgacaggcggtggtgtttcgatggcataaagaacaatcagatccttgaagagaacgtcgaagtggagatttggaccaaagagggagaacgtaagaagctaaaaccccgctggctggacgcccgaatctattctgatccattggctttaaaggagtttaaagagttcgcagccggcagaaagtcactgactctcaatctgattacagagatggggaggcttcctaccttcatgacacagaaaactcgggacgctctggataacctcgccgtattgcacacggcagaagcgggaggtcgcgcctacaatcatgctctgtccgagctaccggagaccctggaaacactccttctgttaactttgctggccaccgtgacaggcgggatctttctcttcctgatgagtggaagaggcataggtaagatgacccttgggatgtgctgcattatcactgcaagcatcctgctctggtatgctcagattcagccccactggatcgccgcatcgataattttggagtttttcctgatcgttttactaattccagaacctgagaagcagaggacgccccaagacaaccagctgacctacgtcgtgatcgccatactcacagtggtcgctgcgactatggccaatgaaatgggctttcttgagaaaaccaagaaagacctgggattgggctctatcgcaacacagcagccagagtccaacattctggatatcgacctccggcctgctagcgcctggaccctgtacgccgttgcaactacattcgtgacgcccatgcttcgacattcaattgaaaatagttctgtaaacgtgtccctcaccgctatcgccaatcaagcgactgtcctgatggggttgggaaagggttggccgctgagcaaaatggatattggcgtgccattactagctatcgggtgttattcacaggttaaccctataacactgaccgccgcactccttctgttggtggcccactacgctattatcggacccggcctgcaggcaaaggccaccagagaggcgcagaagcgcgctgccgcaggtatcatgaaaaatccaacagtcgacgggattactgtaatagatctcgaccccatcccttatgatccgaagtttgaaaaacaactgggccaggtgatgcttttaattctgtgcgttacacaggtgctcatgatgaggaccacatgggccttgtgtgaggctctgactctagccaccggacccatcagtacactgtgggaaggcaacccagggcggttctggaataccactattgcagtcagcatggctaacatctttcgtggatcctacctcgccggcgcgggtcttctgttctctataaagaaaaatacgacaaacaccagaagggggactggaaacatcggcgagaccttgggtgagaagtggaaaagccgcctgaatgccctcggcaagtccgaatttcaaatttataagaaatcagggatccaggaggtggaccggacactggcaaaggaaggaattaaacgaggcgagactgatcaccatgctgtctctagagggagtgccaagttaaggtggttcgtggagcgcaacatggttacccctgaaggaaaagtggtagaccttggctgcggtagagggggatggtcgtactattgtggcggtctgaagaatgtgagagaggtcaagggcctcacaaaagggggacccggccacgaggaacctatcccaatgagcacgtacgggtggaacctagttcgtctgcagtccggagtggatgtctttttcataccccctgaaaagtgcgacaccttgctgtgtgatattggcgagtcttcaccaaatcccactgtggaggcaggtaggacactccgggtacttaacctggtggaaaattggttgaacaataacacccagttctgcatcaaagttctgaatccgtacatgcctagcgtgatcgagaagatggaagctctccaacgcaaatatgggggagccttagtccgaaacccactgtccagaaatagtactcatgagatgtactgggtgtctaacgccagcggcaatattgtctcatccgtgaacatgataagtaggatgcttatcaaccggtttacaatgcgccacaagaaggcgacctatgaacccgacgttgacctgggcagcgggacgagaaatattggaatcgagtctgagattcctaacctagatatcataggtaaaaggatcgaaaagattaaagaggaacatgagacctcctggcactacgaccaggatcacccatataagacatgggcttaccatggctcatatgaaactaaacagaccgggagcgcatcgtctatggtaaatggagtggtccgactcctgacaaagccctgggacgtgttgccgactgttacccagatggccatgacagataccactcctttcggccaacagcgggtgtttaaggagaaagtcgacacgcgtacacaggagcccaaggaaggtaccaaaaagctgatgaaaatcactgctgagtggctctggaaggaacttgggaaaaagaagaccccaagaatgtgtacacgcgaggagttcacgaggaaagtgcggagtaacgccgcactgggagccatttttaccgatgaaaataagtggaaatccgctagagaggcggtagaagacagccgcttctgggagttagtggataaggaaaggaacctgcacttggagggcaaatgcgagacttgtgtttacaatatgatgggcaagcgagaaaagaaactcggggagtttggaaaggccaaaggttcacgggcaatctggtacatgtggctgggcgctagattcctagaatttgaggcccttgggttcctgaacgaagaccattggttttccagggaaaattctctcagcggagtcgagggcgaaggtctgcacaagttggggtatattctgcgcgatgtgagtaaaaaggagggaggcgcaatgtacgccgacgacacagctggctgggatacccgtataactctcgaagaccttaagaacgaggaaatcgtgacaaatcacatggagggggagcataaaaagctggccgaagcgattttcaaattaacctatcagaacaaggtcgttcgggtgcaaagacctacacccaggggaactgtaatggatatcatctcccgccgagaccagcggggtagcggccaggtggggacctacggactgaatacgtttaccaacatggaggcacaattgattagacagatggaaggcgagggtgtcttcaaaaatatacagcacctcacagtgactgaggaagccgctgttcagaactggctggccagggtggggcgcgagagactatctcggatggcaatctcaggagatgactgcgtcgtgaagccacttgatgacaggttcgctaacgccctgaccgctctcaatgatatgggcaagattcgtaaagacatccaacagtgggaacccagtaagggctggaacgattggacacaggtacctttttgctcccatcacttccatgagctgattatgaaagacgggcgagttttggtggtcccatgtcgcaatcaggatgaattaatcggtagagcacggataagccaaggagcaggctggtctctgagggagactgcgtgcctcgggaagtcgtatgcccagatgtggtcacttatgtactttcaccgcagagacctgcggctagctgccaacgcaatctgtagcgctgtgccgtcccactgggtgcccaccagtaggacgacatggtctattcatgccaaacacgagtggatgaccactgaagacatgctgacagtctggaatcgagtttggatccgtgagaacccttggatggaagataagaccccagtggagagctgggaagagattccctatctcggaaagagagaggaccagtggtgcggctccttgatcggtctgacttcacgcgcaacctgggccaaaaatatacaggcggctattaaccaagtacggagtcttatcgggaatgaagagtacacagattacatgccttctatgaagaggttcagacgcgaagaggaagaggccggagtgctgtggtga

SEQ ID NO: 14417 - RNA, 9876 nt, synthetic construct
  misc_feature 1..9876: note = derived and/or modified CDS sequence (opt3) from DENV-2__GQ868638__SS-prME
  source 1..9876: mol_type = other RNA
agcgccggaatgatcattatgctgatacccaccgtgatggctttccacctcactactagaaacggggagcctcatatgatcgtcggtattcaagaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggctctcattttcatcctgctgactgcagtggccccatctatgacaatgcgctgcatagggatttcgaacagagattttgttgaaggagtgtcaggtggcagctgggtcgacatcgtgctcgagcacgggagttgtgttaccactatggctaagaataagcccacattagatttcgaactgattaaaaccgaggccaagcagcctgcgacgcttaggaaatattgcatcgaagcaaagttgaccaacacaactaccgagtcccggtgtccaacacaaggagagccctctctgaaagaagaacaggacaagcgctttgtttgcaagcatagcatggtggatcgaggctggggtaatgggtgtggactattcggcaaaggcgggatcgtcacttgcgccatgtttacctgcaagaaaaacatggaaggaaagattgtgcagcctgagaatctcgaatacacaatagtggtcaccccacactccggtgaggagcatgctgttggcaacgacactgggaaacacggaaaggaaatcaaagtgacgccgcagtcaagtattacagaggccgaactgaccggctatggtactgtaaccatggagtgtagccccagaacagggcttgatttcaatgaaatggtgctgttgcaaatggagaacaaggcatggctcgtccacaggcagtggtttctggacttacctctgccatggctccccggcgctgataagcagggatctaattggatccagaaagagacccttgtgactttcaagaaccctcatgccaaaaagcaagacgttgtggtcctgggctcccaggaaggggcgatgcacacagccttgacgggagcaaccgagatacagatgtcaagcggtaatctactgtttactggccatctcaaatgccggctgcgtatggacaaacttcaactgaaggggatgagttactctatgtgtacaggaaaattcaaggtggtaaaagaaattgctgagacccagcacggcacaatcgttatccgcttgcagtatgagggtgatgggtccccatgcaagattcccttcgaaatcatggacctcgagaaaagatacgtgctgggcaggttaattactgtcaacccgatagtgaccgaaaaggatagccctgtcaacatcgaggccgaacccccatttggagactcgtacattatcatcggcgtggagcctgggcagctgaagctaaattggttcaaaaagggatcttccattggtcaaatgtttgagacgaccatgcggggcgctaaacgaatggccatactcggggatacagcatgggacttcggatcactgggcggtgtttttacaagtgtggggaaggcccttcatcagatcttcggcgctatttatggagcggcatttagcggcgtatcctggaccatgaaaatcttgattggggtcatcataacatggatcggaatgaactctcgcagcacttcactgagtgtgtccctcgttctggtgggcattgtcaccctttacctgggtgtgatggtacaggccgatagcgggtgtgtggtttcttggaagaataaggaattgaaatgcggatcaggcatcttcattacggacaacgtccacacatggaccgagcagtataagtttcaacccgaaagtccaagcaaactcgcttccgccatccagaaggcacaggaggaaggtatatgtggcattagatctgtgactaggctggagaatttaatgtggaaacagatcacacccgagctgaaccacattctagccgaaaatgaggtgaagctcaccatcatgactggggatataaaaggaatcatgcaagctggcaagcggtcgctgcgccctcagccaaccgaacttaagtacagctggaaaacatgggggaaggccaaaatgttgtccacggagtcacataaccagaccttcctgattgacggaccggaaactgcagagtgccccaatacaaacagagcgtggaatagtctcgaggtcgaagattatggctttggtgttttcaccacaaacatctggctgaagttaaaagagaagcaggacgctttttgtgactctaagctgatgagcgccgcaattaaagataatagggccgtgcacgctgacatggggtactggatcgaatccgcccttaacgatacttggaagatagagaaagcatcattcattgaggtgaagaattgccattggcctaaaagccacaccttgtggtctaacggagtactcgaatccgagatgatcatcccaaagaacctggctggccccgtcagtcaacacaattatcgtcctggttaccatacgcagacagccggcccatggcacctagggaagctggaaatggacttcgatttttgtgacggaaccactgtgattgttaccgaggattgcggcaaccgggggcccagcctccgaacaactaccgcgtctggaaaactgatcacagaatggtgctgtagatcctgcacgcttccgcctttgaggtaccgcggcgaggacggttgttggtatgggatggagattcggccactgaaggaaaaagaggaaaatttagtgaactcactcgtcaccgccggacatggccaggtggataatttcagtctgggtgttcttggcatggctctgtttttggaggaaatgctcagaactagggtggggacaaagcacgcaatactgctagtagccgtcagcttcgtgaccctgatcactggaaacatgtcgtttaaagacctcggccgcgtggtcgttatggtgggggctacaatgaccgatgacattggaatgggcgtaacgtacctggcccttttggcagcgttcaaggtgcgacccacttttgccgctggtctgttactccggaagctgacctccaaagagcttatgatgacaaccatcgggattgtcctgctatctcaaagcactatccctgagacaatactcgaactgaccgatgccttggcactgggaatgatggtgttaaagatcgttcgtgacatggagaaatatcagctcgctgtgacaattatggccatcctgtgcgtccccaatgcagtgattcttcagaacgcctggaaggtttcatgtactatcctggctgtggtcagtgtatccccattgctcctgacctctagccagcagaagacggactggatacctctagcgctgacaattaagggccttaatcccaccgccatcttcctcactaccctgtccagaacaaacaaaaagaggtcatggccattgaatgaagcaatcatggctgtgggcatggttagcattctggccagttctttactcaagaacgatataccgatgactgggcctctggtggccggaggtcttctgaccgtctgctacgtgttgacgggccgctccgctgacctcgagctggaacgggcaacagatgtaaaatgggaggaccaggccgagatcagcgggtcgtcacccattctatctatcaccattagtgaagatggatccatgagcatcaagaatgaggaagaggagcagactctgacaatacttatcagaaccggcctcctggtgatttctggtttgtttccagtcagcatccccattactgcggctgcctggtatttatgggaagttaaaaagcagagggcaggggtgctgtgggacgtgccttccccaccccctatgggaaaagccgagctcgaagatggcgcttaccgaatcaagcaaaagggcatactggggtattcacagattggagcaggagtctacaaagagggcacattccataccatgtggcacgtgacgcgcggggccgttcttatgcacaagggaaaacggatcgaaccgagttgggcggacgtaaagaaagatctgatcagctacggcggtgggtggaagttggagggagagtggaaggaaggcgaggaagtgcaggtcctagctctggagccaggcaaaaaccccagagccgtgcagactaagcctgggctctttaaaaccaatacaggaaccattggtgcagtttctctggacttctccccaggcacatcagggagtcccatcatagataagaaaggaaaggtggtcggcctttatggtaacggggtggtaactaggagcggagcctacgtctccgctattgcccaaaccgaaaagtctatcgaggacaaccctgagattgaagatgacatctttcgtaaacgccggttaacgataatggacctgcatccgggcgcaggcaagacaaaaagatatctccccgctattgtgagggaggccatcaagcgagggttgcggactctgatcctcgcgccaacccgcgttgtggccgcagaaatggaggaagctctgagaggacttcctattaggtaccagacacccgccatccgggctgagcacaccggtcgagagattgtcgatctgatgtgtcatgcaactttcaccatgagattgctatcgccagtgcgcgttcctaattataacctgataatcatggacgaagcccacttcacagatcccgccagcattgctgcgaggggctacatctcaacgcgtgtggagatgggggaagcagccggaatctttatgactgctaccccaccgggctcccgggaccctttcccccagagtaatgccccaattatagatgaggagagagaaatccccgagaggtcttggaacagcggtcatgaatgggtcacagactttaaagggaagaccgtgtggttcgtaccttccattaaggcaggaaatgatatcgccgcttgcctccgcaaaaacggcaagaaagtgattcaattatcacgaaagacttttgactctgagtatgttaaaacaagaaccaatgattgggacttcgtcgtgacgactgatatcagcgaaatgggcgcgaactttaaggccgaccgggtgatagacccaaggcgctgtatgaaacccgtcatcctgacagatggggaggagcgtgtaattcttgcaggacctatgccggtgacccacagttccgctgcccagagacggggtaggatcggccgcaatccaaagaacgaaaatgaccagtacatttacatgggggagcccctggaaaacgatgaggactgcgcacactggaaggaagccaaaatgctcttggataatatcaacacccctgagggaataattcccagcatgttcgagccagaacgagagaaggttgacgctatcgatggcgaatatagactgcggggtgaggccaggaaaacttttgtggacctcatgcgcagaggggatctgcctgtctggcttgcgtacaaggtggcagccgaaggcattaattatgctgacaggcggtggtgtttcgatggaatcaaaaacaaccagatactagaggagaatgttgaagtggagatctggacaaaggaaggcgagcgtaagaaactgaagccccgctggttggacgcccgaatttactctgatccattagctctgaaagagtttaaggagttcgcagccgggagaaaatcactcaccctgaaccttatcacagagatgggaaggctgcctactttcatgacgcaaaagacccgggacgctctcgacaatttggccgtcctgcatacagcagaagcgggtggccgcgcctataaccacgctctatccgagctgccggaaactctcgagacccttctgttattgacactgctcgccaccgtgactgggggaatttttctgttccttatgagtggcagaggtatcgggaagatgacgctgggcatgtgctgcataattaccgcaagcatcctcttgtggtacgctcagatccagccccattggattgccgcatcgatcatactggagtttttcttaattgtactactgatcccagaacctgagaaacagaggacaccccaagataatcagctcacttatgtggttattgccatccttaccgtcgtggctgcgacaatggccaacgaaatgggatttctggagaagaccaaaaaggacttgggcctggggtctatagcaactcagcagccagaatccaatatcctcgatattgacctgcggcctgctagcgcctggacactttacgccgtggcaacgaccttcgtcactcccatgctccgacactcaatcgagaacagttctgttaatgtgtccctgacagctattgccaaccaagcgaccgtattgatgggactgggtaaaggctggccgttaagcaagatggatatcggggtgccactactggctattggatgttactcacaggtcaatcctatcaccctcacagccgcacttctgttgctggtggcccactatgctataattggccccggtctccaggcaaaggccactagagaggcgcagaaacgcgctgccgcagggatcatgaagaacccaacggttgacggcatcaccgtgattgatctggaccccataccttacgatccgaaatttgaaaagcaacttggacaggtcatgttactgatcctctgcgtaacacaggtgttgatgatgaggactacctgggccctgtgtgaggctctaacactggccaccggccccattagtactctctgggaagggaatccaggacggttctggaacacgacaatcgcagttagcatggctaatatttttcgtggctcctatcttgccggtgcggggctgttgttctctatcatgaaaaacaccactaataccagaaggggaacaggcaacataggtgagactctgggcgaaaagtggaaaagccgcctcaacgccctggggaagtccgagtttcaaacctacaagaaatcaggaatccaggaggtggaccggacattagcaaaggaaggcattaaacgaggggagacggatcatcacgctgtctctagaggaagtgccaaacttaggtggttcgtggaacgcaatatggtcacccctgagggcaaagtggttgacctgggttgcgggcggggaggctggtcgtattactgtggtggcctcaagaacgtgagagaggtaaaggggctaactaaaggaggccccgggcatgaagaacctatcccaatgagcacatatggatggaatctggtgcgtttgcagtccggcgtcgatgtatttttcattccccctgaaaagtgcgacaccctgctctgtgacatcggtgagtcttcaccaaaccccactgtggaagcagggaggacacttcgggtcctgaatttggtggagaactggctgaataacaatacccagttctgcataaaagtactcaacccgtacatgcctagcgtgattgagaagatggaggctttacaacgcaaatacggaggcgccctggttcgaaatccactttccagaaacagtacgcacgagatgtattgggtgtctaatgccagcggcaacatcgtctcatccgtgaatatgatcagtaggatgctgattaaccggtttaccatgcgccataagaaggcgacatacgaacccgatgtcgacctagggagcggaactagaaacataggtatcgagtctgaaattcctaatctcgatatcattggcaaaaggatcgagaagataaaacaggagcacgaaacctcctggcactatgaccaggatcatccatacaagacatgggcttatcacgggtcatacgagactaaacagaccggaagcgcatcgtctatggtgaacggcgttgtacgactgttgacaaagccctgggacgtgctgccgaccgtcactcaaatggccatgacggatacaacccctttcggtcagcagcgggtgtttaaggaaaaagttgacactcgtgctcaggagcccaaggaagggaccaaaaagctcatgaaaatcacagccgagtggctttggaaggagctgggcaagaagaagacgccaagaatgtgtacccgcgaagagttcactaggaaagtgcggagtaatgcagccttaggcgctatttttacagatgaaaacaagtggaaatccgcgagagaggccgtcgaggacagccgcttctgggaactggtggataaggagaggaatttgcatctcgaaggcaaatgcgagacctgtgtatataacatgatggggaagcgagaaaagaaactgggagagtttggtaaggcaaaaggctcacgggctatctggtacatgtggctaggggccagattccttgagtttgaagcactgggattcctcaatgaggaccactggttttccagggaaaactctctgagcggcgtggagggtgaagggttgcacaagctgggatacattctccgcgacgttagtaaaaaggagggcggcgccatgtatgctgatgacactgccgggtgggatacacgtatcacccttgaggacctgaagaatgaagagatggtcacaaaccatatggaaggagagcacaaaaagttagcggaagcaattttcaaactgacttaccaaaataaggtggtgcgggtccagagacctacccccaggggtacggttatggatataatctcccgccgagaccagcggggcagcgggcaagtgggaacctatggcttgaacacatttactaatatggaggcccagctcattagacagatggagggtgaaggggtattcaggaacatccagcatctgaccgctacagaggaagtggccgtccaaaattggctagcacgcgtgggaagagagcggctttctaggatggctatctcaggcgatgactgcgttgtgaaaccactggatgaccgtttcgccaacgctctcactgccctgaacgatatgggcaagattcgaaaggacatacagcagtgggagcccagtaaagggtggaatgattggacccaggtccctttttgctcccaccatttccacgaattgatcatgaaggacggacgcgtgttagtagttccatgtagaaaccaagacgagctgattggtcgggcaaggatcagccagggcgcggggtggtctctccgcgaaacggcctgccttggaaaatcgtacgctcagatgtggtcactgatgtattttcacagacgggatctaaggctggccgcaaatgctatttgtagcgccgtgccgtcccattgggtccccacaagtcgaaccacttggtctatccacgcaaagcatgagtggatgacaaccgaagacatgctcactgtgtggaaccgtgtgtggataagagagaatccttggatggaggataaaaccccagtcgaaagctgggaggaaatcccctacttgggcaagcgcgaggaccagtggtgcggttccctgattgggcttacatcacgggccacgtgggcgaagaacatccaagctgccattaatcaggttaggagtctgatcggaaacgaagagtataccgattacatgccttctatgaaaagattccgccgggaggaagaggaagcaggcgtgctctggtga

SEQ ID NO: 14418 - RNA, 9876 nt, synthetic construct
  misc_feature 1..9876: note = derived and/or modified CDS sequence (opt3) from DENV-2__GU131927__SS-prME
  source 1..9876: mol_type = other RNA
agcgccggcatgatcattatgctgatacccaccgtgatggctttccacctcacgactcgaaacggggagcctcatatgatcgtcggtattcaagaaaagggaaaatcccttctgtttaagacggaggacggcgttaatatgtgcaccttgatggcaatggatttaggggaactgtgtgaggacacaatcacttacaaatgcccattactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggctctcattttcatcctgctgactgcagtggccccatctatgacaatgcgctgcatagggatttcgaacagagattttgttgaaggagtgtcaggtggcagctgggtcgacatcgtgctcgagcacgggagttgtgtaaccactatggctaggaataagcccacattagatttcgaactgattaagaccgaggccaaacagcctgcgacgcttcggaagtattgcatcgaagcaaaattgaccaacacaactaccgagtcccgctgtccaacacaaggagagccctctctgaaggaagaacaggacaaacgatttgtttgcaagcatagcatggtggatagaggctggggtaatgggtgtggactattcggcaagggcgggatcgtcacttgcgccatgtttacctgcaaaaagaacatggaaggaaaaattgtgcagcctgagaatctcgaatacacaatagtggtcaccccacactccggtgaggagcatgctgttggcaacgacactgggaagcacggaaaagaaatcaaggtgacgccgcagtcaagtattacagaggccgaactgaccggctatggtactgtaaccatggagtgtagccccaggacagggcttgatttcaatgaaatggtgctgttgcaaatggagaacaaagcatggctcgtccaccggcagtggtttctggacttacctctgccatggctccccggcgctgataagcaggagtctaattggatccagaaggaaacccttgtgactttcaaaaaccctcatgccaagaaacaagacgttgtggtcctgggatcccaggagggcgcgatgcacacagccttgacgggggcaaccgaaatacagatgtcaagcggaaatctactgtttactggtcatctcaagtgccgtctgcgcatggacaaacttcaactgaagggcatgagttactctatgtgtacagggaagttcaaagtggtaaaggagattgctgagacccagcacggaacaatcgttatcagagtgcagtatgaaggcgatggttccccatgcaaaattcccttcgagatcatggacttggaaaagaggtacgtcctcgggcggctgattactgtgaacccgatagtcaccgagaaagatagccctgtgaacatcgaagccgagcccccatttggcgactcgtacattatcatcggagttgagcctggccagttaaagctgaattggttcaagaaagggtcttccattggacaaatgtttgaaacgaccatgcgaggtgctaagcgcatggccatactaggcgatacagcatgggacttcgggtcactcggaggcgtgtttacaagtgtaggtaaagccctgcatcaggtcttcggggctatctatggcgcggcatttagcggagtgtcctggaccatgaagattcttatcggcgttattatcacatggatagggatgaactctagaagcacttcattgagtgtgtccctggtcctcgtgggaatcgtaaccctgtaccttggcgtgatggttcaggccgatagcggttgtgtcgtgtcttggaaaaataaggagctgaagtgcgggtcaggaattttcatcacggacaacgtgcacacatggaccgaacagtataaatttcaacccgagagtccaagcaagttggcttccgccattcagaaagcacaggaagagggcatctgtggtataaggtctgtcactcggctcgagaatctgatgtggaagcagattacacccgaattaaaccacatcctggccgagaatgaagttaaactaaccattatgactggcgatatcaaggggataatgcaagctggacgcagatcgctcaggcctcagccaaccgagctgaaatacagctggaagacatggggcaaggccaaaatgctttccacggaatcatataaccagaccttcttgatcgacgggccggagactacagagtgccccaatgcaaaccgtgcgtggaatagtctggaagtggaggattacggatttggcgtgttcaccacaaacatttggctcaagctgaaagaaaagcaggacgctttttgtgactctaaattaatgagcgccgcaatcaaggataatcgggccgtacatgctgacatgggttattggattgagtccgccctgaacgatacttggaagatcgagaaagcatcattcatagaagtcaagaattgccactggcctaaaagccataccctttggtctaacggggtgttggagtccgaaatgattatcccaaagagtctcgctggacccgttagccaacacaactaccgacctggctaccacacgcagatcgccggtccatggcatctgggcaaactagagatggacttcgatttttgtgacgggacaaccgtgattgtcactgaagattgcggaaatagaggcccctctctgaggaccacaactgcgtccgggaagctcatcaccgagtggtgctgtcgctcatgcacactgccgcctcttcggtatagaggagaggacggctgttggtacggtatggaaattaggccattgaaggagaaagaagagaacctggtgaatagtttagttacggccgggcacggacaggtggataacttcagcctcggcgtactgggtatggctctttttctggaagagatgttgcgcacccgagtcggcactaagcatgcaatactcctggtggccgtgtcgttcgtcacactaatcaccgggaatatgtcctttaaagacctgggacgggttgtggtaatggtgggcgctactatggccgatgacattgggatgggagtcacatatctcgcactgcttgcggccttcaaggtgcgtcccacctttgctgccggcttgctgttaagaaaactcacgtctaaggagctgatgatgactaccatcggtattgttcttctgagccaatcaacaatccctgaaaccatactagagctcactgatgcactggctttggggatgatggtgctgaagatcgtcaggaacatggaaaaataccagttagccgtgacaattatggcaatcctctgcgttcccaatgccgtgattctgcagaacgcttggaaggtcagttgtaccatccttgcggtagtgtccgtttctccactgttgctcacaagctcccagcagaagactgactggatacctctggccctaaccattaagggactgaatcccacggcaatcttccttacaaccctctcacgcactaacaaaaagcggagctggccactgaatgaggctatcatggccgtgggcatggtcagtattttggcctcttccctgctcaaaaacgacataccgatgaccggccctctagtggctgggggactgcttacagtatgctatgtgctgactggtagaagcgcagatttggaactcgagagggccaccgacgtcaagtgggaggaacaggcggagatctcgggctcatctcccattctgagtatcacgatttccgaagatgggagcatgtctatcaagaatgaggaggaggaacagacactaaccatactgatccgaactggacttctcgttattagcggcctgtttccaatctccattcccatcacagctgccgcatggtacttgtgggaagtgaaaaagcagcgcgccggtgtgttatgggacgtcccttcaccaccccctatggggaaagctgagctggaagatggagcatatcggataaagcaaaaaggcattctcggctacagtcagatcggggccggagtgtacaaggagggtaccttccacactatgtggcatgttacaagaggcgcggtactgatgcacaaggggaaaaggatcgagccgagctgggctgacgtgaagaaagatcttatttcttatggaggcggttggaagctggaaggggagtggaaagaaggagaggaagtccaggtgttggccctagagccaggcaagaacccccgtgcagttcagaccaagcctggcctgtttaaaacgaatactgggaccatcggagccgtgtccctcgacttctcaccaggtacaagtggcagccccataattgataagaaagggaaggtcgtgggactgtacggcaacggtgtagtcacccgctccggggcttatgtgtctgccatcgcacaaacagagaaatcgactgaagacaaccctgagattgaagatgacatctttcggaagagaaggcttaccataatggatttacacccgggagctggcaagacgaaacgatacctgcccgccattgttcgggaggcgatcaagcgcggcctcagaacattgatcctggccccaactagggtggtcgcagctgaaatggaggaggccctccgggggctgcctattcgatatcagacccccgctatcagagcagaacatacaggacgcgagattgtggaccttatgtgtcacgccaccttcactatgaggctgttgagcccagttcgtgtgcctaattacaacctaataatcatggacgaagcccatttcaccgatcccgcttcaattgcggcacggggttatatctccacaagagtcgagatgggcgaggccgctgggatctttatgacggccactccaccgggaagtagggaccctttcccccagtctaatgcaccaattatagatgaagaacgcgaaatccccgagcgaagctggaactccggccacgaatgggtgaccgactttaaaggtaagacagtatggttcgtgccttcaattaaagccgggaatgatatcgctgcgtgcctgagaaagaacggaaagaaagttattcaactctctcggaagacctttgacagcgagtacgtcaaaactaggacaaatgattgggacttcgtggtgaccacggatatcagtgagatgggcgccaactttaaggcagaacgcgtcatagacccacgtagatgtatgaaacccgtaatcttaactgatggcgaggaacgggtgattctggctgggcctatgccggttacacattccagcgccgcacagaggcgcggacgaatcggtagaaatccaaagaacgagaatgaccagtacatttatatgggcgaaccccttgagaacgacgaggattgcgcccactggaaagaagctaagatgctgctcgacaatatcaacacccctgaggggataattccctctatgttcgaaccagagcgggaaaaggtggatgccatcgacggagagtacaggttgcgcggcgaggcgagaaaaacctttgtcgatctgatgaggcggggtgacctccctgtgtggctggcatataaggttgccgctgaagggattaattacgccgatcgtcgctggtgtttcgacggcatcaaaaacaaccagatacttgaggaaaatgtggaggtcgagatctggactaaggaaggagagaggaaaaagctaaagcccagatggctggatgctagaatttattcagacccattggcattaaaagaatttaaggagttcgccgctggccggaaatccctgacactcaacctgatcaccgaaatggggcgccttcctacattcatgactcaaaagacgagagatgccctggacaatctcgcagtgttgcacaccgcggaggccggaggtagggcttacaaccatgccctgagtgagctaccggaaacactggagactctccttctgttaaccttgctggcaacagtaaccggcgggatttttctcttcctgatgagcggacggggcatcggtaaaatgactcttgggatgtgctgcataattacggcttcgatcctgctctggtatgcccagatccagccccactggattgcagcctctatcatattggaatttttcctgattgtgttactaatcccagagcctgaaaagcagcgaacaccccaagataatcagctgacatacgttgtcattgctatcctcactgtggtggcggccaccatggcaaacgagatgggctttcttgagaagactaaaaaggacctgggattgggctccatagctacccagcagccagaaagcaatatcctggacattgatctcagacctgcctcagcctggactctgtacgcagtcgctacaacgttcatcacccccatgcttcgccatagtattgagaactcttccgttaatactagcctcacagccatcgcgaaccaagctaccgtgctgatggggttgggaaaaggttggccgctgtcaaagatggacattggcgtaccattactagccatcgggtgttatagtcaggtgaatcctataaccctgacagcagccctccttctgttggtcgctcactacgcaattatcggacccggcctgcaggccaaagcgactagggaagctcagaagcgggccgcagccggtatcatgaagaacccaacggtggatgggattaccgttatagacctcgatcccatcccttatgacccgaaatttgagaagcaactgggccaggtgatgcttttaattctgtgcgtcacacaggtactcatgatgcgtactacctgggctttgtgtgaagccctgacactagcaaccggacccatcagcactctgtgggagggcaatccagggagattctggaacacgacaattgctgtgtccatggccaatatctttaggggatcttacctcgcgggcgccggtcttctgttcagcataatgaaaaacaccactaatacccgccgggggacaggaaacatcggcgagactttgggtgaaaagtggaaatcccgactgaacgcactcggcaagtcagagtttcaaatttataaaaagtctgggatccaggaagttgatagaaccctggctaaggagggaattaaaaggggcgagacagaccaccatgccgtgagtcgcgggtcggcaaagttacggtggttcgtcgaaagaaatatggtgacgcctgagggaaaagtcgtggatcttggctgcggtcgtgggggatggagctactattgtggcggtctgaagaacgttaaagaagtgaagggcctcaccaaagggggacccggccacgaggaacctatcccaatgtccacttacgggtggaatctagtaaggctgcagtctggagtggacgtctttttcataccccctgagaaatgcgatacattgctgtgtgacattggcgagtcaagcccaaaccccaccgttgaagctggtcggactctccgcgtgcttaatctggtcgagaactggttgaataacaatacacagttctgcatcaaggtgctgaacccgtacatgccttccgtaatcgagaaaatggaggccctccaacgaaagtatgggggagccttagtgagaaatccactgagtaggaactctacccatgaaatgtactgggttagcaatgcgtcaggcaacattgtgtccagtgtcaatatgataagccggatgcttatcaaccgctttacgatgagacacaaaaaggctacctatgagcccgatgtggacctgggctctgggacaaggaacattggaatcgagtccgaagtccctaatctagacattatcggtaagcgaatagagaaaatcaagcaggaacatgagacttcatggcactacgatcaggaccacccatataaaacctgggcataccatggcagctatgaaacaactcagaccgggtcggcctctagtatggtgaacggagttgtacggctcctgacaaagccctgggatgtgttgccgaccgtcactcaaatggctatgacggacacaacccctttcggccagcagcgtgtgtttaaagagaaggttgatactagaacccaggagcccaaggaaggtaccaaaaagctgatgaaaattacggccgagtggctctggaaggaacttgggaaaaagaaaaccccacgcatgtgtactagggaggagttcacacggaaggtgagatccaatgcagccctgggagctatctttaccgacgaaaacaagtggaaaagcgcgcgcgaggccgtcgaagattcaaggttctgggagttagtggacaaggaacgaaatctgcacttggagggcaaatgcgagacttgtgtatacaacatgatgggcaagcgggagaaaaagctcggggagtttggaaaggcaaaaggttccagagctatttggtacatgtggctgggcgccaggttcctagaatttgaggcacttgggttcctgaatgaagatcattggttttctcgcgagaacagcctcagtggagtggagggcgaaggtctgcacaagttggggtatatcctgcgtgacgtttccaaaaaggagggaggcgccatgtacgctgatgacacagccggctgggacacccggattacactcgaagatcttaaaaatgaggaaatggtcactaaccacatgaagggggagcataagaaactggcggaggcaatattcaagttaacctatcaaaataaagtggtgagagtccagaggcctacgccccgcggaaccgttatggacatcattagccgacgggatcagagaggttctggccaagtggggacatacggactgaacacttttaccaatatggaagcccagttgatcaggcagatggagggcgaaggtgtattcaagaacatccagcacctcacagtgactgaggaggtcgctgtgcaaaattggctggcccgcgttgggagagaacggctatcaaggatggcaattagtggagacgattgcgtggtcaaaccacttgacgatcgtttcgctaacgccctgaccgctctcaacgacatgggcaagatacgaaaggatatccagcagtgggagccctccaaaggctggaatgactggacacaggtgcctttttgcagccatcacttccatgaactgattatgaaggatgggcgcgtattggttgtgccatgtagaaaccaagacgagttaatcggacgggccaggatttctcagggtgcaggctggtcgctgcgcgaaacagcgtgcctcgggaaatcatatgcccagatgtggagccttatgtactttcacagacgggatctgaggctagctgccaatgcaatctgttccgctgtcccgagtcactgggtgcccacctctcgaactacatggagcatacatgccaagcacgagtggatgaccactgaggacatgctgaccgtgtggaaccgtgtctggatcagagaaaatccttggatggaggacaaaacaccagttgaatcctgggaggaaattccctatctcggaaagcgcgaggatcagtggtgcggctcattgatcggtctgacgagtcgggcaacctgggccaagaacattcaagcggctatcaatcaggtgaggtctcttatagggaacgaggaatacactgactacatgcctagcatgaaaagattccgccgggaggaagaggaagccggagtactgtggtga

SEQ ID NO: 14419 - RNA, 9876 nt, synthetic construct
  misc_feature 1..9876: note = derived and/or modified CDS sequence (opt3) from DENV-2__GU131928__SS-prME
  source 1..9876: mol_type = other RNA
agcgccggaatgatcattatgctgataccaaccgtgatggctttccacctcactactcggaacggggagcctcatatgatcgtcggtattcaagaaaagggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccacatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaggaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaatggaaatcaaggtaacgccgcagtcaagtattacagaggctgaactgaccggctatggtactgtgaccatggagtgtagccccagaacagggcttgatttcaatgaaatggtcctgttgcaaatggagaacaaagcctggctcgtgcacaggcagtggtttctggacttacctctgccatggctccccggcgcagataagcaggagtctaattggatccagaaggaaacccttgttactttcaaaaaccctcatgctaagaaacaagacgtggtcgtgctgggatcccaggagggcgccatgcacacagcgttgacgggggccaccgaaatacagatgtcaagcggaaatctactgtttactggtcatctcaagtgccggctgcgtatggacaaacttcaactgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccagttaaagctgaattggttcaagaaagggtcttccattggacaaatgtttgaaacgaccatgcggggtgccaagcgaatggctatactaggcgatacagcctgggacttcgggtcactcggaggcgtatttacaagtatcggtaaagcactgcatcaggtcttcggggccatttatggcgtggcttttagcggagtttcctggaccatgaagatccttattggcgtgatcataacatggatcgggatgaactctcgcagcacttcattgagtgtctccctggtgctcgtaggaattgtgaccctgtaccttggcgttatggtccaggcggatagcggttgtgtggtgtcttggaaaaataaggagctgaagtgcgggtcaggaatcttcattacggacaacgtccacacatggaccgaacagtataaatttcaacccgagagtccaagcaagttggcatccgccatccagaaagctcaggaagagggcatatgtggtattagatctgttactaggctcgagaatctgatgtggaagcagatcacacccgaattaaaccacattctggccgagaatgaagtgaaactaaccatcatgactggcgatataaaggggatcatgcaagcaggaaaacggtcgctccgccctcagccaaccgagctgaagtacagctggaagacatggggcaaagccaagatgctttccacggaatcatataaccagaccttcttgattgacgggccggagactgctgagtgccccaatacaaacagagcctggaatagtctggaagtggaggattacggatttggcgtattcaccacaaacatctggctcaaactgaaggaaaaacaggacgcattttgtgactctaagttaatgagcgcggctattaaggataatagggccgtccatgcagacatgggttattggatcgagtccgccctgaacgatacttggaaaatagagaaggcttcattcattgaagtgaaaaattgccactggcctaagagccataccctttggtctaacggggttttggagtccgaaatgatcatccccaagaacctcgccggacccgtgagtcaacacaattaccgtcctggctaccacacgcagattgcaggtccatggcatctgggcaagctagagatggacttcgatttttgtgacgggacaaccgtcatcgtgactgaagattgcggaaaccggggccccagcctgcgaaccacaactgcttctgggaagctcattaccgagtggtgctgtagatcctgcacactgccgcctcttaggtatcgcggagaggacggctgttggtacggtatggaaatacggccattgaaagagaaggaagagaatctggttaactcattagtgacggccgggcacggacaggtagataatttcagtctcggcgtcctgggtatggcgctttttctggaagagatgttgagaaccagggtgggcactaaacatgccatcctcctggtggctgtcagcttcgttacactaattaccgggaacatgtcgtttaaggacctgggacgcgtggtagtgatggtcggcgcaactatggccgatgacatcgggatgggagtgacatatctcgctctgcttgccgcattcaaagttcgacccacctttgcggccggcttgctgttacggaagctcacgtccaaggagctgatgatgactaccattggtatcgtgcttctgtctcaaagcacaatacctgaaaccgtcctagagctcactgatgctctggccttggggatgatggtgctgaaaatcgttcgtaatatggaaaagtaccagttagcagtgacaattatggctatcctctgcgtccccaacgccgtaattctgcagaatgcatggaaagtgtcatgtaccatccttgccgttgtgagtgtctccccactgttgctcacatctagccagcaaaagactgactggatacctctggctctaaccattaaaggactgaaccccacggcgatcttccttacaaccctctccagaactaataagaaaaggtcatggccactgaacgaggccatcatggcagtgggcatggtaagcattttggctagttctctgttaaagaatgacataccgatgaccggccctctcgtggccgggggactgcttacagtctgctatgttctgactggtcgctccgccgatttggaactcgagcgggctaccgacgtgaagtgggaggatcaggcagaaatcagcggctcgtcacccattctgtctatcacgattagtgaggacgggtccatgagcatcaaaaacgaagaggaggaacagacactaaccatactgatcagaactggacttctcgtgatttctggcctgtttccaatcagcattcccatcacagccgcggcttggtacttgtgggaggtcaagaaacagagggccggtgtgttatgggatgttccttccccaccccctatggggaaggcagaactggaggacggagcctatcgaataaaacaaaagggcattctcggctactcacagatcggggctggagtatacaaggaaggtaccttccacactatgtggcatgtgacacgcggcgcagtcctgatgcacaaagggaagcggatcgagccgagttgggccgatgtgaaaaaggaccttattagctatggaggcggttggaaactggagggggaatggaaggagggagaagaggttcaggtgttggcgctagaaccaggcaagaatcccagagctgtccagaccaaacctggcctgtttaagacgaacactgggaccatcggagccgtgtctctcgatttctccccaggtacatcaggcagtcccataattgacaaaaaggggaaagtagtcggactgtacggcaacggtgtggttaccaggagcggggcatatgtgtccgccatcgctcaaacagagaagtctattgaggataatcctgaaatcgaggacgatatatttcgtaagcgccggcttactattatggacttacacccgggagccggcaaaaccaagagatacctgcccgcaatcgtcagggaagctatcaaacgaggcctccggacgttgattctggccccaacacgcgtggttgcggccgagatggaagaggcactcagagggctgcctatcaggtatcagactcccgctattcgggccgagcataccggacgagaaatagtggaccttatgtgtcacgctacattcaccatgagactgttgtcgccagtccgcgtgcctaactacaatctaatcattatggatgaggcacatttcactgaccccgccagcatcgccgctaggggttatatctcaacccgtgtagaaatgggcgaggcggcagggatttttatgacagccacgccaccgggatcccgggatcctttcccccagagtaacgctccaataatcgacgaggaaagagagattcccgaaaggtcttggaatagcggccacgagtgggtgactgattttaagggtaaaaccgtttggttcgtcccttccatcaaggccgggaacgacattgcagcctgcctgcgcaagaatggcaagaaggtgatccaactctcacgaaaaacatttgattctgaatacgtgaagaccagaactaacgactgggatttcgtcgtaacaaccgacataagcgagatgggcgctaattttaaagcggagcgggtgatcgatccaaggcgctgtatgaagcccgttattttaacggacggcgaagaacgtgtgatcctggccgggcctatgccggtcactcatagttccgcagctcagagacggggaaggattggtcgcaaccccaaaaatgaaaacgaccagtacatctatatgggcgagccccttgaaaatgatgaggactgcgcccactggaaggaggcaaagatgctgctcgataacataaatacacctgaagggattatccccagcatgttcgagccagaacgagagaaagtggacgccattgatggagaatacagattgcggggcgaggctaggaagacctttgttgacctgatgcgcagaggtgatctccctgtgtggctggcctataaagtcgcggcagaggggatcaactacgccgacaggcggtggtgtttcgatggcataaagaacaatcagatccttgaagagaacgtggaagtagagatttggaccaaagagggagaacgtaagaagctaaaaccccgctggctggacgctcgaatctattctgatccattggccttaaaggagtttaaagagttcgctgcaggcagaaagtcactgactctcaatctgattacagagatggggaggcttcctaccttcatgacacagaaaactcgggacgccctggataacctcgctgtgttgcacacggccgaagcaggaggtcgcgcgtacaatcatgccctgtccgagctaccggagaccctggaaacactccttctgttaactttgctggctaccgttacaggcgggatctttctcttcctgatgagtggaagaggcataggtaagatgacccttgggatgtgctgcattatcactgccagcatcctgctctggtatgcacagattcagccccactggatcgctgcctcgataattttggagtttttcctgatcgtcttactaattccagaacctgagaagcagaggacgccccaagacaaccagctgacctacgtggtgatcgcaatactcacagtcgttgccgctactatggcgaatgaaatgggctttcttgagaaaaccaagaaagacctgggattgggctctatcgccacacagcagccagagtccaacattctggatatcgacctccggcctgcaagcgcttggaccctgtacgccgtggccactacattcgtaacgcccatgcttcgacattcaattgaaaatagttctgtgaacgtctccctcaccgcaatcgctaatcaagccactgtgctgatggggttgggaaagggttggccgctgagcaaaatggatattggcgttccattactagcgatcgggtgttattcacaggtgaaccctataacactgaccgctgccctccttctgttggtcgcacactacgccattatcggacccggcctgcaggctaaggcaaccagagaggcccagaagcgcgcggctgccggtatcatgaaaaatccaacagtagacgggattactgtgatagatctcgaccccatcccttatgatccgaagtttgaaaaacaactgggccaggttatgcttttaattctgtgcgtgacgcaggtcctcatgatgaggaccacatgggcattgtgtgaggccctgactctagctaccggacccatcagtacactgtgggaaggcaacccagggcggttctggaataccactattgccgtgagcatggcaaacatctttcgtggatcctacctcgctggcgccggtcttctgttctctataatgaagaatacgacaaacaccagaagggggactggaaacatcggcgagaccttgggtgagaaatggaaaagccgcctgaatgcgctcggcaaatccgaatttcaaatttataagaagtcagggatccaggaggtcgaccggacactggccaaagaaggaattaagcgaggcgagactgatcaccatgcagtgtctagagggagtgctaaattaaggtggttcgttgagcgcaacatggtgacccctgaaggaaaggtagtggaccttggctgcggtagagggggatggtcgtactattgtggcggtctgaaaaatgtcagagaggttaagggcctcacaaaagggggacccggccacgaggaacctatcccaatgagcacgtacgggtggaacctagtgcgtctgcagtccggagtcgatgtgtttttcataccccctgaaaaatgcgacaccttgctgtgtgatattggcgagtcttcaccaaatcccactgtagaggccggtaggacactccgggtgcttaacctggttgaaaattggttgaacaataacacccagttctgcatcaaggtgctgaatccgtacatgcctagcgtcatcgagaaaatggaagcactccaacgcaagtatgggggagctttagtgcgaaacccactgtccagaaatagtactcatgagatgtactgggtctctaacgccagcggcaatattgtgtcatccgttaacatgataagtaggatgcttatcaaccggtttacaatgcgccacaaaaaggccacctatgaacccgacgtagacctgggcagcgggacgagaaatattggaatcgagtctgagacccctaacctagatattatcggtaagaggatagagaaaatcaaggaggaacatgagacatcctggcactacgaccaggatcacccatataaaacttgggcgtaccatggctcatatgaaaccaagcagacagggagcgcttcgtctatggtgaatggagtcgtgcgactcctgactaaaccctgggacgttttgccgaccgtgacacagatggcaatgaccgatactacgcctttcggccaacagcgggtctttaaggagaaggtggacacacgtacccaggagcccaaagaaggtactaagaaactgatgaagattaccgccgagtggctctggaaagaacttgggaagaaaaagacaccaagaatgtgtacgcgcgaggagttcaccaggaaggtacggagtaacgctgccctgggagcaatctttactgatgaaaataaatggaagtccgccagagaggctgtggaagacagccgcttctgggagttagttgataaagaaaggaacctgcacttggagggcaagtgcgagacatgtgtctacaatatgatgggcaaacgagaaaagaagctcggggagtttggaaaagcgaagggttcacgggccatttggtacatgtggctgggcgcaagattcctagaatttgaggctcttgggttcctgaacgaagaccattggttttccagggaaaattctctcagcggagtggagggcgaaggtctgcacaaattggggtatatcctgcgcgatgtgagtaagaaagagggaggcgccatgtacgcagacgacaccgccggctgggatactcgtattacactcgaagaccttaagaacgaggaaatggtcaccaatcacatggagggggagcataagaaactggctgaagccatattcaagttaacatatcagaacaaagttgtgcgggtacaaagacctactcccaggggaaccgtgatggatatcatttcccgccgagaccagcggggtagcggccaggtcgggacgtacggactgaatacctttacaaacatggaggcgcaattgatcagacagatggaaggcgagggtgtgttcaagaatatccagcacctcactgttaccgaggaagcagccgtgcagaactggctggctagggtcgggcgcgagagactatctcggatggccatttcaggagatgactgcgtggtaaaaccacttgatgacaggttcgcaaacgctctgacagccctcaatgatatgggcaagatacgtaaggacatccaacagtgggaacccagtaaaggctggaacgattggactcaggttcctttttgctcccatcacttccatgagctgattatgaaggacgggcgagtgttggtcgtgccatgtcgcaatcaggatgaattaatcggtagagctcggattagccaaggagccggctggtctctgagggagaccgcatgcctcgggaaatcgtatgcgcagatgtggtcacttatgtactttcaccgcagagacctgcggctagccgctaacgccatctgtagcgcagtgccgtcccactgggtccccacgagtaggacaacctggtctatacatgctaagcacgagtggatgactacagaagacatgctgaccgtttggaatcgagtgtggatccgtgagaacccttggatggaagataaaactccagtagagagctgggaagagattccctatctcggaaagagagaggaccagtggtgcggctccttgatcggtctgacctcacgcgccacatgggcaaagaatattcaggccgcgatcaaccaagtgcggagtcttatagggaatgaagagtacacggattacatgccttctatgaaaaggttcagacgcgaagaggaagaggctggagtcctgtggtga

SEQ ID NO: 14420 - RNA, 9876 nt, synthetic construct
  misc_feature 1..9876: note = derived and/or modified CDS sequence (opt3) from DENV-2__GU131929__SS-prME
  source 1..9876: mol_type = other RNA
agcgccggaatgataattatgctgataccaaccgtgatggctttccacctcactactagaaacggggagcctcatatgatcgtcgggattcaagaaaagggtaaatcccttctgtttaagacggaggacggagttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccacatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatacgctgcattgggatctcgaacagagattttgtggaaggagtctcaggtggcagctgggtggacattgtactcgagcacgggagttgtgttaccactatggccaagaataagcccacattagatttcgaactgatcaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggattgtgacttgcgcaatgtttacctgcaagaaaaacatggaaggaaagatagtgcagcctgagaatctcgaatacacaatcgtcgttaccccacactccggtgaggagcatgccgtgggcaacgacactgggaaacacggaatggaaattaaggtaacgccgcagtcaagtatcacagaggctgaactgaccggctatggtactgtgaccatggagtgtagccccagaacagggcttgatttcaatgaaatggtcctgttgcaaatggagaacaaagcctggctcgtgcacaggcagtggtttctggacttacctctgccatggctccccggcgcagataagcaggagtctaattggatacagaaggaaacccttgttactttcaaaaaccctcatgctaagaaacaagacgtggtcgtgctgggatcccaggagggcgccatgcacacagcgttgacgggggccaccgaaattcagatgtcaagcggaaatctactgtttactggtcatctcaagtgccggctgcgtatggacaaacttcaactgaagggcatgagttactctatgtgtacagggaagttcaaagtagttaaggagatcgcagagacccagcacggaacaatcgtgattcgcgtccagtatgaaggcgatggttccccatgcaaaatccccttcgagattatggacttggaaaagagatacgtgctcgggaggctgataactgtcaacccgatcgtgaccgagaaagatagccctgttaacattgaagctgagcccccatttggcgactcgtacatcatcattggagtggagcctggccagttaaagctgaattggttcaagaaagggtcttccataggacaaatgtttgaaacgaccatgcggggtgccaagcgaatggctatcctaggcgatacagcctgggacttcgggtcactcggaggcgtatttacaagtattggtaaagcactgcatcaggtcttcggggccatctatggcgtggcttttagcggagtttcctggaccatgaagattcttatcggcgtgataatcacatggattgggatgaactctcgcagcacttcattgagtgtctccctggtgctcgtaggaatcgtgaccctgtaccttggcgttatggtccaggcggatagcggttgtgtggtgtcttggaaaaataaggagctgaagtgcgggtcaggaattttcatcacggacaacgtccacacatggaccgaacagtataaatttcaacccgagagtccaagcaagttggcatccgccatacagaaagctcaggaagagggcatttgtggtatcagatctgttactaggctcgagaatctgatgtggaagcagattacacccgaattaaaccacatcctggccgagaatgaagtgaaactaaccataatgactggcgatatcaaggggattatgcaagcaggaaaacggtcgctccgccctcagccaaccgagctgaagtacagctggaagacatggggcaaagccaagatgcttttcacggaatcctataaccagacctttttgatcgacgggccggagactgctgagtgccccaatacaaacagagcctggaactcactggaagtggaggattacggattcggcgtatttaccacaaacatttggctcaaactgaaggaaaaacaggacgcattctgtgacagtaagttaatgtctgcggctatcaaggataatagggccgtccatgcagacatgggttattggatagagagcgccctgaacgatacttggaaaattgagaaggcttccttcatcgaagtgaaaaattgccactggcctaagtcacataccctttggagcaacggggttttggagtctgaaatgatcattcccaagaatctcgccggacccgtgtcccaacacaattaccgtcctggctaccacacgcagatcgcaggtccatggcatctgggcaagctagagatggactttgatttctgtgacgggacaaccgtcattgtgactgaagattgcggaaaccggggccccagtctgcgaaccacaactgctagcgggaagctcataaccgagtggtgctgtagatcttgcacactgccgcctcttaggtatcgcggagaggacggctgttggtacggtatggaaatccggccattgaaagagaaggaagagaatctggttaactccttagtgacggccgggcacggacaggtagataatttttcactcggcgtcctgggtatggcgcttttcctggaagagatgttgagaaccagggtgggcactaaacatgccattctcctggtggctgtcagttttgttacactaatcaccgggaacatgagcttcaaggacctgggacgcgtggtagtgatggtcggcgcaactatggccgatgacattgggatgggagtgacatatctcgctctgcttgccgcatttaaagttcgacccaccttcgcggccggcttgctgttacggaagctcacgtcgaaggagctgatgatgactaccatcggtatagtgcttctgtcccaatctacaatccctgaaaccgtcctagagctcactgatgctctggccttggggatgatggtgctgaaaattgttcgtaatatggaaaagtaccagttagcagtgacaatcatggctattctctgcgtccccaacgccgtaatcctgcagaatgcatggaaagtgagctgtaccatacttgccgttgtgtcagtcagtccactgttgctcacatcctctcagcaaaagactgactggattcctctggctctaaccatcaaaggactgaaccccacggcgatctttcttacaaccctcagcagaactaataagaaaaggtcctggccactgaacgaggccattatggcagtgggcatggtatcaatattggctagcagtctgttaaagaatgacatcccgatgaccggccctctcgtggccgggggactgcttacagtctgctatgttctgactggtcgctctgccgatttggaactcgagcgggctaccgacgtgaagtgggaggatcaggcagaaatttccggcagctcgcccatcctgtcaattacgatctctgaggacgggagtatgtccatcaaaaatgaagaggaggaacagacactaaccatcctgattagaactggacttctcgtgatcagcggcctgttcccaatttctatccccataacagccgcggcttggtacttgtgggaggtcaagaaacagagggccggtgtgttatgggatgttcctagcccaccccctatggggaaggcagaactggaggacggagcctatcgaattaaacaaaagggcatcctcggctactcccagatcggggctggagtatacaaggaaggtacctttcacactatgtggcatgtgacacgcggcgcagtcctgatgcacaaagggaagcggattgagccgtcatgggccgatgtgaaaaaggaccttatcagttatggaggcggttggaaactggagggggaatggaaggagggagaagaggttcaggtgttggcgctagaaccaggcaagaatcccagagctgtccagaccaaacctggcctgttcaagacgaacactgggaccataggagccgtgagcctcgatttttctccaggtacatccggctcacccattatcgacaaaaaggggaaagtagtcggactgtacggcaacggtgtggttaccaggagtggggcatatgtgagcgccattgctcaaacagagaagtccatcgaggataatcctgaaatagaggacgatattttccgtaagcgccggcttactatcatggacttacacccgggagccggcaaaaccaagagatacctgcccgcaatcgtcagggaagctattaaacgaggcctccggacgttgatcctggccccaacacgcgtggttgcggccgagatggaagaggcactcagagggctgcctattaggtatcagactcccgctatacgggccgagcataccggacgagaaatcgtggaccttatgtgtcacgctacattcaccatgagactgttgtctccagtccgcgtgcctaactacaatctaattatcatggatgaggcacattttactgaccccgcctcgatcgccgctaggggttatattagcacccgtgtagaaatgggcgaggcggcagggatattcatgacagccacgccaccgggatcacgggatccttttccccagtccaacgctccaatcattgacgaggaaagagagatccccgaaaggagttggaactctggccacgagtgggtgactgatttcaagggtaaaaccgtttggtttgtccctagcattaaggccgggaacgacatcgcagcctgcctgcgcaagaatggcaaaaaggtgatacaactctcccgaaaaacattcgattcagaatacgtgaagaccagaactaacgactgggattttgtcgtaacaaccgacatctctgagatgggcgctaatttcaaagcggagcgggtgattgatccaaggcgctgtatgaagcccgttatcttaacggacggcgaagaacgtgtgattctggccgggcctatgccggtcactcatagcagtgcagctcagagacggggaaggatcggtcgcaaccccaaaaatgaaaacgaccagtacatatatatgggcgagccccttgaaaatgatgaggactgcgcccactggaaggaggcaaagatgctgctcgataacattaatacacctgaagggatcattccctccatgtttgagccagaacgagagaaagtggacgccatcgatggagaatacagattgcggggcgaggctaggaagaccttcgttgacctgatgcgcagaggtgatctccctgtgtggctggcctataaagtcgcggcagaggggataaactacgccgacaggcggtggtgttttgatggcatcaagaacaatcagattcttgaagagaacgtggaagtagagatctggaccaaagagggagaacgtaagaagctaaaaccccgctggctggacgctcgaatttatagcgatccattggccttaaaggagttcaaagagttcgctgcaggcagaaagtctctgactctcaatctgatcacagagatggggaggcttcctacctttatgacacagaaaactcgggacgccctggataacctcgctgtgttgcacacggccgaagcaggaggtcgcgcgtacaatcatgccctgtcagagctaccggagaccctggaaacactccttctgttaactttgctggctaccgttacaggcgggatattcctctttctgatgtccggaagaggcattggtaagatgacccttgggatgtgctgcatcatcactgccagtattctgctctggtatgcacagatccagccccactggatagctgccagcattatcttggagttctttctgattgtcttactaatcccagaacctgagaagcagaggacgccccaagacaaccagctgacctacgtggtgatagcaatcctcacagtcgttgccgctactatggcgaatgaaatgggcttccttgagaaaaccaagaaagacctgggattgggctcgattgccacacagcagccagagtctaacatcctggatattgacctccggcctgcatccgcttggaccctgtacgccgtggccactacatttgtaacgcccatgcttcgacatagcatcgaaaattcaagtgtgaacgtctctctcaccgcaattgctaatcaagccactgtgctgatggggttgggaaagggttggccgctgtccaaaatggatatcggcgttccattactagcgatagggtgttatagccaggtgaaccctattacactgaccgctgccctccttctgttggtcgcacactacgccatcatcggacccggcctgcaggctaaggcaaccagagaggcccagaagcgcgcggctgccggtattatgaaaaatccaacagtagacgggataactgtgatcgatctcgaccccattccttatgatccgaagttcgaaaaacaactgggccaggttatgcttttaatcctgtgcgtgacgcaggtcctcatgatgaggaccacatgggcattgtgtgaggccctgactctagctaccggacccatttcaacactgtgggaaggcaacccagggcggttttggaataccactatcgccgtgagtatggcaaacatattccgtggaagctacctcgctggcgccggtcttctgttttccatcatgaagaatacgacaaacaccagaagggggactggaaacattggcgagaccttgggtgagaaatggaagtctcgcctgaatgcgctcggcaaaagcgagttccaaatctataagaagtccgggattcaggaggtcgaccggacactggccaaagaaggaatcaagcgaggcgagactgatcaccatgcagtgtcaagagggtctgctaaattaaggtggtttgttgagcgcaacatggtgacccctgaaggaaaggtagtggaccttggctgcggtcggggaggatggagttactattgtggcggtctgaaaaatgtcagagaggttaagggcctcacaaaagggggacccggccacgaagaacctataccaatgtcgacgtacgggtggaacctagtgcgtctgcagagcggagtcgatgtgttcttcattccccctgaaaaatgcgacaccttgctgtgtgatatcggcgagtcctctccaaatcccactgtagaggccggtaggacactccgggtgcttaacctggttgaaaattggttgaacaataacacccagttttgcatcaaggtgctgaatccgtacatgccttcagtcattgagaaaatggaagcactccaacgcaagtatgggggagctttagtgcgaaacccactgagcagaaattccactcatgagatgtactgggtcagtaacgcctctggcaatatagtgagctcagttaacatgatctccaggatgcttattaaccggttcacaatgcgccacaaaaaggccacctatgaacccgacgtagacctgggcagtgggacgagaaatatcggaattgagagcgagacccctaacctagatatcataggtaagaggatcgagaaaattaaggaggaacatgagacatcttggcactacgaccaggatcacccatataaaacttgggcgtaccatggctcctatgaaaccaagcagacagggtcagctagctcgatggtgaatggagtcgtgcgactcctgactaaaccctgggacgttttgccgaccgtgacacagatggcaatgaccgatactacgccttttggccaacagcgggtcttcaaggagaaggtggacacacgtacccaggagcccaaagaaggtactaagaaactgatgaagatcaccgccgagtggctctggaaagaacttgggaagaaaaagacaccaagaatgtgtacgcgcgaggagtttaccaggaaggtacggtctaacgctgccctgggagcaattttcactgatgaaaataaatggaagagtgccagagaggctgtggaagactcccgcttttgggagttagttgataaagaaaggaacctgcacttggagggcaagtgcgagacatgtgtctacaatatgatgggcaaacgagaaaagaagctcggggagttcggaaaagcgaagggtagccgggccatctggtacatgtggctgggcgcaagatttctagagttcgaggctcttgggtttctgaacgaagaccattggttctcaagggaaaattccctctctggagtggagggcgaaggtctgcacaaattggggtatattctgcgcgatgtgagcaagaaagagggaggcgccatgtacgcagacgacaccgccggctgggatactcgtataacactcgaagaccttaagaacgaggaaatggtcaccaatcacatggagggggagcataagaaactggctgaagccatctttaagttaacatatcagaacaaagttgtgcgggtacaaagacctactcccaggggaaccgtgatggatattatcagtcgccgagaccagcggggttccggccaggtcgggacgtacggactgaataccttcacaaacatggaggcgcaattgatcagacagatggaaggcgagggtgtgttcaagaatattcagcacctcactgttaccgaggaagcagccgtgcagaactggctggctagggtcgggcgcgagagactaagccggatggccatatctggagatgactgcgtggtaaaaccacttgatgacaggtttgcaaacgctctgacagccctcaatgatatgggcaagatccgtaaggacattcaacagtgggaaccctcaaaaggctggaacgattggactcaggttcctttctgcagtcatcactttcatgagctgatcatgaaggacgggcgagtgttggtcgtgccatgtcgcaatcaggatgaattaattggcagagctcggatctcccaaggtgccggctggagcctgagggagaccgcatgcctcgggaaatcttatgcgcagatgtggtcgcttatgtacttccaccgcagagacctgcggctagccgctaacgccatatgttcagcagtgccgagccactgggtccccacgtccaggacaacctggagtatccatgctaagcacgagtggatgactacagaagacatgctgaccgtttggaatcgagtgtggattcgtgagaacccttggatggaagataaaactccagtagagtcttgggaagagatcccctatctcggaaagagagaggaccagtggtgcggcagcttgattggtctgacctcccgcgccacatgggcaaagaatatccaggccgcgataaaccaagtgcggtcacttattgggaatgaagagtacacggattacatgcctagtatgaaaaggtttagacgcgaagaggaagaggctggagtcctgtggtga

SEQ ID NO: 14421 - RNA, 9876 nt, synthetic construct
  misc_feature 1..9876: note = derived and/or modified CDS sequence (opt3) from DENV-2__GU131930__SS-prME
  source 1..9876: mol_type = other RNA
agcgcaggaatgatcattatgctgatacccaccgtgatggctttccacctcaccactagaaacggggagcctcatatgatcgtcggcattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggctctcattttcatcctgctgactgcagtggccccatctatgacaatgcgctgcatagggatttcgaacagagattttgttgaaggagtgtcaggtggcagctgggtcgacatcgtgctcgagcacgggagttgtgtaaccactatggctaagaataagcccacattagatttcgaactgattaaaaccgaggccaagcagcctgcgacgcttaggaaatattgcatcgaagcaaagttgaccaacacaactaccgagtcccggtgtccaacacaaggagagccctctctgaaagaggaacaggacaagcgctttgtttgcaagcatagcatggtggatcgaggctggggtaatgggtgtggactattcggcaaaggcgggatcgtcacttgcgccatgtttacctgcaagaaaaacatggaaggaaagattgtgcagcctgagaatctcgaatacacaatagtggtcaccccacactccggtgaggagcatgctgttggcaacgacactgggaaacacggaaaggaaatcaaagtgacgccgcagtcaagtattacagaggccgaactgaccggctatggtactgtaaccatggagtgtagccccagaacagggcttgatttcaatgaaatggtgctgttgcaaatggagtctaaggcatggctcgtccacaggcagtggtttctggacttacctctgccatggctccccggcgctgataagcagggatccaactggatccagaaagagacccttgtgactttcaagaatcctcatgccaaaaagcaagacgttgtggtcctgggctcacaggaaggggcgatgcacacagccttgacgggagcaaccgagatacagatgagcagtggtaacctactgtttactggccatctcaaatgccggctgcgtatggacaaacttcaactgaaggggatgtcttactccatgtgtacaggaaaattcaaggtggtaaaagaaattgctgagacccagcacggcacaatcgttatccgcgtgcagtatgagggtgatgggagcccatgcaagattcccttcgaaatcatggacttggagaaaagatacgtcctcggcaggctgattactgtgaatccgatagtcaccgaaaaggattcgcctgtgaacatcgaggccgaacccccatttggagactcttacattatcatcggcgttgagcctgggcagttaaagctgaactggttcaaaaagggatcctcaattggtcaaatgtttgagacgaccatgcggggcgctaaacgaatggccatactaggggatacagcatgggacttcggaagtctcggcggtgtgtttactagcatcgggaaggccctgcatcaggtattcggcgctatttatggagcggcattttccggcgtctcttggaccatgaaaatccttattggggtgatcataacatggatcggaatgaatagccgctcaacaagtttgtccgttagcctggtgctcgtcggcattgtgaccctgtaccttggtgtaatggtgcaggccgattctgggtgtgttgtctcatggaagaacaaggaactgaaatgcggaagtggcatcttcattacggacaatgtgcacacatggaccgagcagtataagtttcaacccgaaagcccatccaaattggcttctgccatccagaaggcacaggaggaaggtatatgtggcattagatcggtgactaggctcgagaacctgatgtggaaacagatcacacccgagttaaatcacattctggccgaaaacgaggtcaagctaaccatcatgactggggatataaaaggaatcatgcaagctggcaagcggagcctccgccctcagccaaccgaactgaagtactcctggaaaacatgggggaaggccaaaatgctttcaacggagagtcataatcagaccttcttgattgacggaccggaaactgcagagtgccccaacacaaatagagcgtggaactctctggaggttgaagattatggctttggtgtgttcaccacaaatatctggctcaagctgaaagagaagcaggacgctttttgtgacagcaagttaatgtccgccgcaattaaagataacagggccgtgcacgctgacatggggtactggatcgaatcagccctgaatgatacttggaagatagagaaagccagcttcattgaggtaaagaactgccattggcctaaatctcacaccctttggtccaatggagtcttggaaagtgagatgatcatcccaaagaacctcgctggccccgtgagccaacacaactatcgtcctggttaccatacgcagacagccggcccatggcacctggggaagctagaaatggacttcgatttttgtgacggaaccactgttattgtgaccgaggattgcggcaatcgggggccctctctgcgaacaactaccgcgtccggaaaactcatcacagaatggtgctgtagatcatgcacgctgccgcctcttaggtaccgcggcgaggacggttgttggtatgggatggagattcggccattgaaggaaaaagaggaaaacctggtcaatagtttagtgaccgccggacatggccaggttgataacttcagcctcggtgtgctgggcatggctctttttctggaggaaatgttgagaactagggtagggacaaagcacgcaatactcctggtcgccgtgtcgttcgtgaccctaatcactggaaatatgtcctttaaagacctgggccgcgtcgttgtgatggtagggacaaccatgacggatgacattggaatgggcgtgacttacctcgctctgcttgccgcattcaaggtccgacccacctttgcggccggtttgctgttacggaagctcacatctaaagagctgatgatgaccactatcgggattgtgcttctgagccaatcaacaatccctgagaccatactagaactcacagatgctctggccttgggaatgatggttctgaagatcgtgcgtgacatggagaaatatcagttagcagtcactattatggctatcctctgcgtgcccaacgccgttattctgcagaatgcatggaaggtgagttgtaccatccttgccgtcgtatccgtgtctccactgttgctcacgagctcccagcaaaagactgactggatacctctggctctaaccattaagggcctgaaccccactgcgatcttccttaccacactctcaagaactaataaaaagaggagctggccactgaacgaagccatcatggcagttggcatggtgagtattttggcttcttccctgttaaagaatgatataccgatgaccgggcctctcgtcgccggaggtctgcttacggtgtgctacgtactgacaggccgcagcgccgacttggagctcgaacgggctaccgatgtgaaatgggaggaccaggcagagatctcggggtcatctcccattctgagtatcactatttccgaagatggaagcatgtctatcaagaacgaggaagaggagcagacactaaccatactgatcagaactggccttctcgtcattagcggtctgtttccagtttccatccccattacagccgcggcttggtatttgtgggaagtgaaaaagcagagggccggggtgttatgggacgtcccttcaccaccccctatgggaaaagcagagctggaagatggcgcctaccgaatcaagcaaaagggcatactcgggtatagtcagattggagctggtgtgtacaaagagggcaccttccatacgatgtggcacgttactcgcggggcagtactgatgcacaagggaaaacggatcgaaccgagctgggccgacgtgaagaaagatcttatctcttacggcggtgggtggaagctggagggagagtggaaggaaggcgaggaagtccaggtgttggcgctagagccaggcaaaaatcccagagctgttcagaccaagcctgggctgtttaaaacaaacaccggaacaattggtgccgtgtccctcgacttctcaccaggcacaagtgggagccccatcatagataagaaaggaaaggtcgtgggcctgtatggtaatggggtagtcaccaggtccggagcatacgtgtctgccattgctcaaacggaaaagtcgatcgaggacaaccctgagattgaagatgacatctttcgtaaacgccggcttacaataatggacttacatccgggcgccggcaagactaaaagatatctgcccgcaattgttagggaggctatcaagcgagggctccggaccttgatcctggccccaacacgcgtggtcgcggccgaaatggaggaagcactcagaggactgcctattaggtaccagacccccgctatccgggccgagcacactggtcgagagattgtggatcttatgtgtcatgctaccttcacaatgagactgttgagcccagttcgcgtgcctaactataatctaataatcatggacgaagcacacttcacggatcccgcctcaattgccgctaggggctacatctccactcgtgtcgagatgggggaagcggcaggaatctttatgaccgccacaccaccgggcagtcgggaccctttcccccagtctaacgctccaattatagatgaggagagagaaatccccgagaggagctggaataccggtcatgaatgggtgactgactttaaagggaagacagtatggttcgtgccttccattaaggccggaaacgatatcgcagcctgcctgcgcaaaaatggcaagaaagttattcaactctcacgaaagacctttgactctgagtatgtcaaaacgagaactaacgattgggacttcgtggtgacaaccgatatcagcgaaatgggcgctaattttaaggcggagcgggtcatagacccaaggcgctgtatgaaacccgtaatcttaaccgacggggaggaacgtgtgattctggccggacctatgccggttactcacagttccgcagctcagagacggggtaggatcggccgcaacccaaagaatgagaacgatcagtacatttacatgggggaaccccttgagaatgacgaagattgcgcccactggaaggaggcaaaaatgctgctcgacaacatcaatacacctgagggaataattcccagcatgttcgaaccagagcgagaaaaggtggatgccatcgacggcgagtatagattgcggggtgaagctaggaaaacctttgtcgatctgatgcgcagaggggacctccctgtgtggctggcctacaaggttgcggcagagggcattaactatgccgataggcggtggtgtttcgacggaatcaaaaataaccagatacttgaggaaaacgtggaggtcgaaatctggacaaaggagggcgagcgtaagaaactaaagccccgctggctggatgctcgaatttactctgacccattggccttaaaagaatttaaggagttcgctgcagggagaaaatcactgactctcaatctgatcacggaaatgggaaggcttcctaccttcatgacacaaaagactcgggatgccctggacaacctcgctgtgttgcataccgccgaggcgggtggacgcgcatataatcacgccctgtccgaactaccggagacactggagaccctccttctgttaactttgctggctacggtaaccgggggaatttttctcttcctgatgagtggcagaggtatcgggaagatgacacttggcatgtgctgcataattactgccagcatcctgctctggtacgcacagatccagccccattggattgctgcctcgatcatattggaatttttcctgattgtgttactaatcccagagcctgaaaaacagaggacaccccaagacaaccagctgacatatgttgtcattgcaatcctcaccgtggtggccgctactatggcgaatgagatgggatttcttgaaaagactaaaaaggatctgggcttggggtctatagccacgcagcagccagagtccaacatcctggacattgatctccggcctgcaagcgcttggaccctgtacgccgtcgccactacattcgttacccccatgcttcgacactcaatcgagaatagttctgtgaacgtatccctcaccgcaattgctaatcaagccacagtgctgatgggattgggtaaaggctggccgctgagcaagatggacatcggggtcccattactagcgattggatgttactcacaggtgaaccctatcactctgacggctgccctccttctgttggttgcacactatgccataattggccccggtctgcaggctaaggcaaccagagaagcccagaaacgcgcggctgccgggatcatgaagaatccaacagtggatggcatcactgtcattgacctcgatcccataccttacgacccgaaatttgagaagcaactgggacaggtaatgcttttaatcctgtgcgtgacccaggttctcatgatgaggacaacctgggcattgtgtgaagccctgactctagctacgggccccattagtacactgtgggaggggaacccaggacggttctggaataccactatcgccgtgagcatggcaaacatttttcgtggctcctatctcgctggtgccgggcttctgttctctatcatgaaaaataccacaaacactagaaggggaaccggcaatataggtgaaacattgggcgagaagtggaaaagccgcctgaacgcgctcgggaagtccgagtttcaaacgtacaagaaatcaggaatccaggaagtcgatcggaccctggccaaggagggcattaaacgaggggaaactgaccatcacgcagtgtctagaggaagtgctaagttaaggtggttcgtcgagcgcaacatggtgacacctgagggcaaagttgtggatcttggttgcgggcggggaggctggtcgtattactgtggtggcctgaagaatgtaagagaagtgaaggggctcaccaaaggaggccccgggcatgaggaacctatcccaatgagcacttatggatggaacctagtccgtctgcagtccggcgttgacgtgtttttcattccccctgagaagtgcgatacattgctgtgtgacatcggtgaatcttcaccaaatcccaccgtcgaggccgggaggacgctccgggtgcttaacctggtagagaattggttgaacaataacacccagttctgcataaaagtgctgaatccgtacatgcctagcgttattgaaaagatggaggcactccaacgcaaatacggaggcgctttagtgcgaaacccactgtccagaaatagtacacacgaaatgtattgggtctctaacgccagcggcaatatcgtgtcatccgtcaacatgatcagtaggatgcttattaatcggtttactatgcgccataagaaggccacctacgagcccgacgtggatctggggagcggaacaagaaacataggtatcgaatctgagattcctaacctagacatcattggcaaaaggatcgagaagataaaacaggaacacgagacttcctggcactatgatcaggaccatccatacaagacctgggcgtatcacgggtcatacgaaacaaaacagaccggaagcgcttcgtctatggttaatggcgtagtgcgactcctgactaagccctgggatgtcttgccgacggtgacacaaatggcaatgaccgacactacccctttcggtcagcagcgggtttttaaggagaaagtggatacacgtacgcaggaacccaaggaggggaccaaaaagctgatgaaaatcactgccgagtggctctggaaggaacttggcaaaaagaagacaccaagaatgtgtacccgcgaggagttcactaggaaagtccggagtaacgctgccctgggcgcaatttttacagacgagaataagtggaaatccgccagagaggctgtggaagatagccgcttctgggagttagtagacaaggaaaggaacctgcatttggagggcaaatgcgaaacctgtgtgtataatatgatggggaagcgagagaagaaactcggagagtttggtaaggcgaaaggctcacgggccatctggtacatgtggctgggggcaagattcctagaatttgaggctcttggattcctgaacgaagatcactggttttccagggaaaattctctcagcggcgttgaaggtgaggggctgcacaagttgggatacattctgcgcgacgtcagtaaaaaggagggcggcgccatgtatgcagacgatacagccgggtgggacactcgtatcaccctcgaagatcttaagaacgaggaaatggtgacgaatcatatggagggagaacacaaaaagctggctgaggccattttcaaattaacctaccaaaacaaggtggtccgggttcagagacctacacccaggggtactgtgatggacataatctcccgccgagatcagcggggcagcgggcaagtaggaacctatggcctgaatacatttactaacatggaggcgcagttgattagacagatggaaggtgagggggtgttcaaaaatatccagcatctcaccgcaacggaagaggtcgccgtgaagaactggctggctagggttggacgcgagagactatctcggatggccatctcaggcgacgattgcgtggtcaagccacttgacgataggttcgcaaatgctctgacagccctcaacgacatgggcaaaattcgtaaggatatacaacagtgggaacccagtaaagggtggaacgactggacccaggtgcctttttgctcccaccatttccacgagctgatcatgaaggatggacgagtattggttgtgccatgtcgcaatcaggacgaattaattggtagagctcggatcagccaaggcgccgggtggtctctgagggagactgcatgcctcggaaaatcgtacgcgcagatgtggtcacttatgtattttcaccgcagagacctgcggctagccgctaacgccatttgtagcgcagtcccgtcccattgggtgcccacaagtaggaccacttggtctatccacgctaagcatgaatggatgaccacagaggatatgctgacggtgtggaatcgagtctggatacgtgagaacccttggatggaagacaagaccccagttgagagctgggaagagatcccctacctcggcaaaagagaagatcagtggtgcggttccttgattgggctgacttcacgcgccacatgggcaaagaatatccaggccgcgattaaccaagtgcggagtcttatcggaaatgaggagtataccgactacatgccttctatgaaaaggttcagacgcgaagaggaagaggctggcgtactgtggtga

SEQ ID NO: 14422 - RNA, 9876 nt, synthetic construct
  misc_feature 1..9876: note = derived and/or modified CDS sequence (opt3) from DENV-2__GU131931__SS-prME
  source 1..9876: mol_type = other RNA
agcgccggaatgatcattatgctgataccaaccgtgatggctttccacctcactactcggaacggggagcctcatatgatcgtaggtattcaagaaaagggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccacatgtcggtatggggcttgagactcgtaccgaaacatggatgagctccgagggagcgtggaaacacgctcagagaatcgagacttggatactgaggcatcctggcttcaccatcatggccgcaattttggcccacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcatgggagttgtgttaccactatggccaagaataagcccacattagatttcgaactgattaaaaccgaggctaagcagcctgccacgcttaggaaatactgcatcgaagcgaagttgaccaacacaactaccgagtcccggtgtccaacacaaggagagccctctctgaaagaggaacaggacaagcgctttgtgtgcaagcacagcatggtcgatcgaggctggggtaatgggtgtggactattcggcaaaggcgggatcgtgacttgcgcaatgtttacctgcaagaaaaacatggaaggaaagattgtgcagcctgagaatctcgaatatacaatagtcgttaccccacattccggtgaggagcacgccgtgggcaacgacactgggaaacacggaatggaaatcaaggtaacgccgcagtcaagtattacagaggctgaactgaccggctacggtactgtgaccatggagtgtagccccagaacagggcttgatttcaatgaaatggtcctgttgcaaatggagaacaaagcctggctcgtgcataggcagtggtttctggacttacctctgccatggctccccggcgcagataagcaggagtctaattggatccagaaggaaacccttgttactttcaaaaaccctcacgctaagaaacaagacgtggtcgtgctgggatcccaggagggcgccatgcatacagcgttgacgggggccaccgaaatacagatgtcaagcggaaatctactgtttactggtcacctcaagtgccggctgcgtatggacaaacttcaactgaagggcatgagttattctatgtgtacagggaagttcaaagtagttaaggagattgcagagacccagcatggaacaatcgtgatccgcgtccagtacgaaggcgatggttccccatgcaaaattcccttcgagatcatggacttggaaaagagatatgtgctcgggaggctgattactgtcaacccgatagtgaccgagaaagatagccctgttaacatcgaagctgagcccccatttggcgactcgtacattatcatcggagtggagcctggccagttaaagctgaattggttcaagaaagggtcttccattggacaaatgtttgaaacgaccatgcggggtgccaagcgaatggctatactaggcgatacagcctgggacttcgggtcactcggaggcgtatttacaagtatcggtaaagcactgcaccagattttcggggccatctacggcgctgcgtttagcggagtctcctggaccatgaagattcttatcggcgtgataatcacatggattgggatgaactctcgcagcacttcattgagtgtttccctggtgctcgtcggaatcgtgaccctgtatcttggcgtaatggtgcaggcagatagcggttgtgttgtctcttggaaaaataaggagctgaagtgcgggtcaggaattttcatcacggacaacgtgcacacatggaccgaacagtacaaatttcaacccgagagtccaagcaagttggcctccgctatacagaaagcccaggaagagggcatttgtggtatcagatctgtgactaggctcgagaatctgatgtggaagcagattacacccgaattaaaccatatcctggcagagaatgaagtcaaactaaccataatgactggcgatatcaaggggattatgcaagccggaaaacggtcgctccgccctcagccaaccgagctgaagtatagctggaagacatggggcaaagctaagatgctttccacggaatcacacaaccagaccttcttgatcgacgggccggagactgccgagtgccccaatacaaacagagcatggaatagtctggaagttgaggattacggatttggcgtgttcaccacaaacatttggctcaaactgaaggaaaaacaggacgcgttttgtgactctaagttaatgagcgctgccatcaaggataatagggcagtgcatgccgacatgggttattggatagagtccgctctgaacgatacttggaaaattgagaaggcctcattcatcgaagtcaagaattgccactggcctaagagccacaccctttggtctaacggggtcttggagtccgaaatgatcattcccaagaacctcgcaggacccgtgagtcaacataattaccgtcctggctatcacacgcagatcgctggtccatggcatctgggcaagctagagatggacttcgatttttgtgacgggacaaccgttattgtgactgaagattgcggaaaccggggccccagcctgcgaaccacaactgcctctgggaagctcataaccgagtggtgctgtagatcctgcacactgccgcctcttaggtaccgcggagaggacggctgttggtacggtatggaaatccggccattgaaagagaaggaagagaatctggtcaactcattagtgacggcggggcacggacaggttgataatttcagtctcggcgtgctgggtatggccctttttctggaagagatgttgagaaccagggtaggcactaaacatgctattctcctggtcgcagtgagcttcgtgacactaatcaccgggaacatgtcgtttaaggacctgggacgcgtcgttgtgatggtaggcgccactatggctgatgacattgggatgggagtgacatatctcgccctgcttgcagcgttcaaagtccgacccacctttgccgctggcttgctgttacggaagctcacgtccaaggagctgatgatgactaccatcggtatagtgcttctgtctcaaagcacaatccctgaaaccgttctagagctcactgatgccctggcattggggatgatggtgctgaaaattgtccgtaatatggaaaagtaccagttagctgtgacaatcatggccattctctgcgttcccaacgcagtgatcctgcagaatgcctggaaagtctcatgtaccatacttgctgtagtgagtgtttccccactgttgctcacatctagccagcaaaagactgactggattcctctggcgctaaccatcaaaggactgaaccccacggccatcttccttacaaccctctccagaactaataagaaaaggtcatggccactgaacgaggcaattatggctgtgggcatggtcagcatattggccagttctctgttaaagaatgacatcccgatgaccggccctctcgtggccgggggactgcttacagtatgctatgtgctgactggtcgctccgctgatttggaactcgagcgggcaaccgacgtcaagtgggaggatcaggccgaaattagcggctcgtcacccatcctgtctattacgatcagtgaggacgggtccatgagcatcaaaaacgaagaggaggaacagacactaaccatcctgattagaactggacttctcgttatctctggcctgtttccaattagcatccccataacagcggctgcctggtacttgtgggaggtgaagaaacagagggccggtgtgttatgggatgtcccttccccaccccctatggggaaggccgaactggaggacggagcttatcgaattaaacaaaagggcatcctcggctactcacagatcggggcaggagtgtataaggaaggtaccttccacactatgtggcacgttacacgcggcgccgtactgatgcataaagggaagcggattgagccgagttgggcggatgtgaaaaaggaccttatcagctacggaggcggttggaaactggagggggaatggaaggagggagaagaggtccaggtgttggctctagaaccaggcaagaatcccagagccgttcagaccaaacctggcctgtttaagacgaacactgggaccataggagcagtgtctctcgatttctccccaggtacatcaggcagtcccattatcgacaaaaaggggaaagtcgtgggactgtacggcaacggtgtagtcaccaggagcggggcctatgtgtccgctattgcccaaacagagaagtctatcgaggataatcctgaaatagaggacgatatttttcgtaagcgccggcttactatcatggacttacacccgggagcaggcaaaaccaagagatacctgcccgctatcgttagggaagccattaaacgaggcctccggacgttgatcctggcgccaacacgcgtggtcgccgcagagatggaagaggctctcagagggctgcctattaggtatcagactcccgccatacgggctgagcataccggacgagaaatcgtggaccttatgtgtcacgcaacattcaccatgagactgttgtcgccagttcgcgtgcctaactacaatctaattatcatggatgaggcccatttcactgaccccgccagcatcgctgcgaggggttatatttcaacccgtgtcgaaatgggcgaggcagccgggatatttatgacagctacgccaccgggatcccgggatcctttcccccagagtaacgccccaatcattgacgaggaaagagagatccccgaaaggtcttggaatagcggccacgagtgggtgactgattttaagggtaaaaccgtatggttcgtgccttccattaaggcagggaacgacatcgccgcttgcctgcgcaagaatggcaaaaaggttatacaactctcacgaaaaacatttgattctgaatacgtcaagaccagaactaacgactgggatttcgtggtgacaaccgacatcagcgagatgggcgcgaattttaaagccgagcgggtcattgatccaaggcgctgtatgaagcccgtaatcttaacggacggcgaggaacgtgtgattctggcagggcctatgccggttactcacagttccgctgcccagagacggggaaggatcggtcgcaaccccaaaaatgaaaacgaccagtatatatacatgggcgagccccttgaaaatgatgaggactgcgcacattggaaggaggccaagatgctgctcgataacattaatacacctgaagggatcattcccagcatgttcgagccagaacgagagaaagtggacgctatcgatggagaatacagattgcggggcgaggccaggaagacctttgtcgacctgatgcgcagaggtgatctccctgtgtggctggcgtataaagttgcagccgaggggataaactacgctgacaggcggtggtgtttcgatggcatcaagaacaatcagattcttgaagagaacgtggaagtcgagatctggaccaaagagggagaacgtaagaagctaaaaccccgctggctggacgcccgaatttattctgatccattggctttaaaggagtttaaagagttcgcagccggcagaaagtcactgactctcaatctgatcacagagatggggaggcttcctaccttcatgacacagaaaactcgggacgctctggataacctcgccgtgttgcacacggcagaagcgggaggtcgcgcctacaatcatgctctgtccgagctaccggagaccctggaaacactccttctgttaactttgctggccaccgtaacaggcgggatatttctcttcctgatgagtggaagaggcattggtaagatgacccttgggatgtgctgcatcatcactgcaagcattctgctctggtatgctcagatccagccccactggatagccgcatcgattatcttggagtttttcctgattgtgttactaatcccagaacctgagaagcagaggacgccccaagacaaccagctgacctacgttgtcatagccatcctcacagtggtggctgcgactatggccaatgaaatgggctttcttgagaaaaccaagaaagacctgggattgggctctattgcaacacagcagccagagtccaacatcctggatattgacctccggcctgctagcgcctggaccctgtatgccgtcgcaactacattcgttacgcccatgcttcgacactcaatcgaaaatagttctgtgaacgtatccctcaccgctattgccaatcaagcgactgtgctgatggggttgggaaagggttggccgctgagcaaaatggatatcggcgtcccattactagctatagggtgttactcacaggtgaaccctattacactgaccgccgcactccttctgttggttgcccattacgctatcatcggacccggcctgcaggcaaaggccaccagagaggcgcagaagcgcgctgccgcaggtattatgaaaaatccaacagtggacgggataactgtcatcgatctcgaccccattccttatgatccgaagtttgaaaaacaactgggccaggtaatgcttttaatcctgtgcgtgacgcaggttctcatgatgaggaccacatgggccttgtgtgaggctctgactctagccaccggacccattagtacactgtgggaaggcaacccagggcggttctggaataccactatcgcagtgagcatggctaacatatttcgtggatcctacctcgccggcgcgggtcttctgttctctatcatgaagaatacgacaaacaccagaagggggactggaaacattggcgagaccttgggtgagaaatggaaaagccgcctgaatgccctcggcaaatccgaatttcaaatctataagaagtcagggattcaggaggtcgaccggacactggcaaaagaaggaatcaagcgaggcgagactgatcaccatgctgtgtctagagggagtgccaaattaaggtggttcgtcgagcgcaacatggtgacccctgaaggaaaggttgtggaccttggctgcggtagagggggatggtcgtactattgtggcggtctgaaaaatgtaagagaggtgaagggcctcacaaaagggggacccggccacgaggaacctataccaatgagcacgtacgggtggaacctagtccgtctgcagtccggagttgatgtgtttttcattccccctgaaaaatgcgacaccttgctgtgtgatatcggcgagtcttcaccaaatcccactgtcgaggcaggtaggacactccgggtgcttaacctggtagaaaattggttgaacaataacacccagttctgcatcaaggtgctgaatccgtatatgcctagcgttattgagaaaatggaagctctccaacgcaagtacgggggagccttagtgcgaaacccactgtccagaaatagtactcatgagatgtactgggtctctaacgccagcggcaatatagtgtcatccgtcaacatgatcagtaggatgcttattaaccggtttacaatgcgccacaaaaaggcgacctatgaacccgacgtggacctgggcagcgggacgagaaatatcggaattgagtctgagatccctaacctagatataatcggtaagaggattgagaaaataaaggaagaacacgagacctcctggcattacgaccaggatcacccatataaaacatgggcttaccatggctcatatgaaactaagcagaccgggagcgcatcgtctatggttaatggagtagtgcgactcctgacaaaaccctgggacgtcttgccgactgtgacccagatggccatgacagataccactcctttcggccaacagcgggtttttaaggagaaggtggacacgcgtacacaggagcccaaagaaggtaccaagaaactgatgaagattactgctgagtggctctggaaagaacttgggaagaaaaagaccccaagaatgtgtacacgcgaggagttcacgaggaaggtccggagtaacgccgcactgggagccatctttaccgatgaaaataaatggaagtccgctagagaggcggtggaagacagccgcttctgggagttagtagataaagaaaggaacctgcacttggagggcaagtgcgagacttgtgtgtacaatatgatgggcaaacgagaaaagaagctcggggagtttggaaaagccaagggttcacgggcaatttggtatatgtggctgggcgctagattcctagaatttgaggcccttgggttcctgaacgaagaccactggttttccagggaaaattctctcagcggagttgagggcgaaggtctgcataaattggggtacatactgcgcgatgtcagtaagaaagagggaggcgcaatgtacgccgacgacacagctggctgggatacccgtatcactctcgaagaccttaagaacgaggaaatggtgacaaatcacatggagggggagcataagaaactggccgaagcgattttcaagttaacctatcagaacaaagtggtccgggttcaaagacctacacccaggggaactgtgatggatatcatctcccgccgagaccagcggggtagcggccaggtagggacctacggactgaatacgtttaccaacatggaggcacaattgattagacagatggaaggcgagggtgtgttcaagaatatacagcacctcacagtcactgaggaagccgctgtgcagaactggctggccagggttgggcgcgagagactatctcggatggcaatctcaggagatgactgcgtggtcaaaccacttgatgacaggttcgctaacgccctgaccgctctcaatgatatgggcaagattcgtaaggacatccaacagtgggaacccagtaaaggctggaacgattggacacaggtgcctttttgctcccatcacttccacgagctgattatgaaggacgggcgagtattggttgtgccatgtcgcaatcaggatgaattaatcggtagagcacggataagccaaggagcaggctggtctctgagggagactgcgtgcctcgggaaatcgtatgcccagatgtggtcacttatgtactttcatcgcagagacctgcggctagctgccaacgcaatctgtagcgctgtcccgtcccactgggtgcccaccagtaggacgacatggtctattcatgccaagcacgagtggatgaccactgaagacatgctgacagtgtggaatcgagtctggatccgtgagaacccttggatggaagataaaaccccagttgagagctgggaagagattccctatctcggaaagagagaggaccagtggtgcggctccttgatcggtctgacttcacgcgcaacctgggccaagaatatacaggcggctattaaccaagtgcggagtcttatcgggaatgaagagtacacagattatatgccttctatgaaaaggttcagacgcgaagaggaagaggccggagtactgtggtga

SEQ ID NO: 14423 - RNA, 9876 nt, synthetic construct
  misc_feature 1..9876: note = derived and/or modified CDS sequence (opt3) from DENV-2__GU131932__SS-prME
  source 1..9876: mol_type = other RNA
agcgccggaatgatcattatgctgataccaaccgtgatggctttccacctcactactcggaacggggagcctcatatgatcgtcggtattcaagaaaagggaaaatcccttctgtttaagacggaggacggcgttaatatgtgcaccttgatggcaatggatttaggggaactgtgtgaggacacgatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccacatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaatggaaatcaaggtaacgccgcagtcaagtattacagaggctgaactgaccggctatggtactgtgaccatggagtgtagccccagaacagggcttgatttcaatgaaatggtcctgttgcaaatggagaacaaagcctggctcgtgcacaggcagtggtttctggacttacctctgccatggctccccggcgcagataagcaggagtctaattggatccagaaggaaacccttgttactttcaaaaaccctcatgctaagaaacaagacgtggtcgtgctgggatcccaggagggcgccatgcacacagcgttgacgggggccaccgaaatacagatgtcaagcggaaatctactgtttactggtcatctcaagtgccggctgcgtatggacaaacttcaactgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccagttaaagctgaattggttcaagaaagggtcttccattggacaaatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacagtataaatttcaacccgagagtccaagcaagttggcctccgctatccagaaagcccaggaagagggcatatgtggtattagatctgtcactaggctcgagaatctgatgtggaagcagatcacacccgaattaaaccacattctggcagagaatgaagttaaactaaccatcatgactggcgatataaaggggatcatgcaagccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaggacgcgttttgtgactctaagttaatgagcgctgccattaaggataatagggcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatccccaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaagctcattaccgagtggtgctgtagatcctgcacactgccgcctcttaggtatcgcggagaggacggctgttggtacggtatggaaatacggccattgaaagagaaggaagagaatctggtgaactcattagttacggcggggcacggacaggtggataatttcagtctcggcgtactgggtatggccctttttctggaagagatgttgagaaccagggtcggcactaaacatgctatcctcctggtggcagtgagcttcgtcacactaattaccgggaacatgtcgtttaaggacctgggacgcgttgtggtaatggtgggcgccactatggctgatgacatcgggatgggagtcacatatctcgccctgcttgcagcgttcaaagtgcgacccacctttgccgctggcttgctgttacggaagctcacgtccaaggagctgatgatgactaccattggtatcgttcttctgtctcaaagcacaatacctgaaaccgtgctagagctcactgatgccctggcattggggatgatggtcctgaaaatcgtgcgtaatatggaaaagtaccagttagctgttacaattatggccatcctctgcgtgcccaacgcagtcattctgcagaatgcctggaaagtatcatgtaccatccttgctgtggttagtgtgtccccactgttgctcacatctagccagcaaaagactgactggatacctctggcgctaaccattaaaggactgaaccccacggccatcttccttacaaccctctccagaactaataagaaaaggtcatggccactgaacgaggcaatcatggctgtcggcatggtgagcattttggccagttctctgttaaagaatgacataccgatgaccggccctctcgtagccgggggactgcttacagtgtgctatgtcctgactggtcgctccgctgatttggaactcgagcgggcaaccgacgttaagtgggaggatcaggccgaaatcagcggctcgtcacccattctgtctatcacgattagtgaggacgggtccatgagcatcaaaaacgaagaggaggaacagacactaaccatactgatcagaactggacttctcgtgatttctggcctgtttccaatcagcattcccatcacagcggctgcctggtacttgtgggaggtgaagaaacagagggccggtgtcttatgggatgtgccttccccaccccctatggggaaggccgaactggaggacggagcttatcgaataaaacaaaagggcattctcggctactcacagatcggggcaggagtttacaaggaaggtaccttccacactatgtggcatgtaacacgcggcgccgtgctgatgcacaaagggaagcggatcgagccgagttgggcggatgtcaaaaaggaccttattagctatggaggcggttggaaactggagggggaatggaaggagggagaagaggtgcaggttttggctctagaaccaggcaagaatcccagagccgtgcagaccaaacctggcctgtttaagacgaacactgggaccatcggagcagtctctctcgatttctccccaggtacatcaggcagtcccataattgacaaaaaggggaaagtggtaggactgtacggcaacggtgtcgtgaccaggagcggggcctatgtttccgctatcgcccaaacagagaagtctattgaggataatcctgaaatcgaggacgatatatttcgtaagcgccggcttactattatggacttacacccgggagcaggcaaaaccaagagatacctgcccgctatcgtgagggaagccatcaaacgaggcctccggacgttgattctggcgccaacacgcgtcgtggccgcagagatggaagaggctctcagagggctgcctatcaggtatcagactcccgccattcgggctgagcataccggacgagaaatagttgaccttatgtgtcacgcaacattcaccatgagactgttgtcgccagtgcgcgtccctaactacaatctaatcattatggatgaggcccatttcactgaccccgccagcatcgctgcgaggggttatatctcaacccgtgtggaaatgggcgaggcagccgggatttttatgacagctacgccaccgggatcccgggatcctttcccccagagtaacgccccaataatcgacgaggaaagagagattcccgaaaggtcttggaatagcggccacgagtgggtaactgattttaagggtaaaaccgtgtggttcgttccttccatcaaggcagggaacgacattgccgcttgcctgcgcaagaatggcaaaaaggtcatccaactctcacgaaaaacatttgattctgaatacgtgaagaccagaactaacgactgggatttcgtggtcacaaccgacataagcgagatgggcgcgaattttaaagccgagcgggtaatcgatccaaggcgctgtatgaagcccgtgattttaacggacggcgaagaacgtgttatcctggcagggcctatgccggtgactcatagttccgctgcccagagacggggaaggattggtcgcaaccccaaaaatgaaaacgaccagtacatctatatgggcgagccccttgaaaatgatgaggactgcgcacactggaaggaggccaagatgctgctcgataacataaatacacctgaagggattatccccagcatgttcgagccagaacgagagaaagtcgacgctattgatggagaatacagattgcggggcgaggccaggaagacctttgtggacctgatgcgcagaggtgatctccctgtttggctggcgtataaagtggcagccgaggggatcaactacgctgacaggcggtggtgtttcgatggcataaagaacaatcagatccttgaagagaacgtcgaagtggagatttggaccaaagagggagaacgtaagaagctaaaaccccgctggctggacgcccgaatctattctgatccattggctttaaaggagtttaaagagttcgcagccggcagaaagtcactgactctcaatctgattacagagatggggaggcttcctaccttcatgacacagaaaactcgggacgctctggataacctcgccgtattgcacacggcagaagcgggaggtcgcgcctacaatcatgctctgtccgagctaccggagaccctggaaacactccttctgttaactttgctggccaccgtgacaggcgggatctttctcttcctgatgagtggaagaggcataggtaagatgacccttgggatgtgctgcattatcactgcaagcatcctgctctggtatgctcagattcagccccactggatcgccgcatcgataattttggagtttttcctgatcgttttactaattccagaacctgagaagcagaggacgccccaagacaaccagctgacctacgtcgtgatcgccatactcacagtggtcgctgcgactatggccaatgaaatgggctttcttgagaaaaccaagaaagacctgggattgggctctatcgcaacacagcagccagagtccaacattctggatatcgacctccggcctgctagcgcctggaccctgtacgccgttgcaactacattcgtgacgcccatgcttcgacattcaattgaaaatagttctgtaaacgtgtccctcaccgctatcgccaatcaagcgactgtcctgatggggttgggaaagggttggccgctgagcaaaatggatattggcgtgccattactagctatcgggtgttattcacaggttaaccctataacactgaccgccgcactccttctgttggtggcccactacgctattatcggacccggcctgcaggcaaaggccaccagagaggcgcagaagcgcgctgccgcaggtatcatgaaaaatccaacagtcgacgggattactgtaatagatctcgaccccatcccttatgatccgaagtttgaaaaacaactgggccaggtgatgcttttaattctgtgcgttacacaggtgctcatgatgaggaccacatgggccttgtgtgaggctctgactctagccaccggacccatcagtacactgtgggaaggcaacccagggcggttctggaataccactattgcagtcagcatggctaacatctttcgtggatcctacctcgccggcgcgggtcttctgttctctataatgaagaatacgacaaacaccagaagggggactggaaacatcggcgagaccttgggtgagaaatggaagaatcgcctgaacgccctcggcaaaagcgaatttcaaatttataagaagtccgggatccaggaggtggaccggacactggcaaaagaaggaattaagcgaggcgagactgatcaccatgctgtctcaagagggtctgccaaattaaggtggttcgtggagcgcaatatggttacccctgaaggaaaggtggtagaccttggctgcggtagagggggatggagttactattgtggcggtctgaaaaacgtgagagaggtcaagggcctcacaaaagggggacccggccacgaggaacctatcccaatgtcgacgtacgggtggaatctagttcgtctgcagagcggagtggatgtctttttcataccccctgaaaaatgcgacaccttgctgtgtgatattggcgagtcctctccaaaccccactgtggaggcaggtaggacactccgggtacttaatctggtggaaaactggttgaataacaatacccagttctgcatcaaggttctgaacccgtacatgccttcagtgatcgagaaaatggaagctctccaacgcaagtatgggggagccttagtccgaaatccactgagcagaaactccactcatgagatgtactgggtgagtaatgcctctggcaacattgtcagctcagtgaacatgatatccaggatgcttatcaatcggtttacaatgcgccacaaaaaggcgacctatgaacccgacgttgacctgggcagtgggacgagaaacattggaatcgagagcgagattcctaatctagatatcataggtaagaggatcgagaaaattaaggaggaacatgagacctcttggcactacgaccaggatcacccatataaaacatgggcttaccatggctcctatgaaactaagcagaccgggtcagcaagctcgatggtaaacggagtggtccgactcctgacaaaaccctgggacgtgttgccgactgttacccagatggccatgacagataccactcctttcggccaacagcgggtgtttaaggagaaggtcgacacgcgtacacaggagcccaaagaaggtaccaagaaactgatgaagatcactgctgagtggctctggaaagaacttgggaagaaaaagaccccaagaatgtgtacacgcgaggagttcacgaggaaggtgcggtctaatgccgcactgggagccatttttaccgatgaaaacaaatggaagagtgctagagaggcggtagaagactcccgcttctgggagttagtggataaagaaaggaatctgcacttggagggcaagtgcgagacttgtgtttacaacatgatgggcaaacgagaaaagaagctcggggagtttggaaaagccaagggtagccgggcaatctggtacatgtggctgggcgctagattcctagaatttgaggcccttgggttcctgaatgaagaccattggttttcaagggagaactccctctctggagtcgagggcgaaggtctgcacaaattggggtatattctgcgcgatgtgagcaagaaagagggaggcgcaatgtacgccgacgacacagctggctgggatacccgtataactctcgaagaccttaagaatgaggaaatggtgacaaaccacatggagggggagcataagaaactggccgaagcgatcttcaagttaacctatcagaataaagtcgttcgggtgcaaagacctacacccaggggaactgtaatggatattatcagtcgccgagaccagcggggttccggccaggtggggacctacggactgaacacgtttaccaatatggaggcacaattgatcagacagatggaaggcgagggtgtcttcaagaacattcagcacctcacagtgactgaggaagccgctgttcagaactggctggccagggtggggcgcgagagactaagccggatggcaatatctggagatgactgcgtcgtgaaaccacttgatgacaggttcgctaatgccctgaccgctctcaacgatatgggcaagatccgtaaggacattcaacagtgggaaccctcaaaaggctggaatgattggacacaggtacctttttgcagtcatcacttccatgagctgatcatgaaggacgggcgagttttggtggtcccatgtcgcaaccaggatgaattaattggtagagcacggatctcccaaggagcaggctggagcctgagggagactgcgtgcctcgggaaatcttatgcccagatgtggtcgcttatgtactttcaccgcagagacctgcggctagctgccaatgcaatatgttcagctgtgccgagccactgggtgcccacctccaggacgacatggagtatccatgccaagcacgagtggatgaccactgaagacatgctgacagtctggaaccgagtttggattcgtgagaatccttggatggaagataaaaccccagtggagtcttgggaagagatcccctatctcggaaagagagaggaccagtggtgcggcagcttgattggtctgacttcccgcgcaacctgggccaagaacatccaggcggctataaatcaagtacggtcacttattgggaacgaagagtacacagattacatgcctagtatgaaaaggttcagacgcgaagaggaagaggccggagtgctgtggtga

SEQ ID NO: 14424 - RNA, 9876 nt, synthetic construct
  misc_feature 1..9876: note = derived and/or modified CDS sequence (opt3) from DENV-2__GQ199892__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataagcttcaactgaaagggatgagctacagtatgtgtactggaaagttcaagatcgtcaaagaaatcgctgagacccagcacggcacgattgtgatcagagtacagtatgagggtgacggggccccatgcaagattcccttcgaaataaccgatttggagaaaaggcatgttctcggccggctgatcacagtgaacccgattgtcactgaaaaggactctcctgtgaacatcgaggctgaacccccatttggagattcctacatcattgtcggcgtggagcctgggcagttaaaactgaattggttcaagaagggaagctcgataggtcaaatgtttgagaccacaatgcgaggcgccaaacgcatggcaatcctaggggacactgcctgggatttcggatctctcggcggtgtttttacctccattgggaaggctctgcaccaggtgttcggcgcgatctacggagcagccttttcaggcgtaagttggacgatgaaaattcttatcggggtcataatcacatggattggaatgaacagcagatccacctctttgagcgtgtcactggttctcgtgggcgtcgtgactctgtatcttggtgctatggtacaggccgacagtgggtgtatcgtgtcctggaagaataaagaactgaagtgcggaagcggcattttcatcacagataacgttcacacctggactgagcagtacaagtttcaacccgaatctccatcaaaattggcaagtgccatacagaaggctcatgaggaaggtatttgtggcatcaggagcgtcacccggctcgagaatctgatgtggaaacagattacacccgagttaaaccacatcctgtccgaaaatgaggtgaagctaacgataatgaccggggacatcaaaggaattatgcaggccggcaagcgctctctcagacctcaaccaactgaactgaaatattcgtggaagacatgggggaaggcaaaaatgcttagcaccgagtcccataaccagacattcttgatcgatggaccggaaactgcggagtgccccaataccaacagggcttggaattcactggaggtggaagactacggctttggtgtcttcagtacgaacatttggctcaagctgcgtgagaaacaggacgttttttgtgattctaagttaatgagcgccgcaatcaaagacaatcgggccgtgcacgctgatatggggtattggatagaatccgccctgaacgacacatggaagatggagaaggcatcattcattgaggtgaaaagctgccactggcctaagtctcataccctttggtccaatggagtattggaaagtgagatgatcatcccaaaaaacttcgctggccccgtcagccagcacaactaccgacctggttatcatactcaaaccgccggcccatggcacctcgggaagctggaaatggattttgacttctgtgagggaacaactgtggttgtgaccgaagattgcggcaatagagggccctctctaaggacaacgaccgcgtccggaaaactgattactgagtggtgctgtcgctcatgcacactcccgcctctgcggtacagaggcgaggacggttgttggtacgggatggaaatcaggccacttaaggagaaggaagagaacttggtcaatagtctggtgaccgccggacatggccagattgataactttagcttaggtatactcggcatggctctgttccttgaagagatgctgcgcactcgagttgggacaaaacacgcaatcttgctcgtggccctgtcgtttgtaaccctaattacgggaaatatgtccttccgggacctgggccgtgtcatggtgatggtgggggctactatgaccgatgacatcggaatgggcgtcacatatctcgccctgcttgcagcgtttaaggttagacccaccttcgccgctggtttgctgttaaggaaactcacttctaaggagctgatgatggccacaattgggatcgcacttctgagccagtcaaccctacctgaaacaatactcgagctgactgatgctttggccctgggaatgatggcattaaaaatcgtgcgcaacatggaaaagtaccaactcgccgtaaccattatggctatcagttgcgtgcccaatgcggtcattctgcagaacgcctggaaggtgtcctgtacgatccttgcagctgtttctgtgagcccactgttgctcacatcctcacagcagaaagccgactggatacctctggccctaaccattaagggcctgaatcccactgctatctttcttaccacactcagccggactagtaaaaagagatcttggccactgaacgaggcaatcatggccgtcggcatggtgtccattttggcgagctcgctgttaaaaaatgacataccgatgaccgggcctctcgttgctggaggtctgcttacggtgtgctatgtcctgacaggcaggtcagccgatttggaactcgagcgagcagccgacgtaaagtgggaggatcaagctgaaatctctgggagttcccccattctgagcatcaccatttctgaggacggaagcatgtccatcaaaaacgaagaggaggaacagactctaacaatactgatccgcaccggccttctcgtgatttcaggtgttttcccagtgagtatccccattactgcagccgcgtggtacctgtgggaggtcaagaagcagcgggctggggtgttgtgggatgtacctagcccaccccctgtgggaaaagccgaattagaggacggcgcatatagaatcaagcagaggggcatactggggtactctcaaattggagccggtgtctataaagaaggcacatttcacaccatgtggcatgttacgcgtggggctgtgctcatgcaccgcggaaagcggatcgagccgtcctgggccgatgtgaaaaaggacctgatctcatacggcggtgggtggaagcttgagggagaatggaaagagggcgaagaggtccaggtgctggcattggaaccaggcaagaatcccagagctgttcagactaaacctgggattttcaagaccaacacaggaaccatcggtgccgtaagtctagattttagcccaggcacatccgggtctcccatagtggacaggaaaggaaaggtcgtgggcctgtacggtaatggggttgtgactcgatcgggagcgtatgtcagcgccattgcacagaccgagaagtcaatcgaggataaccctgaaattgaggacgatatcttccggaaaaagcgcctcacgataatggacctgcatccgggcgctggcaaaacaaagagataccttcccgccattgtgagggaagctatcaaacgggggttacgaactctgatcctcgcaccaaccagagtagtcgccgccgagatggaagaggctttgcgcggactgcctattaggtatcaaacacccgcgatccgtgcagagcacaccggtcgggaaattgtggacctcatgtgtcatgccactttcaccatgagactgctttccccagttagggtgcctaactacaatctgataatcatggatgaggctcactttacagaccccgccagtattgcagcccgcggctatatctctacgcgagtcgaaatgggggaggctgcgggaatcttcatgactgccaccccaccgggcagcagagatccttttccccagtccaacgcaccaattatggacgaggaacgggagatacccgaaaggtcatggaattctggtcacgagtgggtgacagatttcaaggggaagaccgtttggtttgtgcctagcatcaaagctggaaacgacattgccgcatgcttgcgcaagaatggcaaaaaggtcatccagctaagtcgtaaaactttcgattccgaatacgtgaagacaagagccaacgactgggattttgtagtgaccacggacattagcgagatgggcgctaatttcaaggccgagcgggttatcgatccaaggcgctgtatgaaacccgtcatactgactgacggggaagagcgagtgatcctcgcgggacctatgccggtgacacattcttcagcagcccaaagacggggtaggattggccgcaacccaaagaatgaaaacgaccagtatatctacatgggggagcccttagaaaatgatgaggactgcgctcactggaaagaggccaagatgctgcttgataacattaatacccctgaaggaatcataccctccatgtttgagccagaaagagagaaagtcgacgctattgatggcgaatacaggctgcggggtgaggcacgtaagaccttcgtagacctcatgcgccgaggggatttgcctgtgtggctggcctataaagttgctgccgagggcatcaactacgcagacagaaagtggtgttttgatggaattaagaataaccagatcctcgaagagaacgtggaagtcgagatatggactaaagagggcgaaaggaagaaactgaagccccggtggcttgacgcgcgcatctatagtgatccactagccctgaaagagttcaaggaattcgctgccgggagaaagagcttgacattaaatctgattaccgagatgggaaggctccctacatttatgactcagaaagcacggaacgctctggacaatcttgccgtgctgcatacggcagaagttggtggccgagcctacacccacgctctctcggagttgccggagacactggaaactctactgctccttaccctgttagcgacagtgaccgggggaatcttcttgtttctgatgtctggcaagggtattgggaaaatgactctcggcatgtgctgcatcataacggcctccattctgctttggtatgcacaaatccagccccactggatcgctgccagcattatcctggagttctttctcatagtcttgctgattccagaacctgagaagcagagaaccccccaggataaccaattaacatacgtggtaatcgccattctaactgtggttgcagctaccatggccaatgaaatgggattcctggagaaaacaaagaaggacctcggctttgggtcaatcaccactcaggagagtgaatctaacatacttgacatcgatctgcgcccagcgtccgcttggacattgtatgccgtcgcaacgaccttcgtgactcctatgctgaggcatagcattgagaattcaagtgtgaacgtcagcctcacagccatcgctaatcaggcaaccgttctgatgggacttggtaaaggctggcccctctccaagatggacattggggtgccgctgttggccatcggatgttactctcaggtaaacccaattaccctgacagcggctttactactgctcgtggcccactacgcaatcataggccctggtcttcaagccaaagctactcgggaagcccagaagcgtgcagctgccgggattatgaaaaatcccacggtcgatggcatcaccgtgatcgacctggagccaattccctatgatcctaagtttgaaaagcagttgggacaggttatgctgctcatactgtgcgtgacacaagtccttatgatgagaactacctgggcgttatgtgaggccctgacactcgcaaccggcccgatcagcactttgtgggaggggaaccccggaaggttctggaatacgacaattgctgtatccatggccaacatctttcgcggctcatacctggcaggtgctgggctactgttctctattatgaaaaataccactaacacccggcgaggaacaggcaatgtgggtgaaactctcggcgagaagtggaaaagtagacttaacgccctggggaagtcggaatttcagatctataaaaagagcggaatacaggaggttgacaggaccttggccaaagagggcatcaagcgcggggaaacagatcatcacgcggtgtcccggggatctgctaagctgagatggttcgtcgagcgtaacatggtgacgccagaaggcaaagtcgtggacctcggttgcgggaggggaggctggtcatactattgtggtggcctgaagaatgttcgggaggtgaaagggttaaccaagggaggccctgggcatgaagagcccattcctatgagcacttacggatggaaccttgtacgcctgcaatccggcgtggatgtcttctttacaccacccgagaaatgcgacaccctcctatgtgatatcggtgaaagttctcctaatccaactattgaggcagggcgaacactgagagttttgaacctggtggaaaattggctcaacaataacacccagttctgcatcaaggtccttaatccctatatgccgagcgtgatagagaagatggaaacgctgcagaggaaatacggaggcgccttggtacggaaccctctgtcacgcaattccacccacgagatgtactgggtgagtaacgctacaggcaatattgttagctctgtgaacatgatctccagaatgctcatcaataggtttactatgaagcacaaaaaggccacctatgagccagacgtcgatttagggtcaggaacacgaaacattggtatagaaagcgagatccccaacctggacattatcggcaaacggattgaaaagatcaagcaggagcatgaaacttcgtggcactacgaccaagatcatccttataaaacctgggcataccacgggtcttatgagacaaagcagaccggaagtgcctccagcatggtgaatggcgtcgtgcgtcttctgactaaaccatgggacgttgtacccatggtgacgcagatggctatgacagataccactccgttcggtcagcaaagagtctttaaggagaaagtggacacccgcacacaggaacctaaggaggggacgaagaaactaatgaagataaccgcggaatggctctggaaagagctgggaaaggagaaaactcccaggatgtgtacacgggaagagttcaccagaaaggttcgctcaaacgccgcattgggcgctatctttactgatgaaaataaatggaagtccgccagggaggcagtggaagacggccgattctgggagctggtcgatcgggagagaaacctccaccttgaagggaagtgcgagacatgtgtgtacaatatgatgggaaaaagggaaaagaaactgggtgagtttggcaaggccaaagggtctcgcgctatttggtatatgtggttaggagcccgtttcctggaatttgaggcgttgggcttcctcaacgaggaccattggtttagccggggtaatagtctgtccggggtagaaggagagggcctacacagacttggctacatcctgagggaagtggggaagaaggagggaggtgcaatgtacgccgatgacaccgctggctgggatacacgcattactctcgaagacctgaaaaacgaggagatggttaccaatcatatgaagggggaacacaaaaagttggccgaggcaatcttcaaactgacgtatcagaacaaggtcgtgcgagtgcagcggccaacccctagaggaacagtcatggacattataagcaggaaggatcaacgcggctctggtcaggttgggacttacggactcaataccttcacaaacatggaagctcagcttatcagacaaatggagggcgagggcatttttaaatcaatccagcatctgactgccaccgaagagatcgctgtgcagaattggttagcccgggtagggagggaacgtctgagtcgaatggcaatttccggagacgattgcgtggtcaagcccatagacgatcgcttcgcgagcgccttgacggctctcaacgacatgggtaaagtgagaaaggatatccagcaatgggagccatctcggggctggaatgactggacacaggttcccttttgctcgcaccacttccatgaactggtgatgaaagatgggagggtcctagtggtaccttgtcgcaaccaggacgagcttattggaagagcccggatctcacagggcgcaggttggagcctgaaggagaccgcttgcctcgggaagtcctatgcccaaatgtggactctgatgtactttcacaggcgagatttgcgtttagcagccaacgcgatttgtagtgctgttccatctcattgggtgccgacaagcagaaccacttggtccatccacgccaaacacgaatggatgaccacagaggacatgctggcagtctggaatcgcgtgtggatacaggaaaacccctggatggaggataagacgcctgtggaatcatgggaggaggtcccatatctcggaaaacgggaagaccagtggtgcggcagtcttatcggcctgacctctagggccacttgggctaagaatattcagacagccatcaaccaagttagaagcctaattgggaatgagggatacaccgactatatgccctccatgaaacgcttccggagggaagaggaagaggcaggtgtgctgtggtga

SEQ ID NO: 14425 - RNA, 9876 nt, synthetic construct
  misc_feature 1..9876: note = derived and/or modified CDS sequence (opt3) from DENV-2__JF730044__SS-prME
  source 1..9876: mol_type = other RNA
accgccggcgtgatcattatgctgatacccacagctatggcattccacctcactacgcggaacggggaacctcatatgatcgtcggaaggcaggaaaagggtaaaagccttctgtttaagaccgaagacggcgttaatatgtgcacattgatggccattgatttaggggaactgtgtgaagacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaaggaacctgcgacccttcggaaatattgcatcgaggcaaagttgacaaacactaccacagagagtcgctgtccaactcagggagaaccctccctgaatgaggaacaagacaaacgatttgtgtgcaagcattctatggtcgatagaggctggggtaacgggtgtggactattcggcaagggcgggatcgtgacctgcgccatgtttacatgcaaaaagaatatggagggaaaaattgtgcagcctgaaaacctcgagtacaccatagtcatcactccacacagcggtgaggaacatgctgttggcaatgacacggggaagcacggaaaagagattaagatcacaccgcagtcctcaagtaccgaagccgagctgactggctatggtaccgtgacaatggaatgtagccccaggaccgggcttgatttcaacgagatggtactgttgcagatggaggacaaagcatggctcgtgcaccggcaatggtttctggatttacctctgccatggctccccggcgctgacactcagggatctaattggatacagaaggaaacacttgtcacgttcaagaaccctcatgccaaaaagcaggacgtggttgtgctgggctcccaagagggggcgatgcacaccgccttgactggagcaacagaaattcagatgtcaagcggtaatctactgtttaccggccatctcaaatgccgtctgcgcatggataaacttcagctgaaagggatgagttactctatgtgtacaggaaagttcaagatcgtcaaagagatcgctgagactcaacacggcaccattgtgatcagagtacagtatgaaggtgacgggtccccatgcaagattcccttcgagataatggatttggagaagaggcatgttctcggccggctgatcacggtgaacccgattgtcaccgagaaggacagccctgtgaacatcgaagccgagcccccatttggagattcgtacatcattataggcgtcgagcctgggcagttaaaactgaattggttcaagaagggatcttccatcggtcagatgtttgaaacaactatgcgaggcgctaaacgcatggccattctaggggacaccgcatgggatttcggatcactcggcggtgtgtttacaagtatggggaaggccctgcaccaagttttcggcgctatctacggagcggcatttagcggcgtgtcctggactatgaaaattcttatcggggtaataatcacctggattggaatgaactctagaagcacgtcattgagtgtctccctggtgctcgttggcgtgatcacactgtatcttggtgccatggtccaggctgacagcgggtgtgtggtatcttggaagaataaagagctgaagtgcggatcaggcattttcatcaccgataacgtgcacacttggacagaacagtacaagtttcagcccgagagtccaagcaaattggcctccgcaatacaaaaggcccatgaagagggtatttgtggcatcaggtctgttacccggctcgagaatctgatgtggaaacagattactcccgaattaaaccacatcctgtcggagaatgaagtcaagctaaccataatgacaggggacatcaaaggaattatgcaggctggcaagcgcagcctcagacctcagccaacggagctgaaatattcctggaagacctgggggaaggccaaaatgctttcaactgaaagtcataaccaaacattcttgatcgatggaccggagaccgcagagtgccccaatacaaacagggcgtggaactctctggaagtggaggactacggctttggtgtgttcactaccaacatttggctcaagctgcgtgaaaaacaggacgtcttttgtgatagcaagttaatgtccgctgccatcaaagacaatcgggcagttcacgccgatatggggtattggatagagtcagctctgaacgacacgtggaagatggagaaggccagcttcattgaagtgaaatcttgccactggcctaagtcccatacactttggagtaatggagtgttggagagcgaaatgatcatcccaaaatctttcgcaggccccgtatcccagcacaactaccgacctggttattacacccagactgctggcccatggcatctcgggaagctggagatggattttgacttctgtgaaggaaccacagtcgtggttactgaggattgcggcaacagagggccctcactaaggaccacaacggccagtggaaaactgattaccgagtggtgctgtcgcagctgcactctcccgcctctgcggtacagaggcgaagacggttgttggtatgggatggagatcaggccacttaaggaaaaggaggaaaatttggtgaactcgctggtcacagcgggacacggccaaattgataatttttccttaggtgtgctcggcatggccctgttccttgaggagatgctgcgcacccgagttgggactaaacatgctatattgctcgtggcagtatcttttgtcacactgatcaccggaaacatgagcttccgggacctaggccgtgtgatggtgatggtcggggccacgatgactgatgacattggaatgggcgttacctacctggctctcctggccgcatttaaggtgagacccacattcgcggccggtcttttgctgaggaaattaacctcaaaggaactcatgatggctactatcgggattgccctgcttagtcagtccacaatccctgagaccatactggaactaacagatgcactcgctctgggaatgatggtattgaaaatcgtgcgcaatatggagaagtatcagctggccgtcactattatggcaatctcttgcgtgcccaacgccgttattttacaaaatgcttggaaggtgagctgtaccatcctcgcggccgtctccgtgtcaccactgcttctgacgagcagtcagcagaaagcagactggatacctttggctctcacaattaagggcctgaaccccaccgccatctttctaactaccctgtctcggacatccaaaaagagaagctggccacttaatgaagccatcatggctgttggcatggtgtcgattctcgcatcatctctgttgaaaaacgacataccgatgactgggcctctggtcgccggaggtttactcaccgtatgctacgtgctgacgggcaggagtgcggatcttgagctggagcgagctacagacgttaagtgggaagatcaggccgagatctccgggagctctcccattttgagcatcaccatttccgaagacggatcaatgagtatcaaaaatgaggaggaagaacaaactctcacaatactgatccgcaccggcctactggtgattagcggtcttttcccagtctctatccccattactgcagccgcttggtatctctgggaagtgaagaagcagcgggcaggggtactgtgggatgtgccttccccaccccctgtcggaaaagccgagttggaagacggcgcgtacagaatcaagcagaaaggcatattagggtattcacagattggagctggtgtttacaaggagggcacatttcacaccatgtggcacgtgacgagaggggcagtgctgatgcatcgtggaaaacgcatcgagccgagttgggcagatgtcaagaaggacctcatcagctacggcggtgggtggaaactggaaggagagtggaaggaaggcgaggaagtgcaagttcttgccctggagccaggcaaaaacccccgggctgtacagactaagcctgggttgttcaaaaccaatacaggaaccattggtgccgtgtccctagatttttctccaggcacatcggggagccccatcgtcgacagaaagggaaaggtggttggcctgtatggtaacggggtggtcactaggtcaggagcatacgtgtccgctatagcccagaccgagaaaagtattgaagataatcctgagatcgaagacgatattttccgaaagaaacggctcacgatcatggacctgcacccgggcgcgggcaagacaaaacgctatcttcccgccatagtaagagaggcaattaagagggggttacggactctgatcctcgctccaacccgagtcgtggccgctgaaatggaggaggcattgagaggactgcctatccgctaccagacacccgccattagggccgaacataccggtcgtgagatcgttgacctcatgtgtcacgctactttcaccatgcggctgctttctccagtgagagtccctaactataacctgattataatggatgaagcgcattttacagaccccgcaagcatcgccgctaggggctacatttccacgcgcgtggagatgggggaggccgcaggaatcttcatgactgccaccccaccgggctcacgagatccttttccccaatctaatgctccaatcatggacgaagagagagaaattcccgagcggagctggaacagtggtcacgaatgggttacagatttcaaggggaaaaccgtgtggtttgtcccttccataaaggcgggaaatgacatcgccgcatgcttgaggaaaaacggcaagaaagtgattcagctaagccgcaagactttcgattctgagtatgtaaagacacgtaccaatgactgggattttgtggttacgactgacatctcagagatgggcgctaacttcaaagccgaaagagtcattgatccacggaggtgtatgaagcccgtgatcctgacagacggggaggaacgcgtgatactcgcaggacctatgccggtcacccactccagtgccgctcagcgaagaggtcggatcggcaggaatcccaagaatgagaatgaccaatacatttacatgggggaacccttagagaacgatgaggactgcgcccattggaaggaagcgaaaatgctgcttgataatatcaacacccctgagggaattatccccagcatgtttgaaccagagcgcgaaaaggtagacgcaatagatggcgagtatagactgaggggtgaggcccggaaaactttcgtggacctcatgcgtcgcggggatttgcctgtttggctggcttaccgagtggccgctgaaggcattaattatgcagacagaaggtggtgttttgatggagtcaagaacaatcagatcctcgaggaaaacgtggaggttgagatttggacaaaggaaggcgagcggaaaaagctgaaaccccgctggcttgacgccagaatctactcggatccactagctctgaaggagttcaaagagttcgccgcagggaggaagtctttgaccttaaacctgataacagaaatgggacggctccctacttttatgacgcagaaggcgcgagacgccctggataatcttgctgtgctgcacaccgccgaggccggtggcagagcttataaccatgccctctccgagttgccggaaacactggagactctactgctccttaccctgttagcaacagtcaccgggggaatcttcttgtttctgatgagcggcaaaggtgtggggaagatgactctcggcatgtgctgcattatcacggcctcaattctgctttggtacgctcagatccaaccccactggatagcggccagtattatcctggagttctttctcatcgtattgctgattccagagcctgaaaaacagcgcacaccacaagacaatcagttaacatatgtggttatcgcaatactaactgtcgtggctgccaccatggccaacgagatgggattcctggagaagaccaaaaaggacctcggccttgggtctattgcaacccaagaaccagagtccaatatcctggatattgacttgaggcctgctagcgcctggactctgtacgcggtggctacaacgtttgtcacccccatgctccggcactcaatcgaaaacagtagcgttaatgtgtccctgactgccatagcaaaccaggccacagtacttatgggactcggtaagggctggccgctgtctaaaatggatatcggggtgccattgctggctattggatgttacagccaggtcaatcctgtgaccttaaccgcagccctactgctccttgttgcgcattatgctatcattggccccggtctgcaggccaaggcaacacgtgaggcccagaaaagggctgccgcagggatcatgaagaacccaactgtggacggcattacggtcatcgatttggaccccataccttacgatccgaaattcgaaaagcagctgggacaggtaatgctcctgattctttgcgtgacccaggttttaatgatgaggacaacttgggctctgtgtgaggccctcaccttggcgacaggccccatctccaccctgtgggaggggaatccaggacgcttttggaacactacgatcgccgtgtcaatggcaaatattttccggggctcttatctagctggtgccgggctgctctttagtataatgaagaacacaaccaatactcgaagaggaaccggcaacatcggtgaaacacttggcgagaaatggaagtcgaggctgaatgcattggggaaaagcgagttccaaatttacaagaaatccggaatccaggaggtcgaccgcactctggctaaggagggcattaaaagaggggaaaccgatcaccatgccgtgtctagaggatcagccaagctccgttggtttgtcgagaggaacatggtgacacctgaaggcaaggttgtggacctgggttgcgggcggggaggctggagctattactgtggtggccttaaaaacgtaaaggaggtgaaagggctaacgaagggaggccccgggcacgaagaacctatcccaatgtccacctatggatggaatctggtccgcctccagagtggcgttgatgtgttcttcactccccctgagaaatgcgacacactactgtgtgatataggtgaatctagcccaaaccccaccatcgaggcggggcgaactttgagagtcctgtcactcgtggaaaattggcttaacaatgacacacaattttgcattaaggtactgaacccgtacatgccttccgtgatcgagaagatggaaaccttgcagaggaaatacggaggcgctctggttcggaatccactcagtcgcaacagcacgcatgagatgtattgggtgtctaatgcaaccggcaacattgtctcctcagtgaatatgatcagcagaatgttaataaacaggttcacaatgaagcacaaaaaggccacttacgagcccgacgtcgatctggggtcgggaacccgaaatattggtatcgaatctgagatccctaaccttgacattataggcaaacggatcgaaaagattaagcaggagcacgaaacaagttggcattatgatcaggaccacccatacaaaacttgggcttatcatgggtcctacgagaccaagcaaacaggaagcgcctcatccatggtgaatggcgttgtacgtctgctaaccaaaccctgggatgtggtcccgatggtgactcagatggcaatgacggacacaaccccttttggtcagcagagagttttcaaggagaaagtggatactcgcacccaagaacccaaggaggggacaaagaaactcatgaagatcacggccgaatggctgtggaaagagttgggaaagaaaaagaccccaaggatgtgtactcgggaggaatttacaagaaaagtccgctctaacgctgcgctgggcgccattttcaccgacgagaacaagtggaaaagcgcaagggaagctgtggaggatagtcgattttgggaactcgtagacaaagagcggaatcttcacctggagggcaagtgcgaaacttgtgtgtataacatgatggggaaaagagagaagaaattaggagagttcggtaaggccaagggctccagggcaatctggtacatgtggctgggggcccgctttttggagttcgaagctctcggatttctgaatgaggatcactggttcagccgtgagaactctctatcaggcgttgaaggtgaggggcttcataaactgggatacatactccgggacgtcggcaagaaagaaggcggggccatgtatgcggacgatacagcaggatgggacaccagaatcacactggaggatttgaagaatgaagagatggtgactaaccacatggagggtgaacataaaaagctggccgaggctatttttaagctcacctaccagaataaagtggtcagggttcagcgccctacgccccgaggcaccgtgatggacatcattagtcggagagatcagagggggtccggacaagtaggcacatatggtcttaacactttcaccaatatggaagcccagctgatccgccagatggagggggagggaattttcaagagcatacaacacttaacagcaactgaagagatcgctgtgcagaactggctggccagagtcggccgggaaaggttgtctcgtatggctatttcgggcgacgattgcgtggttaaaccactcgacgatcgatttgcctcagcactgaccgcgctaaatgacatggggaaggtgcgcaaagatatccagcagtgggagcccagcagaggatggaacgactggacgcaagtccctttctgctcccatcactttcacgaacttatcatgaaggatggtcgggtgctggtagttccatgtaggaatcaggacgagctcattggccgcgccagaataagtcagggggctggatggtctctgaaggagacagcctgcttgggcaaaagctacgcacagatgtggtccttaatgtatttccatcggagggacctgcgactcgctgccaacgcaatctgttcagccgtgccgagtcactgggtccccacctctcgtactacatggagcattcatgcgaagcacgaatggatgaccactgaggatatgcttaccgtgtggaatagagtgtggatccaagaaaacccttggatggaggacaaaacaccagtcgaatcctgggaggaggttccctacctgggtaagcgcgaagatcagtggtgcgggtcactaattggactgacgagccgggctacctgggccaaaaacatccagactgcaataaatcaggtgaggtctctcatcggcaacgaggaatatacagactacatgccttccatgaagagatttcgccgggaggaagaggaggccggcgtattgtggtga

SEQ ID NO: 14426 - RNA, 9876 nt, synthetic construct
  misc_feature 1..9876: note = derived and/or modified CDS sequence (opt3) from DENV-2__FJ639697__SS-prME
  source 1..9876: mol_type = other RNA
accgccggcgtgatcattatgctgatacccacagctatggcattccacctcactacgcggaacggggaacctcatatgatcgtcggaaggcaggaaaagggtaaaagccttctgtttaagaccgaagacggcgttaatatgtgcacattgatggccattgatttaggggaactgtgtgaagacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaaggaacctgcgacccttcggaaatattgcatcgaggcaaagttgacaaacactaccacagagagtcgctgtccaactcagggagaaccctccctgaatgaggaacaagacaaacgatttgtgtgcaagcattctatggtcgatagaggctggggtaacgggtgtggactattcggcaagggcgggatcgtgacctgcgccatgtttacatgcaaaaagaatatggagggaaaaattgtgcagcctgaaaacctcgagtacaccatagtcatcactccacacagcggtgaggaacatgctgttggcaatgacacggggaagcacggaaaagagattaagatcacaccgcagtcctcaagtaccgaagccgagctgactggctatggtaccgtgacaatggaatgtagccccaggaccgggcttgatttcaacgagatggtactgttgcagatggaggacaaagcatggctcgtgcaccggcaatggtttctggatttacctctgccatggctccccggcgctgacactcagggatctaattggatacagaaggaaacacttgtcacgttcaagaaccctcatgccaaaaagcaggacgtggttgtgctgggctcccaagagggggcgatgcacaccgccttgactggagcaacagaaattcagatgtcaagcggtaatctactgtttaccggccatctcaaatgccgtctgcgcatggataaacttcagctgaaagggatgagttactctatgtgtacaggaaagttcaagatcgtcaaagagatcgctgagactcaacacggcaccattgtgatcagagtacagtatgaaggtgacgggtccccatgcaagattcccttcgagataatggatttggagaagaggcatgttctcggccggctgatcacggtgaacccgattgtcaccgagaaggacagccctgtgaacatcgaagccgagcccccatttggagattcgtacatcattataggcgtcgagcctgggcagttaaaactgaattggttcaagaagggatcttccatcggtcagatgtttgaaacaactatgcgaggcgctaaacgcatggccattctaggggacaccgcatgggatttcggatcactcggcggtgtgtttacaagtatggggaaggccctgcaccaagttttcggcgctatctacggagcggcatttagcggcgtgtcctggactatgaaaattcttatcggggtaataatcacctggattggaatgaactctagaagcacgtcattgagtgtctccctggtgctcgttggcgtgatcacactgtatcttggtgccatggtccaggctgacagcgggtgtgtggtatcttggaagaataaagagctgaagtgcggatcaggcattttcatcaccgataacgtgcacacttggacagaacagtacaagtttcagcccgagagtccaagcaaattggcctccgcaatacaaaaggcccatgaagagggtatttgtggcatcaggtctgttacccggctcgagaatctgatgtggaaacagattactcccgaattaaaccacatcctgtcggagaatgaagtcaagctaaccataatgacaggggacatcaaaggaattatgcaggctggcaagcgcagcctcagacctcagccaacggagctgaaatattcctggaagacctgggggaaggccaaaatgctttcaactgaaagtcataaccaaacattcttgatcgatggaccggagaccgcagagtgccccaatacaaacagggcgtggaactctctggaagtggaggactacggctttggtgtgttcactaccaacatttggctcaagctgcgtgaaaaacaggacgtcttttgtgatagcaagttaatgtccgctgccatcaaagacaatcgggcagttcacgccgatatggggtattggatagagtcagctctgaacgacacgtggaagatggagaaggccagcttcattgaagtgaaatcttgccactggcctaagtcccatacactttggagtaatggagtgttggagagcgaaatgatcatcccaaaatctttcgcaggccccgtatcccagcacaactaccgacctggttattacacccagactgctggcccatggcatctcgggaagctggagatggattttgacttctgtgaaggaaccacagtcgtggttactgaggattgcggcaacagagggccctcactaaggaccacaacggccagtggaaaactgattaccgagtggtgctgtcgcagctgcactctcccgcctctgcggtacagaggcgaagacggttgttggtatgggatggagatcaggccacttaaggaaaaggaggaaaatttggtgaactcgctggtcacagcgggacacggccaaattgataatttttccttaggtgtgctcggcatggccctgttccttgaggagatgctgcgcacccgagttgggactaaacatgctatattgctcgtggcagtatcttttgtcacactgatcaccggaaacatgagcttccgggacctaggccgtgtgatggtgatggtcggggccacgatgactgatgacattggaatgggcgttacctacctggctctcctggccgcatttaaggtgagacccacattcgcggccggtcttttgctgaggaaattaacctcaaaggaactcatgatggctactatcgggattgccctgcttagtcagtccacaatccctgagaccatactggaactaacagatgcactcgctctgggaatgatggtattgaaaatcgtgcgcaatatggagaagtatcagctggccgtcactattatggcaatctcttgcgtgcccaacgccgttattttacaaaatgcttggaaggtgagctgtaccatcctcgcggccgtctccgtgtcaccactgcttctgacgagcagtcagcagaaagcagactggatacctttggctctcacaattaagggcctgaaccccaccgccatctttctaactaccctgtctcggacatccaaaaagagaagctggccacttaatgaagccatcatggctgttggcatggtgtcgattctcgcatcatctctgttgaaaaacgacataccgatgactgggcctctggtcgccggaggtttactcaccgtatgctacgtgctgacgggcaggagtgcggatcttgagctggagcgagctacagacgttaagtgggaagatcaggccgagatctccgggagctctcccattttgagcatcaccatttccgaagacggatcaatgagtatcaaaaatgaggaggaagaacaaactctcacaatactgatccgcaccggcctactggtgattagcggtcttttcccagtctctatccccattactgcagccgcttggtatctctgggaagtgaagaagcagcgggcaggggtactgtgggatgtgccttccccaccccctgtcggaaaagccgagttggaagacggcgcgtacagaatcaagcagaaaggcatattagggtattcacagattggagctggtgtttacaaggagggcacatttcacaccatgtggcacgtgacgagaggggcagtgctgatgcatcgtggaaaacgcatcgagccgagttgggcagatgtcaagaaggacctcatcagctacggcggtgggtggaaactggaaggagagtggaaggaaggcgaggaagtgcaagttcttgccctggagccaggcaaaaacccccgggctgtacagactaagcctgggttgttcaaaaccaatacaggaaccattggtgccgtgtccctagatttttctccaggcacatcggggagccccatcgtcgacagaaagggaaaggtggttggcctgtatggtaacggggtggtcactaggtcaggagcatacgtgtccgctatagcccagaccgagaaaagtattgaagataatcctgagatcgaagacgatattttccgaaagaaacggctcacgatcatggacctgcacccgggcgcgggcaagacaaaacgctatcttcccgccatagtaagagaggcaattaagagggggttacggactctgatcctcgctccaacccgagtcgtggccgctgaaatggaggaggcattgagaggactgcctatccgctaccagacacccgccattagggccgaacataccggtcgtgagatcgttgacctcatgtgtcacgctactttcaccatgcggctgctttctccagtgagagtccctaactataacctgattataatggatgaagcgcattttacagaccccgcaagcatcgccgctaggggctacatttccacgcgcgtggagatgggggaggccgcaggaatcttcatgactgccaccccaccgggctcacgagatccttttccccaatctaatgctccaatcatggacgaagagagagaaattcccgagcggagctggaacagtggtcacgaatgggttacagatttcaaggggaaaaccgtgtggtttgtcccttccataaaggcgggaaatgacatcgccgcatgcttgaggaaaaacggcaagaaagtgattcagctaagccgcaagactttcgattctgagtatgtaaagacacgtaccaatgactgggattttgtggttacgactgacatctcagagatgggcgctaacttcaaagccgaaagagtcattgatccacggaggtgtatgaagcccgtgatcctgacagacggggaggaacgcgtgatactcgcaggacctatgccggtcacccactccagtgccgctcagcgaagaggtcggatcggcaggaatcccaagaatgagaatgaccaatacatttacatgggggaacccttagagaacgatgaggactgcgcccattggaaggaagcgaaaatgctgcttgataatatcaacacccctgagggaattatccccagcatgtttgaaccagagcgcgaaaaggtagacgcaatagatggcgagtatagactgaggggtgaggcccggaaaactttcgtggacctcatgcgtcgcggggatttgcctgtttggctggcttaccgagtggccgctgaaggcattaattatgcagacagaaggtggtgttttgatggagtcaagaacaatcagatcctcgaggaaaacgtggaggttgagatttggacaaaggaaggcgagcggaaaaagctgaaaccccgctggcttgacgccagaatctactcggatccactagctctgaaggagttcaaagagttcgccgcagggaggaagtctttgaccttaaacctgataacagaaatgggacggctccctacttttatgacgcagaaggcgcgagacgccctggataatcttgctgtgctgcacaccgccgaggccggtggcagagcttataaccatgccctctccgagttgccggaaacactggagactctactgctccttaccctgttagcaacagtcaccgggggaatcttcttgtttctgatgagcggcaaaggtgtggggaagatgactctcggcatgtgctgcattatcacggcctcaattctgctttggtacgctcagatccaaccccactggatagcggccagtattatcctggagttctttctcatcgtattgctgattccagagcctgaaaaacagcgcacaccacaagacaatcagttaacatatgtggttatcgcaatactaactgtcgtggctgccaccatggccaacgagatgggattcctggagaagaccaagaaggacctcggccttgggtctattgcaacccaagaaccagagtccaatatcctggatattgacttgaggcctgctagcgcctggactctgtacgcggtggctacaacgtttgtcacccccatgctccggcactcaatcgaaaacagtagcgttaatgtgtccctgactgccatagcaaaccaggccacagtacttatgggactcggtaagggctggccgctgtctaaaatggatatcggggtgccattgctggctattggatgttacagccaggtcaatcctgtgaccttaaccgcagccctactgctccttgttgcgcattatgctatcattggccccggtctgcaggccaaggcaacacgtgaggcccagaaaagggctgccgcagggatcatgaagaacccaactgtggacggcattacggtcatcgatttggaccccataccttacgatccgaaattcgaaaagcagctgggacaggtaatgctcctgattctttgcgtgacccaggttttaatgatgaggacaacttgggctctgtgtgaggccctcaccttggcgacaggccccatctccaccctgtgggaggggaatccaggacgcttttggaacactacgatcgccgtgtcaatggcaaatattttccggggctcttatctagctggtgccgggctgctctttagtataatgaagaacacaaccaatactcgaagaggaaccggcaacatcggtgaaacacttggcgagaaatggaagtcgaggctgaatgcattggggaaaagcgagttccaaatttacaagaaatccggaatccaggaggtcgaccgcactctggctaaggagggcattaaaagaggggaaaccgatcaccatgccgtgtctagaggatcagccaagctccgttggtttgtcgagaggaacatggtgacacctgaaggcaaggttgtggacctgggttgcgggcggggaggctggagctattactgtggtggccttaaaaacgtaaaggaggtgaaagggctaacgaagggaggccccgggcacgaagaacctatcccaatgtccacctatggatggaatctggtccgcctccagagtggcgttgatgtgttcttcactccccctgagaaatgcgacacactactgtgtgatataggtgaatctagcccaaaccccaccatcgaggcggggcgaactttgagagtcctgtcactcgtggaaaattggcttaacaatgacacacaattttgcattaaggtactgaacccgtacatgccttccgtgatcgagaagatggaaaccttgcagaggaaatacggaggcgctctggttcggaatccactcagtcgcaacagcacgcatgagatgtattgggtgtctaatgcaaccggcaacattgtctcctcagtgaatatgatcagcagaatgttaataaacaggttcacaatgaagcacaaaaaggccacttacgagctggacgtcgatcttgggtcgggaacccgaaatattggtatcgaatctgagatccccaacctggacattataggcaaacggatcgaaaagattaagcaggagcacgaaacaagttggcattatgatcaggaccacccttacaaaacttgggcttatcatgggtcctacgagaccaagcaaacaggaagcgcctcatccatggtgaatggcgttgtacgtctactcaccaaaccatgggatgtggtccccatggtgactcagatggcaatgacggacacaaccccgtttggtcagcagagagttttcaaggagaaagtggatactcgcacccaagaacctaaggaggggacaaagaaactgatgaagatcacggccgaatggttgtggaaagagctgggaaagaaaaagacccccaggatgtgtactcgggaggaatttacaagaaaagtccgctctaacgctgcgctcggcgccattttcaccgacgagaacaagtggaaaagcgcaagggaagctgtggaggatagtcgattttgggaacttgtagacaaagagcggaatctgcacttagagggcaagtgcgaaacttgtgtgtataacatgatggggaaaagagagaagaaactgggagagttcggtaaggccaagggctccagggcaatctggtacatgtggttgggggcccgctttctcgagttcgaagctctgggatttctaaatgaggatcactggttcagccgtgagaactctctttcaggcgttgaaggtgaggggctgcataaactcggatacatactgcgggacgtcggcaagaaagaaggcggggccatgtatgcggacgatacagcaggatgggacaccagaatcacattggaggatctgaagaatgaagagatggtgactaaccacatggagggtgaacataaaaagctcgccgaggctatttttaaacttacctaccagaataaagtggtcagggttcagcgcccaacgcctcgaggcaccgtgatggacatcattagtcggagagatcagagggggtccggacaagtaggcacatatggtctgaacactttcaccaatatggaagcccagttaatccgccagatggagggggagggaattttcaagagcatacaacacctgacagtgactgaagagatcgcagtccagaactggttggctagagtgggccgggaaaggctctctcgtatggccatttcgggcgacgattgcgttgtgaaacccctggacgatcgatttgcttcagccctaaccgcacttaatgacatggggaaggtccgcaaagatatccagcagtgggagccaagcagaggatggaacgactggacgcaagtgcccttctgctcccatcactttcacgaactgatcatgaaggatggtcgggtactcgttgtgccttgtaggaatcaggacgagctgattggccgcgcgagaataagtcagggggccggatggtctttgaaggagacagcttgcttaggcaaaagctacgcccagatgtggtccctgatgtatttccatcggagggacctccgacttgcagctaacgccatctgttcagcagtcccaagtcactgggtgccgacctctcgtactacatggagcattcatgccaagcacgaatggatgaccactgaggatatgctgaccgtgtggaatagagtctggatccaagaaaacccctggatggaggacaaaacacctgttgaatcctgggaggaggtgccatacctaggtaagcgcgaagatcagtggtgcgggtcactgattggactcacgagccggaccacttgggcgaaaaacatccagacagctataaatcaggtaaggtctttgatcggcaacgaggaatataccgactacatgccctccatgaagagatttcgccgggaggaagaggaggccggcgtgctgtggtga

SEQ ID NO: 14427 - RNA, 9876 nt, synthetic construct
  misc_feature 1..9876: note = derived and/or modified CDS sequence (opt3) from DENV-2__FJ639698__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgcccagaggatcgagacctggatactgcggcatcctggcttcacaatcatggcagccattttggcttacaccatcggcacgactcactttcagcgcgcactcattttcatcctgctgacagccgtggctccatccatgaccatgagatgcatagggatttctaacagggattttgttgaaggagtgtcgggtggctcatgggtcgacatcgtgctcgagcacgggagctgtgtaactacaatggccaagaataagcccaccttagatttcgaactgattaaaacggaggcgaaggaacctgcaacccttcggaaatattgcatcgaggccaagttgacaaacactaccacagagagtcgctgtccaactcagggagaaccctccctgaatgaggaacaagacaaacgatttgtttgcaagcattctatggtggatagaggctggggtaacgggtgtggactattcggcaagggcgggatcgtcacctgcgctatgtttagctgcaaaaagaatatggagggaaaaattgtgcagcctgaaaacctcgagtacacaatagtgatcaccccacactccggtgaggaacatgccgtcggcaatgacactgggaagcacggaaaagagattaagatcacgccgcagtcaagtataacagaagcagagctgaccggctatggtactgttaccatggaatgtagccccaggacagggcttgatttcaacgagatggtgctgttgcagatggaggacaaagcttggctcgtacaccggcaatggtttctggatttacctctgccatggctccccggcgccgacacccagggatctaattggattcagaaggaaactcttgtgacattcaagaaccctcatgcgaaaaagcaggacgtcgtggttctgggctcccaagagggggccatgcacacggcattgaccggagctactgaaatccagatgtcaagcggtaatctactgtttacaggccatctcaaatgccgtctgcgcatggataagcttcagctgaaagggatgagttactctatgtgtaccggaaagttcaagatcgtgaaagagattgccgagacacaacacggcactatcgtcattagagtgcagtatgaaggtgacgggtccccatgcaagatacccttcgagatcatggatttggaaaaaaggcatgtactcggccggctgattaccgttaacccgatcatcacggagaaggacagccctgtgaacattgaagctgagcccccatttggagattcgtacataatcattggcgtcgagcctgggcagttaaaactgaattggttcaagaagggatcttccatcggtcagatgtttgaaaccacaatgcgaggcgccaaacgcatggcaattctaggggacactgcctgggatttcggatcactcggcggtgtgtttaccagtatcgggaaggctctgcaccaagtcttcggcgcgatatacggagcagcctttagcggcgtgtcctggacaatgaaaatccttattggggttatcattacttggatcggaatgaactctagaagcacctcattgagtgtgtccctggtactcgtcggcgtgataacgctgtatcttggtgctatggttcaggccgacagcgggtgtgtggtctcttggaagaataaagagctgaagtgcggatcaggcattttcatcacagataacgtgcacacctggactgaacagtacaagtttcagcccgagagtccaagcaaattggcatccgccattcaaaaggctcatgaagagggtatctgtggcataaggtctgtaacacggctcgagaatctgatgtggaaacagatcacccccgaattaaaccacattctgtcggagaatgaagtgaagctaactatcatgaccggggacattaaaggaatcatgcaggccggcaagcgcagcctcagacctcagccaacagagctgaaatattcctggaagacgtgggggaaggcaaaaatgctttcaaccgaaagtcataaccaaactttcttgatagatggaccggagacagcggagtgccccaataccaacagggcttggaattctctggaagttgaggactacggctttggtgtcttcacaactaacatttggctcaagctgaaagaaaagcaggacgtgttttgtgatcctaaattaatgagcgccgcaatcaaggacaatcgtgccgtgcacgctgatatggggtattggatcgagtccgccctgaacgacacctggaagatggagaaagcatcattcattgaagtcaagagctgccactggccaaaatctcatacgctttggtccaatggagttttggagagtgaaatgatcattcccaagggcttcgctggtcctgtgagccagcacaactaccggccaggctattacacacagaccgccgggccctggcatctcggaaaactggagatggattttgacttctgtgaaggcactaccgtggtagtcacagaggattgcgggaaccgaggaccgtctctaagaactaccacagcgtccggcaagctgataacggagtggtgctgtaggtcatgcaccctccctccactgcgctaccggggtgaagacgggtgttggtatggaatggagatcagaccccttaaggaaaaagaggaaaatttggtgaacagtctggttactgccggccacggtcaaattgataattttagcttaggcgtgctcgggatggctctgttccttgaggagatgctgaggacacgcgtcggaaccaagcatgcaatcttgctcgtggccgtttcgtttgtgactctgattacaggcaacatgtccttccgagacctagggcgggtaatggtcatggtgggagctaccatgacggatgacatcggcatgggtgtgacttacctggccctcctggcagcgtttaaagtccgtcctaccttctctgccgggcttttgctgagaaagttaacaagcaaagaactcatgatggctaccataggaatcgccctgctttcacagagtactattcccgagacaatcctggaactaaccgatgcactcgctctgggcatgatggttttgaagattgtgaggaatatggagaagtatcagctggccgtaacaatcatggcaatatcctgcgtgccaaacgccgtcattttacaaaatgcttggaaagtgtcttgtactatcctcgcggccgttagcgtgtcccctctgcttctgacctcaagccagcagaaggcagactggatccccttggctctcacgattaaaggcctgaacccaacagccatatttctaaccactctgagtcgcacctctaagaaacggtcctggccgcttaatgaagccatcatggctgtcgggatggtgagcattctcgcatcgtcactgttgaagaacgacatccctatgacaggacccctggttgccggtggcttactcactgtgtgctacgtcctgaccgggagatctgcggatcttgagctggagagggctacggacgtaaaatgggaagatcaggccgagattagtggatccagcccaatcttgtctataacaatcagcgaagacggctccatgtcaattaagaatgaggaggaagagcaaaccctcactatcctgattcgaacaggtctactggtgatcagtgggcttttccccgttagcatacctattaccgcagccgcttggtatctctgggaagtgaagaaacagcgcgcaggagtcctgtgggatgtgccatctccccctccggtaggcaaggccgagttggaagacggcgcgtaccggatcaaacagaaggggatcttaggatattcccagattggtgctggcgtgtacaaagaggggacttttcacacaatgtggcacgtcaccagaggagccgttctgatgcataggggcaagcgtatcgagccatcatgggcagatgtgaagaaagacctcataagttacggtgggggatggaagctggaaggcgagtggaaagaaggcgaggaagtgcaagtccttgccctggagcccgggaagaaccctcgcgctgtgcagacgaaaccaggattgttcaagactaataccggtacaattggcgccgttagcctagatttttcccccgggacctctggatcgcctatcgtagaccggaagggcaaagtggtcggtctgtatgggaacggagtggttacaagaagcggcgcatacgtgtcagctattgcccagactgagaagtccatcgaagataatccggagatagaagacgatattttcaggaaaaagcgactcaccatcatggacctgcaccccggcgcggggaaaacgaagcggtatcttccagccatcgtccgcgaggcaattaagagaggattaaggacactgatcctcgctcctactcgggtggtagccgctgaaatggaggaggcattgcgaggtctgcccattagataccagaccccagccatacgcgccgaacatacaggcagggagatcgtcgacctcatgtgtcacgctaccttcactatgcgtctgcttagtcctgtgcgggttcccaactataacctgattatcatggatgaagcgcattttaccgacccagcatctatcgccgctagagggtacattagcacaagggtggagatgggagaggccgcaggcatattcatgacggccactccgcctggttcccgcgatccctttccacaatcaaatgctcccatcatggacgaagagcgagaaattcctgagagatcttggaacagcgggcacgaatgggtcaccgatttcaaaggaaagacagtgtggtttgttccaagtatcaaagcgggcaatgacattgccgcatgcttgcggaagaacggcaaaaaggtgatccagctatccaggaagaccttcgatagcgagtatgtcaaaactcgcacaaatgactgggattttgtggtaaccacggacatatctgagatgggggctaacttcaaggccgaacgtgtgatcgatcccagacggtgtatgaaacctgttattctgactgacggagaggaaagggtcatcctcgcaggtccgatgccagtgacacactcatccgccgctcagcgccgaggcagaattgggcggaatcccaagaacgagaatgaccaatacatctacatgggagaacctttagagaacgatgaggactgcgcccattggaaagaagcgaagatgctgcttgataatataaacacccccgagggcattatcccaagtatgtttgaacctgagagggaaaaagtggacgcaattgatggtgagtatcgcctgagaggggaggccaggaagaccttcgtcgacctcatgcggcgtggcgatttgcccgtatggctggcttaccgcgtggccgctgaaggaatcaattatgcagaccgaagatggtgttttgatggcgttaagaacaatcagatactcgaggaaaacgtggaggtcgagatctggactaaagaaggggagaggaagaaactgaagccacggtggcttgacgcccgcatttacagcgatcctctagctctgaaagaattcaaggagttcgccgcaggaagaaagtcgttgacattaaacctgatcaccgaaatgggtaggctcccgacatttatgactcagaaagcgcgggacgccctggataatcttgctgtgctgcacacggccgaggttggcgggcgagcatataaccatgctctctctgagttgcccgaaaccctggagacactactgctccttactctgttagccaccgtgacaggaggcattttcttgtttctgatgtccggtaagggggtcggcaaaatgaccctcggaatgtgctgcatcataactgcaagcattctgctttggtacgcccagatccaaccacactggatcgctgcgtcaattatcctggaattctttctcatagtgttgctgattcctgagcccgaaaagcagagaacgccacaggacaatcagttaacctatgtagtgatcgccattctaacagttgtcgcagctactatggccaacgagatgggcttcctggagaaaaccaagaaggacctcgggcttggaagtatcgccacacaagaacctgagtctaatatactggatatcgacttgcgccccgcatccgcttggaccctgtacgccgtggcgactacatttgtgacgccgatgctcaggcacagcattgaaaactcaagtgtcaatgttagcctgaccgctatcgccaaccaggcaactgtgcttatgggtctcggcaaagggtggccactgtccaagatggatattggagtacctttgctggccatcggctgttactctcaggtgaatcccattacattaaccgctgcactactgctccttgtcgcccattatgcgatcataggtccagggctgcaggctaaagccacccgggaggcacaaaagcgtgccgctgccggcattatgaaaaaccccacagtggacggaatcactgttatcgatttggaccctattccgtacgatcccaagttcgaaaagcagctgggccaggtgatgctcctgatactttgcgtcacgcaggtattaatgatgagaaccacatgggcactgtgtgaggctctcactttggccaccgggccaatcagcacactgtgggagggaaatcctggcaggttttggaacaccactattgcggtgtccatggccaatatcttccgcggttcatatctagcaggggctggactgctcttttctattatgaaaaacacgacaaatacccggcgaggcactggtaacatcggcgaaacccttggggagaagtggaaaagtagactgaatgccttgggaaagaacgaattccaaatatacaaaaagtcgggcatccaggaggttgacaggacactggcaaaagaggggattaagcgcggagaaactgatcaccatgctgtgagccggggctccgccaagctcagatggtttgtcgagcgtaacatggtgacccccgaaggtaaagtcgtggacctggggtgcggaaggggcggttggtcttattactgtggcgggttaaagaatgttcgggaggtgaaaggacttacaaagggcgggcctggacacgaagagccaatccccatgtcaacgtatggctggaacctggtacgcctccagagcggtgtggatgtcttcttcacccctccagagaaatgcgacactctactgtgtgatattggggaatccagtcccaatccgacaatcgaggccggacgaaccttgagagttctgtctctcgtggaaaactggcttaataacgacactcaattttgcataaaggtcctgaatccttacatgccaagcgtgattgagaagatggaaacattgcagaggaaatacggcggcgcgctggtacggaaccccctctcacgcaattccacccatgagatgtattgggtgagtaacgctacggggaatatcgttagctctgtgaacatgatctccagaatgttaattaataggttcaccatgaagcacaaaaaggcaacatacgagcctgacgtcgatctgggatcaggtactcgaaacataggcatcgaaagcgagattccaaatcttgacatcattgggaaacggatcgaaaagataaagcaggagcacgaaacctcgtggcattatgatcaggaccacccctacaaaacatgggcctatcatggatcttacgagactaagcaaaccggcagtgcttccagcatggtgaacggtgtcgtgcgtctgctaacaaaaccgtgggatgttgtacctatggtgacccagatggccatgactgacacgacaccctttgggcagcagagagtcttcaaggagaaagtggatacccgcactcaagaaccaaaggagggaaccaagaaactcatgaagatcacagcaaaatggctgtggaaggaattgggcaaaaagaaaacgcctaggatttgtacccgggaggagtttactaagaaggttagatcaaacgccgctctgggcgcgatcttcacagacgaaaataaatggaagtccgcccgcgaggcagtggaagattctaggttttgggagctcgtcgacaaagaacgaaaccttcacctggaggggaagtgcgagacctgtgtgtataatatgatgggaaaacgggaaaagaagttaggtgagttcggcaaagctaaggggagcagagccatttggtacatgtggctgggagcaaggtttttggaattcgaggccctcggctttctgaacgaagatcactggttcagtcgcgagaattccctaagcggtgtagagggggaaggacttcataaactgggctacatcctccgtgacgtgtctaagaaagagggcggggctatgtatgccgacgatactgcgggatgggacacacggattaccctggaagatttgaagaacgaggaaatggttacaaatcacatggagggtgagcataagaaactggcagaagccatatttaagctcacttaccagaacaaagtcgtgagagtgcagaggcccaccccacgcggcacggtcatggacatcatttcacgacgggatcagagagggagtggacaagttggcacctatggtcttaatacattcactaacatggaggctcagctgatcaggcagatggaaggggagggaatcttcaagtccattcaacacttaaccgtgacagaggaagtagccgtgcagaattggctggcacgcgtcggcagagagcggttgagcaggatggctatatctggcgacgattgcgtggttaaacccctcgacgatcgttttgcctcggctctgactgccctaaacgacatggggaaggtgcgaaaggatatccagcagtgggaaccttcacgcggatggaatgactggacccaagtcccattctgcagccatcactttcacgagcttattatgaaagatggtagagtgctggtagttccgtgtcggaaccaggacgaactcatcggcagggcacgcatttcccagggggcgggatggagtctgaaggagacggcctgcttgggcaaatcttacgctcagatgtggagcttaatgtatttccatagacgggacctgaggctcgccgcaaatgctatctgttccgccgtgccctcacactgggtccctacaagtcgaaccacttggtctatacatgcaaagcacgagtggatgacaaccgaagatatgcttactgtgtggaaccgtgtgtggatccaagagaacccatggatggaagacaaaacccccgtcgagagctgggaagaggttccttacctgggtaagagagaggatcagtggtgcgggtccctaattggactgacatcacgcgccacgtgggcgaagaatatccagaccgctattaaccaggtgcggagcctcatcggcaatgaagagtatactgactacatgccatctatgaaaaggtttagacgcgaagaggaagaggccggcgtattgtggtga

SEQ ID NO: 14428 - RNA, 9876 nt, synthetic construct
  misc_feature 1..9876: note = derived and/or modified CDS sequence (opt3) from DENV-2__FJ639699__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgcccagaggatcgagacctggatactgcggcatcctggcttcacaatcatggcagccattttggcttacaccatcggcacgactcactttcagcgcgcactcattttcatcctgctgacagccgtggctccatccatgaccatgagatgcatagggatttctaacagggattttgttgaaggagtgtcgggtggctcatgggtcgacatcgtgctcgagcacgggagctgtgtaactacaatggccaagaataagcccaccttagatttcgaactgattaaaacggaggcgaaggaacctgcaacccttcggaaatattgcatcgaggccaagttgacaaacactaccacagagagtcgctgtccaactcagggagaaccctccctgaatgaggaacaagacaaacgatttgtttgcaagcattctatggtggatagaggctggggtaacgggtgtggactattcggcaagggcgggatcgtcacctgcgctatgtttagctgcaaaaagaatatggagggaaaaattgtgcagcctgaaaacctcgagtacacaatagtgatcaccccacactccggtgaggaacatgccgtcggcaatgacactgggaagcacggaaaagagattaagatcacgccgcagtcaagtataacagaagcagagctgaccggctatggtactgttaccatggaatgtagccccaggacagggcttgatttcaacgagatggtgctgttgcagatggaggacaaagcttggctcgtacaccggcaatggtttctggatttacctctgccatggctccccggcgccgacacccagggatctaattggattcagaaggaaactcttgtgacattcaagaaccctcatgcgaaaaagcaggacgtcgtggttctgggctcccaagagggggccatgcacacggcattgaccggagctactgaaatccagatgtcaagcggtaatctactgtttacaggccatctcaaatgccgtctgcgcatggataagcttcagctgaaagggatgagttactctatgtgtaccggaaagttcaagatcgtgaaagagattgccgagacacaacacggcactatcgtcattagagtgcagtatgaaggtgacgggtccccatgcaagatacccttcgagatcatggatttggaaaaaaggcatgtactcggccggctgattaccgttaacccgatcatcacggagaaggacagccctgtgaacattgaagctgagcccccatttggagattcgtacataatcattggcgtcgagcctgggcagttaaaactgaattggttcaagaagggatcttccatcggtcagatgtttgaaaccacaatgcgaggcgccaaacgcatggcaattctaggggacactgcctgggatttcggatcactcggcggtgtgtttaccagtatcgggaaggctctgcaccaagtcttcggcgcgatatacggagcagcctttagcggcgtgtcctggacaatgaaaatccttattggggttatcattacttggatcggaatgaactctagaagcacctcattgagtgtgtccctggtactcgtcggcgtgataacgctgtatcttggtgctatggttcaggccgacagcgggtgtgtggtctcttggaagaataaagagctgaagtgcggatcaggcattttcatcacagataacgtgcacacctggactgaacagtacaagtttcagcccgagagtccaagcaaattggcatccgccattcaaaaggctcatgaagagggtatctgtggcataaggtctgtaacacggctcgagaatctgatgtggaaacagatcacccccgaattaaaccacattctgtcggagaatgaagtgaagctaactatcatgaccggggacattaaaggaatcatgcaggccggcaagcgcagcctcagacctcagccaacagagctgaaatattcctggaagacgtgggggaaggcaaaaatgctttcaaccgaaagtcataaccaaactttcttgatagatggaccggagacagcggagtgccccaataccaacagggcttggaattctctggaagttgaggactacggctttggtgtcttcacaactaacatttggctcaagctgaaagaaaagcaggacgtgttttgtgatagcaaattaatgtccgccgcaatcaaggacaatcgtgccgtgcacgctgatatggggtattggatcgagtcagccctgaacgacacctggaagatggagaaagcaagcttcattgaagtcaagtcttgccactggcctaaatcccatacgctttggagtaatggagttttggagagcgaaatgatcattccaaagggcttcgctggtcccgtgtctcagcacaactaccggcctggctattacacacagaccgccgggccatggcatctcggaaaactggagatggattttgacttctgtgaaggcactaccgtggtagtcacagaggattgcgggaaccgaggaccctccctaagaactaccacagcgtcaggcaagctgataacggagtggtgctgtaggagttgcaccctcccgcctctgcgctaccggggtgaagacgggtgttggtatggaatggagatcagaccacttaaggaaaaagaggaaaatttggtgaacagcctggttactgccggccacggtcaaattgataatttttcgttaggcgtgctcgggatggctctgttccttgaggagatgctgaggacacgcgtcggaaccaagcatgcaatcttgctcgtggccgtttcctttgtgactctgattacaggcaacatgtctttccgagacctagggcgggtaatggtcatggtgggagctaccatgacggatgacatcggcatgggtgtgacttacctggccctcctggcagcgtttaaagtccgtcccaccttcgccgctgggcttttgctgagaaagttaacaagcaaagaactcatgatggccaccataggaatcgcactgctttcacagagtactattcctgagacaatcctggaactaaccgatgctctcgccctgggcatgatgattttgaagatcgttaggaatatggagaagtatcagctggcagtgacaataatggccatttcctgcgtacccaacgctgtgatcttacaaaatgcgtggaaagtctcttgtactatcctcgccgcagtgagcgtttccccactgcttctgacctcaagccagcagaaggctgactggattcctttggccctcacgataaaaggcctgaaccccacagccatctttctaaccactctgagtcgcacctctaagaaacggtcctggccacttaatgaagctattatggcagtggggatggtcagcatcctcgcctcgtcactgttgaagaacgacattccgatgacaggacctctggtggcgggtggcttactcactgtttgctacgtgctgaccgggagatctgctgatcttgagctggagagggccacggacgtcaaatgggaagatcaggcagagatcagtggatccagccccatattgtctatcacaattagcgaagacggctccatgtcaatcaagaatgaggaggaagagcaaaccctcactattctgatccgaacaggtctactggtaataagtgggcttttcccagtgagcattcccatcaccgccgctgcatggtatctctgggaagttaagaaacagcgcgccggagtgctgtgggatgtcccttctccaccccctgtgggcaaggcggagttggaagacggcgcttaccggatcaaacagaaggggattttaggatattcccagatcggtgccggcgtatacaaagaggggacttttcacacaatgtggcacgtgaccagaggagcagtcctgatgcataggggcaagcgtatagagccgtcatgggccgatgttaagaaagacctcattagttacggtgggggatggaagctggaaggcgagtggaaagaaggcgaggaagtgcaagtgcttgctctggagccagggaagaacccccgcgccgtccagacgaaacctggattgttcaagactaataccggtacaatcggcgcagtgagcctagatttttccccagggacctctggatcgcccattgttgaccggaagggcaaagtagtgggtctgtatgggaacggagtcgtgacaagaagcggcgcttacgtttcagccatcgcgcagactgagaagtccatagaagataatcctgagattgaagacgatatcttcaggaaaaagcgactcaccatcatggacctgcacccgggcgccgggaaaacgaagcggtatcttcccgcaattgtgcgcgaggctatcaagagaggattaaggacactgattctcgccccaactcgggtcgtggctgcagaaatggaggaggccttgcgaggtctgcctataagataccagacccccgccatccgcgctgaacatacaggcagggagattgtagacctcatgtgtcacgcgaccttcactatgcgtctgcttagtccagtccgggtgcctaactataacctgatcatcatggatgaagcacattttaccgaccccgcctctattgctgccagagggtacataagcacaagggttgagatgggagaggcagccggcatcttcatgacggctactccaccgggttcccgcgatccttttccccaatcaaatgcgccaattatggacgaagagcgagaaatccccgagagatcttggaacagcgggcacgaatgggtgaccgatttcaaaggaaagacagtctggtttgtgcctagtattaaagccggcaatgacatcgcagcttgcttgcggaagaacggcaaaaaggttatacagctatccaggaagaccttcgatagcgagtatgtgaaaactcgcacaaatgactgggattttgtcgtgaccacggacatctctgagatgggggccaacttcaaggcagaacgtgtaattgatccaagacggtgtatgaaacccgtgatcctgactgacggagaggaaagggttattctcgccggtcctatgccggtcacacactcatccgctgcccagcgccgaggcagaatcgggcggaatccaaagaacgagaatgaccaatacatatacatgggagaacccttagagaacgatgaggactgcgcgcattggaaagaagcaaagatgctgcttgataatattaacacccctgagggcatcattcccagtatgtttgaaccagagagggaaaaagtggacgccatcgatggtgagtatcgcctgagaggggaggctaggaagaccttcgtggacctcatgcggcgtggcgatttgcctgtctggctggcctaccgcgtagctgcagaaggaataaattatgccgaccgaagatggtgttttgatggcgtgaagaacaatcagatcctcgaggaaaacgttgaggtggagatttggactaaagaaggggagaggaagaaactgaagccccggtggcttgacgctcgcatctacagcgatccactagccctgaaagaattcaaggagttcgcagcgggaagaaagtcgttgacattaaacctgattaccgaaatgggtaggctccctacatttatgactcagaaagcccgggacgctctggataatcttgccgtcctgcacacggcagaggtgggcgggcgagcttataaccatgccctctctgagttgccggaaaccctggagacactactgctccttactctgttagcaaccgttacaggaggcatcttcttgtttctgatgtccggtaagggggtgggcaaaatgaccctcggaatgtgctgcataattactgccagcatcctgctttggtacgctcagatccaaccccactggattgcggcctcaatcatactggaattctttctcattgtcttgctgatcccagagcctgaaaagcagagaacgccccaggacaatcagttaacctatgtggtaattgcaatcctaacagtggttgctgccactatggccaacgagatgggcttcctggagaaaaccaagaaggacctcgggcttggaagtatagcaacacaagaaccagagtctaatatcctggatattgacttgcgccctgcttccgcctggaccctgtacgcggtcgctactacatttgtgacgcccatgctcaggcacagcatcgaaaactcaagtgtgaatgtcagcctgaccgccattgcaaaccaggccactgttcttatgggtctcggcaaagggtggccgctgtccaagatggatatcggagtgccattgctggctattggctgttactctcaggtaaatcctatcacattaaccgcagccctactgctccttgtggcgcattatgctataattggtcccgggctgcaggccaaagcaacccgggaggcccaaaagcgtgctgccgcaggcatcatgaaaaacccaacagtcgacggaatcactgtgattgatttggaccccataccttacgatccgaagttcgaaaagcagctgggccaggttatgctcctgatcctttgcgtgacgcaggtcttaatgatgagaaccacatgggctctgtgtgaggccctcactttggcgaccgggcccattagcacactgtgggagggaaatccaggcaggttttggaacaccactatcgccgtatccatggcaaatattttccgcggttcatatctagctggggccggactgctcttttctatcatgaaaaacacgacaaatacccggcgaggcactggtaacataggcgaaacccttggggagaagtggaaaagtagactgaatgcattgggaaagaacgaattccaaatctacaaaaagtcgggcattcaggaggtggacaggacactggctaaagaggggatcaagcgcggagaaactgatcaccatgccgttagccggggctccgccaagctcagatggtttgtggagcgtaacatggtcacccctgaaggtaaagtggtcgacctggggtgcggaaggggcggttggtcttattactgtggcgggttaaagaatgtgcgggaggttaaaggacttacaaagggcgggcccggacacgaagagcctattccaatgtcaacgtatggctggaacctggtgcgcctccagagcggtgtagatgtgttcttcaccccccctgagaaatgcgacactctactgtgtgatatcggggaatccagtccaaatcccacaatagaggcgggacgaaccttgagagtcctgtctctcgttgaaaactggcttaataacgacactcaattttgcattaaggtgctgaatccgtacatgcctagcgtcatcgagaagatggaaacattgcagaggaaatacggcggcgctctggtgcggaacccactctcacgcaattccacccatgagatgtattgggtaagtaacgcaacggggaatatcgtgagctctgttaacatgatttccagaatgttaataaataggttcaccatgaagcacaaaaaggccacatacgagcccgacgtggatctgggatcaggtactcgaaacatcggcattgaaagcgagatccctaatcttgacattatcgggaaacggatagaaaagatcaagcaggagcacgaaacctcgtggcattatgatcaggaccacccatacaaaacatgggcttatcatggatcttacgagactaagcaaaccggcagtgcctccagcatggtcaacggtgtggtccgtctgctaacaaaaccctgggatgtggttccgatggtaacccagatggcaatgactgacacgacaccttttgggcagcagagagtgttcaaggagaaagtcgatacccgcactcaagaacccaaggagggaaccaagaaactcatgaagattacagccaaatggctgtggaaggaattgggcaaaaagaaaacgccaaggatctgtacccgggaggagtttactaagaaggtgagatcaaacgctgcgctgggcgccattttcacagacgaaaataaatggaagtccgcacgcgaggctgttgaagattctaggttttgggagctcgtggacaaagaacgaaaccttcacctggaggggaagtgcgagacctgtgtctataatatgatgggaaaacgggaaaagaagttaggtgagttcggcaaagccaaggggagcagagcaatctggtacatgtggctgggagccaggtttttggaattcgaggctctcggctttctgaacgaagatcactggttcagtcgcgagaattccctaagcggtgtggagggggaaggacttcataaactgggctacattctccgtgacgtatctaagaaagagggcggggccatgtatgcggacgatactgcaggatgggacacacggataaccctggaagatttgaagaacgaggaaatggtgacaaatcacatggagggtgagcataagaaactggccgaagctatctttaagctcacttaccagaacaaagttgtcagagtgcagaggcctaccccccgcggcacggtgatggacattatctcacgacgggatcagagagggagtggacaagtcggcacctatggtcttaatacattcactaacatggaggcccagctgatcaggcagatggaaggggagggaattttcaagtccatacaatacttaaccgttacagaggaagtggcagtacagaattggctggctcgcgtgggcagagagcggttgagcaggatggccatctctggcgacgattgcgtcgtgaaaccactcgacgatcgttttgcttcggccctgactgcactaaacgacatggggaaggttcgaaaggatattcagcagtgggaaccctcacgcggatggaatgactggacccaagtgcctttctgcagccaccattttcacgagcttatcatgaaagatggtagagtcctggtggtaccatgtcggaaccaggacgaactcattggcagggcgcgcatctcccagggggccggatggagtctgaaggagacggcttgcttgggcaaatcttatgcccagatgtggagcttaatgtacttccacagacgggacctgaggctcgcagctaatgccatatgttccgcagttccgtcacattgggtgcccacaagtcgaaccacttggtctatccacgccaagcatgagtggatgacaaccgaagatatgcttactgtctggaaccgtgtgtggattcaagagaacccttggatggaagacaaaaccccagtggagagctgggaagaggtcccctatctgggtaagagagaggatcagtggtgcgggtccctaatcggactgacatcacgcgcgacgtgggctaagaatattcagaccgccatcaaccaggttcggagcctcataggcaatgaagagtacactgactacatgccttctatgaaaaggtttagacgcgaagaggaagaggcaggcgtgttgtggtga

SEQ ID NO: 14429 - RNA, 9876 nt, synthetic construct
  misc_feature 1..9876: note = derived and/or modified CDS sequence (opt3) from DENV-2__FJ639700__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgcccagaggatcgagacctggatactgcggcatcctggcttcacaatcatggcagccattttggcttacaccatcggcacgactcactttcagcgcgcactcattttcatcctgctgacagccgtggctccatccatgaccatgagatgcatagggatttctaacagggattttgttgaaggagtgtcgggtggctcatgggtcgacatcgtgctcgagcacgggagctgtgtaactacaatggccaagaataagcccaccttagatttcgaactgattaaaacggaggcgaaggaacctgcaacccttcggaaatattgcatcgaggccaagttgacaaacactaccacagagagtcgctgtccaactcagggagaaccctccctgaatgaggaacaagacaaacgatttgtttgcaagcattctatggtggatagaggctggggtaacgggtgtggactattcggcaagggcgggatcgtcacctgcgctatgtttagctgcaaaaagaatatggagggaaaaattgtgcagcctgaaaacctcgagtacacaatagtgatcaccccacactccggtgaggaacatgccgtcggcaatgacactgggaagcacggaaaagagattaagatcacgccgcagtcaagtataacagaagcagagctgaccggctatggtactgttaccatggaatgtagccccaggacagggcttgatttcaacgagatggtgctgttgcagatggaggacaaagcttggctcgtacaccggcaatggtttctggatttacctctgccatggctccccggcgccgacacccagggatctaattggattcagaaggaaactcttgtgacattcaagaaccctcatgcgaaaaagcaggacgtcgtggttctgggctcccaagagggggccatgcacacggcattgaccggagctactgaaatccagatgtcaagcggtaatctactgtttacaggccatctcaaatgccgtctgcgcatggataagcttcagctgaaagggatgagttactctatgtgtaccggaaagttcaagatcgtgaaagagattgccgagacacaacacggcactatcgtcattagagtgcagtatgaaggtgacgggtccccatgcaagatacccttcgagatcatggatttggaaaaaaggcatgtactcggccggctgattaccgttaacccgatcatcacggagaaggacagccctgtgaacattgaagctgagcccccatttggagattcgtacataatcattggcgtcgagcctgggcagttaaaactgaattggttcaagaagggatcttccatcggtcagatgtttgaaaccacaatgcgaggcgccaaacgcatggcaattctaggggacactgcctgggatttcggatcactcggcggtgtgtttaccagtatcgggaaggctctgcaccaagtcttcggcgcgatatacggagcagcctttagcggcgtgtcctggacaatgaaaatccttattggggttatcattacttggatcggaatgaactctagaagcacctcattgagtgtgtccctggtactcgtcggcgtgataacgctgtatcttggtgctatggttcaggccgacagcgggtgtgtggtctcttggaagaataaagagctgaagtgcggatcaggcattttcatcacagataacgtgcacacctggactgaacagtacaagtttcagcccgagagtccaagcaaattggcatccgccattcaaaaggctcatgaagagggtatctgtggcataaggtctgtaacacggctcgagaatctgatgtggaaacagatcacccccgaattaaaccacattctgtcggagaatgaagccaagctaactatcatgaccggggacattaaaggaatcatgcaggcaggcaagcgcagcctcagacctcagccaacagagctgaaatattcctggaagacgtgggggaaggcgaaaatgctttcaaccgaaagtcataaccaaactttcttgatagatggaccggagacagctgagtgccccaataccaacagggcctggaattctctggaagtggaggactacggctttggtgttttcacaactaacatttggctcaagctgaaagaaaagcaggacgtcttttgtgatagcaaattaatgtccgcagccatcaaggacaatcgtgctgtgcacgccgatatggggtattggatcgagtcagcactgaacgacacctggaagatggagaaagctagcttcattgaagtgaagtcttgccactggcctaaatcccatacgctttggagtaatggagtcttggagagcgaaatgatcattccaaagggcttcgccggtcccgtttctcagcacaactaccggcctggctatcatacacagaccgcggggccatggcacctcggaaaactggagatggattttgacttctgtgaaggcactaccgtggtggtaacagaggattgcgggaaccgaggaccctccctaagaactaccacagcctcaggcaagctgataacggagtggtgctgtaggagttgcaccctcccgcctctgcgctaccggggtgaagacgggtgttggtacggaatggagatcagaccacttaaggaaaaagaggaaaatttggtcaacagcctggtgactgctggccatggtcaaattgataatttttcgttaggcgttctcgggatggcactgttccttgaggagatgctgaggacacgcgtgggaaccaagcacgccatcttgctcgtcgctgtgtcctttgttactctgattacaggcaacatgtctttccgagacctagggcgggtgatggtaatggtcggagccaccatgacggatgacatcggcatgggtgtgacttatctggcactcctggcggcctttaaagtgcgtcccaccttcgctgccgggcttttgctgagaaagttaacaagcaaagaactcatgatggcaaccataggaatcgctctgctttcacagagtactattcctgagacaatcctggaactaaccgatgccctcgcactgggcatgatgattttgaagatcgtcaggaatatggagaagtaccagctggccgttacaataatggctatttcctgcgtgcccaacgcggtaatcttacaaaatgcctggaaagtgtcttgtactatcctcgcagctgtcagcgtgtccccactgcttctgacctcaagccagcagaaggccgactggattcctttggccctcacgataaaaggcctgaaccccacagctatctttctaaccactctgagtcgcacctctaagaaacggtcctggccacttaatgaagcaattatggccgttgggatggtgagcatcctcgcgtcgtcactgttgaagaacgacattccgatgacaggacctctggtcgctggtggcttactcactgtgtgctatgttctgaccgggagatctgccgatcttgagctggagagggcaacggacgtgaaatgggaagatcaggccgagatcagtggatccagccccatattgtctatcacaattagcgaagacggctccatgtcaatcaagaatgaggaggaagagcaaaccctcactattctgatccgaacaggtctactggtcataagtgggcttttcccagtaagcattcccatcaccgctgcagcctggtacctctgggaagtgaagaaacagcgcgcgggagttctgtgggatgtgccttctccaccccctgtcggcaaggctgagttggaagacggcgcctatcggatcaaacagaaggggattttaggatactcccagatcggtgcaggcgtgtataaagaggggacttttcacacaatgtggcatgtaaccagaggagccgtgctgatgcacaggggcaagcgtatagagccgtcatgggctgatgtcaagaaagacctcattagttacggtgggggatggaagctggaaggcgagtggaaagaaggcgaggaagttcaagtgcttgccctggagccagggaagaacccccgcgcagtgcagacgaaacctggattgttcaagactaataccggtacaatcggcgctgtcagcctagatttttccccagggacctctggatcgcccattgtggaccggaagggcaaagttgtaggtctgtacgggaacggagtggtcacaagaagcggcgcctatgtgtcagcgatcgcccagactgagaagtccatagaagataatcctgagattgaagacgatatcttcaggaaaaagcgactcaccatcatggacctgcatccgggcgcagggaaaacgaagcggtaccttcccgctattgttcgcgaggccatcaagagaggattaaggacactgattctcgctccaactcgggtggtcgcagccgaaatggaggaggccttgcgaggtctgcctataagatatcagacccccgctatccgcgcggaacacacaggcagggagattgtggacctcatgtgtcatgcaaccttcactatgcgtctgcttagtccagtacgggtccctaactacaacctgatcatcatggatgaagcccactttaccgaccccgcttctattgccgcaagagggtatataagcacaagggtggagatgggagaggccgctggcatcttcatgacggcgactccaccgggttcccgcgatccttttccccaatcaaatgccccaattatggacgaagagcgagaaatccccgagagatcttggaacagcgggcacgaatgggttaccgatttcaaaggaaagacagtgtggtttgtccctagtattaaagcaggcaatgacatcgctgcctgcttgcggaagaacggcaaaaaggtgatacagctatccaggaagaccttcgatagcgagtacgttaaaactcgcacaaatgactgggattttgtggtcaccacggacatctctgagatgggggcaaacttcaaggccgaacgtgtgattgatccaagacggtgtatgaaacccgtaatcctgactgacggagaggaaagggtgattctcgctggtcctatgccggttacacattcatccgccgcgcagcgccgaggcagaatcgggcggaatccaaagaacgagaatgaccaatatatatacatgggagaacccttagagaacgatgaggactgcgcacactggaaagaagccaagatgctgcttgataatattaacacccctgagggcatcattcccagtatgtttgaaccagagagggaaaaagtcgacgctatcgatggtgagtaccgcctgagaggggaggccaggaagaccttcgtggacctcatgcggcgtggcgatttgcctgtgtggctggcttatcgcgtcgcagccgaaggaataaattacgctgaccgaagatggtgttttgatggcgtaaagaacaatcagatcctcgaggaaaacgtggaggttgagatttggactaaagaaggggagaggaagaaactgaagccccggtggcttgacgcccgcatctatagcgatccactagcactgaaagaattcaaggagttcgcggccggaagaaagtcgttgacattaaacctgattaccgaaatgggtaggctccctacatttatgactcagaaagctcgggacgccctggataatcttgcagtgctgcatacggctgaggtcggcgggcgagcctacaaccacgcactctctgagttgccggaaaccctggagacactactgctccttactctgttagccaccgtgacaggaggcatcttcttgtttctgatgtccggtaagggggttggcaaaatgaccctcggaatgtgctgcataattactgctagcatcctgctttggtatgcgcagatccaaccccactggattgccgcatcaatcatactggaattctttctcattgtgttgctgatcccagagcctgaaaagcagagaacgccccaggacaatcagttaacctacgtcgtgattgctatcctaacagtagtggccgccactatggcaaacgagatgggcttcctggagaaaaccaagaaggacctcgggcttggaagtatagctacacaagaaccagagtctaatatcctggatattgacttgcgccctgcctccgcgtggaccctgtatgctgttgccactacatttgtcacgcccatgctcaggcatagcatcgaaaactcaagtgtgaatgtgagcctgaccgcaattgccaaccaggctactgtccttatgggtctcggcaaagggtggccgctgtccaagatggatatcggagttccattgctggcaattggctgttactctcaggtgaatcctatcacattaaccgccgcgctactgctccttgtagctcactacgccataattggtcccgggctgcaggcaaaagccacccgggaggctcaaaagcgtgccgcagctggcatcatgaaaaacccaacagtggacggaatcactgtcattgatttggaccccataccttatgatccgaagttcgaaaagcagctgggccaggtgatgctcctgatcctttgcgttacgcaggtgttaatgatgagaaccacatgggccctgtgtgaggcgctcactttggccaccgggcccattagcacactgtgggagggaaatccaggcaggttttggaacaccactatcgcagtctccatggctaatattttccgcggttcatacctagccggggcaggactgctcttttctatcatgaaaaacacgacaaatacccggcgaggcactggtaacataggcgaaacccttggggagaagtggaaaagtagactgaatgctttgggaaagaacgaattccaaatctataaaaagtcgggcattcaggaggtagacaggacactggccaaagaggggatcaagcgcggagaaactgatcatcacgccgtgagccggggctccgcgaagctcagatggtttgttgagcgtaacatggtgacccctgaaggtaaagtcgtggacctggggtgcggaaggggcggttggtcttactattgtggcgggttaaagaatgtccgggaggtgaaaggacttacaaagggcgggcccggacatgaagagcctattccaatgtcaacgtacggctggaacctggttcgcctccagagcggtgtggatgtattcttcaccccccctgagaaatgcgacactctactgtgtgatatcggggaatccagtccaaatcccacaatagaggctggacgaaccttgagagtgctgtctctcgtcgaaaactggcttaataacgacactcaattttgcattaaggttctgaatccgtatatgcctagcgtgatcgagaagatggaaacattgcagaggaaatacggcggcgcactggtccggaacccactctcacgcaattccacccacgagatgtactgggtgagtaacgccacggggaatatcgtaagctctgtgaacatgatttccagaatgttaataaataggttcaccatgaagcacaaaaaggctacatatgagcccgacgttgatctgggatcaggtactcgaaacatcggcattgaaagcgagatccctaatcttgacattatcgggaaacggatagaaaagatcaagcaggagcatgaaacctcgtggcactacgatcaggaccatccatataaaacatgggcctaccacggatcttatgagactaagcaaaccggcagtgcatccagcatggtgaacggtgtcgtgcgtctgctaacaaaaccctgggatgtcgtgccgatggttacccagatggccatgactgacacgacaccttttgggcagcagagagtattcaaggagaaagtggatacccgcactcaagaacccaaggagggaaccaagaaactcatgaagattacagctaaatggctgtggaaggaattgggcaaaaagaaaacgccaaggatctgtacccgggaggagtttactaagaaggtcagatcaaacgcggccctgggcgcaattttcacagacgaaaataaatggaagtccgctcgcgaggccgtggaagattctaggttttgggagctcgttgacaaagaacgaaaccttcacctggaggggaagtgcgagacctgtgtgtacaatatgatgggaaaacgggaaaagaagttaggtgagttcggcaaagcaaaggggagcagagccatctggtatatgtggctgggagctaggtttttggaattcgaggccctcggctttctgaacgaagatcattggttcagtcgcgagaattccctaagcggtgtcgagggggaaggacttcacaaactgggctacattctccgtgacgtgtctaagaaagagggcggggcgatgtacgcagacgatactgccggatgggacacacggataaccctggaagatttgaagaacgaggaaatggtaacaaatcatatggagggtgagcacaagaaactggctgaagccatctttaagctcacttatcagaacaaagtggttagagtccagaggcctaccccccgcggcacggtgatggacattatctcacgaaaggatcagcgggggagtggacaagtgggcacctacggtcttaatacattcactaacatggaggcacagctgatcagacagatggaaggggagggaattttcaaatccatacaatatttaaccgtcacagaggaagttgctgtgcagaattggctggccagggtaggccgcgagagattgagccggatggctatctctggcgacgattgcgtggtcaagccactcgacgataggtttgcctcggcactgactgcgctaaacgacatggggaaggtgcgtaaagatattcagcagtgggaaccctcacgaggatggaatgactggacccaagttcctttctgcagccatcactttcacgagcttatcatgaaggatggtcgcgtgctggtcgtgccatgtagaaaccaggacgaactcattggccgggccaggatctcccagggggctggatggagtctgaaagagacggcctgcttgggcaagtcttacgcacagatgtggagcttaatgtatttccatcgcagagacctgcggctcgctgccaatgcaatatgttccgccgtaccgtcacactgggttcccacaagtaggaccacttggtctatccatgcgaaacacgagtggatgacaaccgaagatatgcttactgtgtggaaccgagtctggattcaagagaacccttggatggaagacaagaccccagtggagagctgggaagaggtgccctacctgggtaagcgtgaggatcagtggtgcgggtccctaatcggactgacatcaagagctacgtgggccaaaaatattcagaccgcaatcaaccaggtccgcagcctcataggcaatgaagagtatactgactacatgccttctatgaagcggtttaggagagaagaggaagaggccggcgttttgtggtga

SEQ ID NO: 14430 - RNA, 9876 nt, synthetic construct
  misc_feature 1..9876: note = derived and/or modified CDS sequence (opt3) from DENV-2__GQ868620__SS-prME
  source 1..9876: mol_type = other RNA
agcgccggaatgataattatgctgatacccaccgtgatggctttccacctcaccactagaaacggggagcctcatatgatcgtcggtattcaagaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggctctcattttcatcctgctgactgcagtggccccatctatgacaatgcgctgcatagggatttcgaacagagattttgttgaaggagtgtcaggtggcagctgggtcgacatcgtgctcgagcacgggagttgtgtaaccactatggctaagaataagcccacattagatttcgaactgattaaaaccgaggccaagcagcctgcgacgcttaggaaatattgcatcgaagcaaagttgaccaacacaactaccgagtcccggtgtccaacacaaggagagccctctctgaaagaggaacaggacaagcgctttgtttgcaagcatagcatggtggatcgaggctggggtaatgggtgtggactattcggcaaaggcgggatcgtcacttgcgccatgtttacctgcaagaaaaacatggaaggaaagattgtgcagcctgagaatctcgaatacacaatagtggtcaccccacactccggtgaggagcatgctgttggcaacgacactgggaaacacggaaaggaaatcaaagtgacgccgcagtcaagtattacagaggccgaactgaccggctatggtactgtaaccatggagtgtagccccagaacagggcttgatttcaatgaaatggtgctgttgcaaatggagaacaaggcatggctcgtccacaggcagtggtttctggacttacctctgccatggctccccggcgctgataagcagggatctaattggatccagaaagagacccttgtgactttcaagaaccctcatgccaaaaagcaagacgttgtggtcctgggctcccaggaaggggcgatgcacacagccttgacgggagcaaccgagatacagatgtcaagcggtaatctactgtttactggccatctcaaatgccggctgcgtatggacaaacttcaactgaaggggatgagttactctatgtgtacaggaaaattcaaggtggtaaaagaaattgctgagacccagcacggcacaatcgttatccgcgtgcagtatgagggtgatgggtccccatgcaagattcccttcgaaatcatggacttggagaaaagatacgtcctcggcaggctgattactgtgaacccgatagtcaccgaaaaggatagccctgtgaacatcgaggccgaacccccatttggagactcgtacattatcatcggcgttgagcctgggcagttaaagctgaattggttcaaaaagggatcttccattggtcaaatgtttgagacgaccatgcggggcgctaaacgaatggccatactaggggatacagcatgggacttcggatcactcggcggtgtgtttacaagtatcgggaaggccctgcatcaggtattcggcgctatttatggagcggcatttagcggcgtctcctggaccatgaaaatccttattggggtgatcataacatggatcggaatgaactctcgcagcacttcattgagtgtttccctggtgctcgtcggcattgtgaccctgtaccttggtgtaatggtgcaggccgatagcgggtgtgttgtctcttggaagaataaggaactgaaatgcggatcaggcatcttcattacggacaacgtgcacacatggaccgagcagtataagtttcaacccgaaagtccaagcaaattggcttccgccatccagaaggcacaggaggaaggtatatgtggcattagatctgtgactaggctcgagaatctgatgtggaaacagatcacacccgagttaaaccacattctggccgaaaatgaggtcaagctaaccatcatgactggggatataaaaggaatcatgcaagctggcaagcggtcgctccgccctcagccaaccgaactgaagtacagctggaaaacatgggggaaggccaaaatgctttccacggagtcacataaccagaccttcttgattgacggaccggaaactgcagagtgccccaatacaaacagagcgtggaatagtctggaggttgaagattatggctttggtgtgttcaccacaaacatctggctcaagctgaaagagaagcaggacgctttttgtgactctaagttaatgagcgccgcaattaaagataatagggccgtgcacgctgacatggggtactggatcgaatccgccctgaacgatacttggaagatagagaaagcatcattcattgaggtaaagaattgccattggcctaaaagccacaccctttggtctaacggagtcttggaatccgagatgatcatcccaaagaacctcgctggccccgtgagtcaacacaattatcgtcctggttaccatacgcagattgccggcccatggcacctggggaagctagaaatggacttcgatttttgtgacggaacaaccgttatcgtgactgaggattgcggcaaccgggggcccagcctgcgaaccacaactgcgtctggaaaactcattaccgaatggtgctgtagatcctgcacactgccgcctcttaggtaccgcggcgaggacggttgttggtatgggatggagatacggccattgaaggaaaaagaggaaaatctggtcaactcattagtgacggccggacatggccaggttgataatttcagtctcggtgtgctgggcatggctctttttctggaggaaatgttgagaaccagggtagggactaagcacgcaatcctcctggtcgccgtgagcttcgtgacactaattaccggaaacatgtcgtttaaagacctgggccgcgtcgttgtgatggtaggggctactatgacagatgacatcggaatgggcgtgacctacctcgccctgcttgcagcgttcaaggtccgacccacgtttgccgctggtttgctgttacggaagctcacttccaaagagctgatgatgaccacaattgggatcgtgcttctgtctcaaagcaccatacctgagactatcctagaactcacagatgccctggcattgggaatgatggttctgaagattgtgcgtaatatggagaaatatcagttagctgtcaccatcatggccattctctgcgtgcccaacgcagttatcctgcagaatgcctggaaggtgtcatgtacaatacttgctgtcgtaagtgtgtccccactgttgctcacttctagccagcagaagacagactggattcctctggcgctaacgatcaagggcctgaaccccacagccatcttccttaccactctctccagaaccaataaaaagaggtcatggccactgaacgaagcaattatggctgttggcatggtgagcatattggccagttctctgttaaagaatgacatcccgatgacagggcctctcgtcgccggaggtctgcttactgtgtgctacgtactgaccggccgctccgctgatttggagctcgaacgggcaacggacgtgaaatgggaggatcaggccgagattagcgggtcgtcacccatcctgtctattacaatcagtgaagacggatccatgagcataaagaacgaggaagaggagcagaccctaactatcctgattagaacaggccttctcgtcatctctggtctgtttccagttagcattcccatcaccgcggctgcctggtatttgtgggaagtgaaaaagcagagggcaggggtgttatgggatgtcccttccccaccccctatgggaaaagccgagctggaagacggcgcttaccgaataaagcaaaagggcattctcgggtattcacagatcggagcaggagtgtacaaagagggcactttccatacaatgtggcacgttacccgcggggccgtactgatgcacaagggaaaacggatcgaaccgagttgggcggatgtgaagaaagaccttattagctacggcggtgggtggaagctggagggagagtggaaggaaggcgaggaagtccaggtgttggctctagagccaggcaaaaatcccagagttgtgcagacgaagcctgggctgtttaaaactaacaccggaacaatcggtgccgtctctctcgatttctccccaggcacctcagggagtcccataattgacaagaaaggaaaggtggtaggcctgtatggtaacggggtcgtgacaaggagcggagcatacgtttccgccatcgctcaaactgaaaagtctattgaggataatcctgagatcgaagacgatatatttcgtaaacgccggcttaccattatggacttacatccgggcgccggcaagacgaaaagatatctgcccgcaatcgtgagggaggctatcaagcgagggctccggacattgattctggccccaactcgcgtcgtggcggccgaaatggaggaagcactcagaggactgcctatcaggtaccagacccccgctattcgggccgagcacacaggtcgagagatagttgaccttatgtgtcatgctaccttcactatgagactgttgtcgccagtgcgcgtccctaactataatctaatcattatggatgaagcacacttcaccgaccccgccagcatcgccgctaggggctacatctcaacacgtgtggagatgggggaagcggcaggaatttttatgacggccactccaccgggctcccgggatcctttcccccagagtaacgctccaataatcgacgaggagagagaaattcccgagaggtcttggaatagcggtcatgaatgggtaaccgattttaaagggaagacagtgtggttcgttccttccatcaaggccggaaacgacattgcagcctgcctgcgcaaaaatggcaagaaagtcatccaactctcacgaaagacctttgattctgagtatgtgaaaactagaacaaacgactgggatttcgtggtcaccacggacataagcgaaatgggcgctaattttaaggcggagcgggtaatcgatccaaggcgctgtatgaaacccgtgattttaactgacggggaggaacgtgttatcctggccggacctatgccggtgacacacagttccgcagctcagagacggggtaggattggccgcaacccaaagaatgagaacgaccagtacatctacatgggggaaccccttgagaatgatgaagactgcgcccactggaaggaggcaaaaatgctgctcgataacataaatacccctgagggaattatccccagcatgttcgaaccagagcgagaaaaggtcgacgccattgatggcgagtatagattgcggggtgaagctaggaaaacctttgtggacctgatgcgcagaggggatctccctgtttggctggcctacaaggtggcggcagagggcatcaactatgccgacaggcggtggtgtttcgatggaatcaaaaacaatcagatccttgaggaaaacgtcgaggtggaaatttggactaaggagggcgagcgtaagaaactaaagccccgctggctggacgctcgaatctactctgatccattggccttaaaagaatttaaggagttcgctgcagggagaaaatcactgacactcaatctgattaccgaaatgggaaggcttcctacattcatgactcaaaagacgcgggacgccctggataacctcgctgtattgcataccgccgaggcgggtggacgcgcatataatcacgccctgtccgaactaccggagacactggagactctccttctgttaaccttgctggctacagtgaccgggggaatctttctcttcctgatgagtggcagaggtatagggaagatgactcttggcatgtgctgcattatcacggccagcatcctgctctggtacgcacagattcagccccattggatcgctgcctcgataattttggaatttttcctgatcgttttactaattccagagcctgaaaaacagaggacaccccaagacaaccagctgacatatgtcgtgatcgcaatactcactgtggtcgccgctaccatggcgaatgagatgggatttcttgaaaagactaaaaaggacctgggcttggggtctatcgccacccagcagccagagtccaacattctggatatcgacctccggcctgcaagcgcttggactctgtacgccgttgccacaacgttcgtgacccccatgcttcgacactcaattgagaatagttctgtaaacgtgtccctcactgcaatcgctaatcaagccacagtcctgatgggattgggtaaaggctggccgctgagcaagatggatattggggtgccattactagcgatcggatgttactcacaggttaaccctataaccctgaccgctgccctccttctgttgattgcacactatgccatcatcggccccggtctgcaggctaaggcaacaagagaagcccagaaacgcgcggctgccgggattatgaagaatccaactgtggacggcataacggtcatcgatctcgaccccattccttacgatccgaaatttgagaagcaactgggacaggtaatgcttttaatcctgtgcgtgacccaggttctcatgatgaggacaacttgggcattgtgtgaagccctgaccctagctacaggccccattagtaccctgtgggaggggaacccaggacggttctggaatactacgatcgccgtgagcatggcaaacatatttcgtggctcctatctcgctggtgccgggcttctgttctctatcatgaaaaatgcgaacaacacaagaaggggaaccggcaatattggtgaaactttgggcgagaagtggaaaagccgcctgaacgccctcgggaagtccgagtttcaaatctacaagaaatcaggcattcaggaagtcgaccggaccctggcaaaggagggcatcaaacgaggggaaacagatcatcacgctgtgtctagaggaagtgccaagttaaggtggttcgtcgagcgcaatatggtgactcctgagggcaaagttgtggaccttggttgcgggcggggaggctggtcgtattactgtggtggcctgaagaacgtaagagaagtgaaggggctcaccaaaggaggccccgggcatgaggaacctataccaatgagcacatatggatggaatctagtccgtctgcagtccggcgttgatgtgtttttcattccccctgagaagtgcgacacgttgctgtgtgatatcggtgaatcttcaccaaaccccaccgtcgaggcagggaggactctccgggtgcttaatctggtagagaactggttgaataacgacacacagttctgcatcaaagtgctgaatccgtacatgcctagcgttattgaaaagatggaggctctccaacgcaaatacggaggcgccttagtgcgaaacccactgtccagaaatagtacccacgaaatgtattgggtctctaacgccagcggcaatatagtgtcatccgtcaacatgatcagtaggatgcttattaaccggtttactatgcgccataagaaggcgacatacgagcccgacgtggatctggggagcggaaccagaaatatcggtattgaatctgagatccctaacctagacataatcggcaaaaggattgagaagatcaaacaggaacacgagacgtcctggtattacgatcaggaccacccatataagacctgggcttaccatgggtcatatgaaacaaaacagactggaagcgcatcgtctatggttaatggcgtagtgcgactcctgaccaagccctgggatgtcttgccgacagtgactcaaatggccatgaccgacacaacccctttcggtcagcagcgggtttttaaggagaaagtggatactcgtacgcaggaacccaaggaggggaccaaaaagctgatgaaaattaccgctgagtggctctggaaggaacttggcaaaaagaagactccaagaatgtgtacccgcgaggagttcatcaggaaagtccggagtaacgccgcactgggcgccatttttacagacgagaataagtggaaatccgctagagaggcggtggaagatagccgcttctgggagttagtagacaaggaaaggaacctgcacttggagggcaaatgcgaaacgtgtgtgtacaatatgatggggaagcgagagaagaaactcggagagtttggtaaggccaaaggctcacgggcaatatggtacatgtggctgggggctagattcctagaatttgaggcccttggattcctgaacgaagatcattggttttccagggaaaattctctcagcggcgttgaaggtgaggggctgcacaagttgggatatatcctgcgcgacgtcagtaaaaaggagggcggcgcaatgtacgccgacgataccgctgggtgggacactcgtattacactcgaagatcttaagaacgaggaaatggtgaccaatcacatggagggagaacataaaaagctggccgaggcgatcttcaaattaacttatcaaaacaaggtggtccgggttcagagacctacacccaggggtaccgtgatggacatcatttcccgccgagatcagcggggcagcgggcaagtaggaacatacggcctgaatacttttaccaacatggaggcacagttgataagacagatggaaggtgagggggtgttcgaaaatatccagcacctcacggtcaccgaggaggtggccgttcaaaactggctggctagggtgggacgcgaaagactatctcggatggccatttcaggcgacgattgcgtcgtgaaaccacttgacgataggttcgcaaacgctctgacagccctcaatgacatgggcaagatccgtaaggatattcagcagtgggagcccagtaaagggtggaacgactggactcaggtacctttttgctcccatcacttccatgaactgatcatgaaggatggacgagttttggtggtcccatgtcgcaatcaagacgagttaataggtagagctcggatcagccagggcgccgggtggtctctgagggaaaccgcatgcctcggaaaatcgtatgcgcagatgtggtcacttatgtactttcaccgcagagacctgcggctagccgctaacgccatttgtagcgcagtgccgtcccactgggtgcccacaagtaggactacctggtctatccatgctaagcacgagtggatgacgacagaggatatgctgaccgtctggaatcgagtttggattcgtgaaaacccttggatggaggacaaaactccagtggaaagctgggaggaaatcccctatctcggcaagagagaggatcagtggtgcggttccttgatagggctgacatcacgcgccacctgggcaaagaatattcaagccgcgatcaaccaggtacggagtcttattggaaatgaggaatacactgactacatgccttctatgaaaaggttcagacgcgaggaagaggaagctggcgtgctgtggtga

SEQ ID NO: 14431 - RNA, 9876 nt, synthetic construct
  misc_feature 1..9876: note = derived and/or modified CDS sequence (opt3) from DENV-2__FJ639702__SS-prME
  source 1..9876: mol_type = other RNA
accgccggagtgatcattatgctgatacccacagctatggcattccacctcactacgaggaatggggagcctcatatgatcgtcgggaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaaggaacctgcgacccttcggaaatattgcatcgaggcaaagttgacaaacactaccacagagagtcgctgtccaactcagggagaaccctccctgaatgaggaacaagacaaacgatttgtgtgcaagcattctatggtcgatagaggctggggtaacgggtgtggactattcggcaagggcgggatcgtgacctgcgccatgtttacatgcaaaaagaatatggagggaaaaattgtgcagcctgaaaacctcgagtacaccatagtcatcactccacacagcggtgaggaacatgctgttggcaatgacacggggaagcacggaaaagagattaagatcacaccgcagtcctcaagtaccgaagccgagctgactggctatggtaccgtgacaatggaatgtagccccaggaccgggcttgatttcaacgagatggtactgttgcagatggaggacaaagcatggctcgtgcaccggcaatggtttctggatttacctctgccatggctccccggcgctgacactcagggatctaattggatacagaaggaaacacttgtcacgttcaagaaccctcatgccaaaaagcaggacgtggttgtgctgggctcccaagagggggcgatgcacaccgccttgactggagcaacagaaattcagatgtcaagcggtaatctactgtttaccggccatctcaaatgccgtctgcgcatggataaacttcagctgaaagggatgagttactctatgtgtacaggaaagttcaagatcgtcaaagagatcgctgagactcaacacggcaccattgtgatcagagtacagtatgaaggtgacgggtccccatgcaagattcccttcgagataatggatttggagaagaggcatgttctcggccggctgatcacggtgaacccgattgtcaccgagaaggacagccctgtgaacatcgaagccgagcccccatttggagattcgtacatcattataggcgtcgagcctgggcagttaaaactgaattggttcaagaagggatcttccatcggtcagatgtttgaaacaactatgcgaggcgctaaacgcatggccattctaggggacaccgcatgggatttcggatcactcggcggtgtgtttacaagtatggggaaggccctgcaccaagttttcggcgctatctacggagcggcatttagcggcgtgtcctggactatgaaaattcttatcggggtaataatcacctggattggaatgaactctagaagcacgtcattgagtgtctccctggtgctcgttggcgtgatcacactgtatcttggtgccatggtccaggctgacagcgggtgtgtggtatcttggaagaataaagagctgaagtgcggatcaggcattttcatcaccgataacgtgcacacttggacagaacagtacaagtttcagcccgagagtccaagcaaattggcctccgcaatacaaaaggcccatgaagagggtatttgtggcatcaggtctgttacccggctcgagaatctgatgtggaaacagattactcccgaattaaaccacatcctgtcggagaatgaagtcaagctaaccataatgacaggggacatcaaaggaattatgcaggctggcaagcgcagcctcagacctcagccaacggagctgaaatattcctggaagacctgggggaaggccaaaatgctttcaactgaaagtcataaccaaacattcttgatcgatggaccggagaccgcagagtgccccaatacaaacagggcgtggaactctctggaagtggaggactacggctttggtgtgttcactaccaacatttggctcaagctgcgtgaaaaacaggacgtcttttgtgatagcaagttaatgtccgctgccatcaaagacaatcgggcagttcacgccgatatggggtattggatagagtcagctctgaacgacacgtggaagatggagaaggccagcttcattgaagtgaaatcttgccactggcctaagtcccatacactttggagtaatggagtgttggagagcgaaatgatcatcccaaaatctttcgcaggccccgtatcccagcacaactaccgacctggttattacacccagactgctggcccatggcatctcgggaagctggagatggattttgacttctgtgaaggaaccacagtcgtggttactgaggattgcggcaacagagggccctcactaaggaccacaacggccagtggaaaactgattaccgagtggtgctgtcgcagctgcactctcccgcctctgcggtacagaggcgaagacggttgttggtatgggatggagatcaggccacttaaggaaaaggaggaaaatttggtgaactcgctggtcacagcgggacacggccaaattgataatttttccttaggtgtgctcggcatggccctgttccttgaggagatgctgcgcacccgagttgggactaaacatgctatattgctcgtggcagtatctctggtcacactaatcaccggaaacatgagctttcgggacctgggccgtgtgatggtgatggtcggggccacgatgactgatgacattggaatgggcgttacctacctcgctctgcttgccgcattcaaggtgagacccacatttgcggccggtttgctgttaaggaaactcacctcaaaggaactgatgatggctactatcgggattgcccttctgagtcagtccacaatccctgagaccatactagaactcacagatgcactggctttgggaatgatggtactgaaaatcgtgcgcaatatggagaagtatcagttagccgtcactattatggcaatctcttgcgtgcccaacgccgttattctccaaaatgcttggaaggtgagctgtaccatcctggcggccgtctccgtgtcaccacttctgttgacgagcagtcagcagaaagcagactggatacctctcgctctgacaattaagggcctaaaccccaccgccatcttcctgactaccctttctcggacatccaaaaagagaagctggccactcaatgaagccatcatggctgttggcatggtgtcgattctggcatcatctttgctgaaaaacgacataccgatgactgggcctttagtcgccggaggtctcctgaccgtatgctacgtgcttacgggcaggagtgcggatctggagttggagcgagctacagacgttaagtgggaagatcaggccgagatctccgggagctctcccattctcagcatcaccatttccgaagacggatcaatgagtatcaaaaatgaggaggaagaacaaactctgacaatactaatccgcaccggcctgcttgtgattagcggtctctttccagtctctatccccattactgcagccgcttggtatctgtgggaagtgaagaagcagcgggcaggggtattgtgggatgtgccttccccaccccctgtcggaaaagccgagttagaagacggcgcgtacagaatcaagcagaaaggcatactggggtattcacagattggagctggtgtttacaaggagggcacattccacaccatgtggcacgtgacgagaggggccgtgctcatgcatcgtggaaaacgcatcgagccgagttgggcagatgtcaagaaggacctgatcagctacggcggtgggtggaaacttgaaggagagtggaaggaaggcgaggaagtgcaagttctggccttggagccaggcaaaaacccccgggctgtacagactaagcctgggctatttaaaaccaatacaggaaccattggtgccgtgtccctggatttctctccaggcacatcggggagccccatcgtcgacagaaagggaaaggtggttggcctctatggtaacggggtggtcactaggtcaggagcatacgtgtccgctatagcccagaccgagaaaagtattgaagataatcctgagatcgaagacgatatttttcgaaagaaacggctgacgatcatggaccttcacccgggcgcgggcaagacaaaacgctatttacccgccatagtaagagaggcaattaagagggggctgcggactctcatcttggctccaacccgagtcgtggccgctgaaatggaggaggcactgagaggactccctatccgctaccagacacccgccattagggccgaacataccggtcgtgagatcgttgacctgatgtgtcacgctactttcaccatgcggcttctgtctccagtgagagtccctaactataacttgattataatggatgaagcgcatttcacagaccccgcaagcatcgccgctaggggctacatttccacgcgcgtggagatgggggaggccgcaggaatctttatgactgccaccccaccgggctcaaaggatcctttcccccaatctaatgctccaatcatggacgaagaacgagaaattcccgagagaagctggaacagtggtcacgaatgggttacagattttaaagggaagaccgtgtggttcgtcccttccataaaagcgggaaatgacatcgccgcatgcctacggaagaacggcaaaaaggtgattcagctgagcaggaagacttttgattctgagtatgtaaaaacacgcaccaatgactgggatttcgtggttacgactgacatctcagagatgggcgctaactttaaggccgaacgtgtcattgatccaagacggtgtatgaaacccgtgatcctcacagacggggaggaaagggtgatattagcaggacctatgccggtcacccactccagtgccgctcagcgccgaggtagaatcggccggaatccaaagaacgagaatgaccaatacatttacatgggggaacccctggagaacgatgaggactgcgcccattggaaagaagcgaagatgcttctggataatatcaacacccctgagggaattatccccagcatgttcgaaccagagagggaaaaagtagacgcaatagatggcgagtatcgcctcagaggtgaggccaggaagacttttgtggacttgatgcggcgtggggatctgcctgtttggctcgcttaccgcgtggccgctgaaggcattaattatgcagaccgaagatggtgtttcgatggagtcaagaacaatcagatcctggaggaaaacgtggaggttgagatttggacaaaagaaggcgagaggaagaaacttaagccccggtggctagacgcccgcatctactcggatccactggctttgaaagaatttaaggagttcgccgcagggagaaagtctttaaccctgaacctcataacagaaatgggaaggctgcctactttcatgacgcagaaagcgcgggacgcccttgataatctggctgtgctccacaccgccgaggctggtggacgagcatataaccatgccttgtccgagctgccggaaacactagagactctgctccttctgaccttattggcaacagtcaccgggggagtgtttctgttcctcatgagcggcaagggtgtagggaaaatgactctgggcatgtgctgcatcattacggcctcaatccttctgtggtacgctcagattcaaccccactggatcgcggccagtataattctcgaatttttcttgatcgtgctgttaatcccagagcctgaaaagcagagaacaccccaggacaatcagctaacatatgttgtcattgcaatcctgactgtggtggctgccaccatggccaacgagatgggatttctcgagaaaacaaagaaggaccttggcctggggtctatagcaacccaagaaccagagtccaatattttggatatcgacctgcgccctgctagcgcctggactctctacgcggtcgctacaacgttcgttacccccatgctgaggcactcaattgaaaacagtagcgtgaatgtatcccttactgccatcgcaaaccaggccacagtgctcatgggactgggtaaaggctggccgttgtctaagatggatataggggtcccactgttagctatcggatgttacagccaggtgaatcctgttaccctaaccgcagccctgctccttctggtggcgcattatgctattatcggccccggtttgcaggccaaagcaacacgggaggcccaaaagcgtgctgccgcagggattatgaaaaacccaactgtcgacggcatcacggtaattgatctggaccccatcccttacgatccgaagtttgaaaagcagctcggacaggtgatgctgcttatattatgcgttacccaggtgctgatgatgagaacaacttgggctctctgtgaggccttgaccctggcgacaggccccatttccaccctatgggaggggaatccaggaaggttctggaacactacgatcgccgtctcaatggcaaatatctttcgcggctcttatctggctggtgccgggctccttttcagtattatgaaaaacacaaccaatactcggcgaggaaccggcaacataggtgaaacactgggcgagaagtggaaatcgagattgaatgcactgggaaagagcgaatttcaaatctacaaaaagtccggcattcaggaggtggacaggactctcgctaaagagggcatcaagcgcggggaaaccgatcaccatgccgtctctcggggatcagccaagctgagatggttcgtggagcgtaacatggttacacctgaaggcaaagtggtagacttaggttgcgggaggggaggctggagctattactgtggtggccttaagaacgtgaaagaggtcaaggggctgacgaaaggaggccccgggcacgaggaacctattccaatgtccacctatggatggaatctcgttcggctacagagtggcgtggatgtctttttcactccccctgagaagtgcgacacactgttgtgtgatatcggtgaatctagcccaaaccccaccatagaggcggggcgcactctgcgagtgctctcacttgtagaaaattggctgaacaatgacacacaattctgcatcaaggtgttgaacccgtacatgccttccgttattgagaaaatggaaaccctgcagagaaagtacggaggcgctctcgtgaggaatccattaagtcggaacagcacgcatgagatgtattgggtctctaatgcaaccggcaacatcgtgtcctcagtcaatatgattagccgcatgctgatcaacagatttacaatgaaacacaagaaagccacttacgagcccgacgtggatcttgggtcgggaaccaggaatataggtattgaatctgagatccctaacctggacatcattggcaagcgaatagaaaagatcaaacaggagcacgaaacaagttggcattatgatcaggaccacccatacaagacttgggcttatcatgggtcctacgagaccaaacaaacaggaagcgcctcatccatggttaatggcgtagtgcggctactcaccaagccctgggatgtcgtgccgatggttactcagatggcaatgacggacacaacccctttcggtcagcagcgtgtgtttaaagagaaggtcgatactagaacccaagaacccaaggaggggaccaaaaagctgatgaaaattacggccgaatggttgtggaaggagctgggcaaaaagaaaaccccacgcatgtgtactagggaggagttcacacggaaggtgagatctaacgctgcgctcggcgccatctttaccgacgagaacaagtggaaaagcgcacgcgaagctgtagaggatagtaggttctgggaacttgtggacaaggagcgaaatctgcacttagagggcaaatgcgaaacttgtgtttataacatgatggggaagcgggagaaaaagctgggagaatttggtaaggccaaaggctccagagcaatttggtacatgtggttgggggccaggttcctcgagtttgaagctctgggattcctaaatgaggatcactggtttagccgcgagaactctctttcaggcgtcgaaggtgaggggctgcataagctcggatacatcctgcgtgacgtgggcaaaaaggaaggcggggccatgtatgcggacgatacagcaggatgggacacccggataacattggaggatctgaaaaatgaagagatggtgactaaccacatggagggtgaacataagaagctcgccgaggctatcttcaaacttacctaccagaataaggtcgttagagtgcagaggcctacgccccgcggcaccgtaatggacattatcagtcgacgggatcagagagggtccggacaagtgggcacatatggtctgaacacttttaccaatatggaagcccagttaattaggcagatggagggggagggaatcttcaaaagcattcaacacctgacagcaactgaagagatagctgtccagaactggttggcccgcgtgggcagagaacggctctctaggatggctatctcgggcgacgattgcgttgtgaagccactggacgatcgtttcgcctcagcactaaccgcgcttaatgacatggggaaagtccgaaaggatattcagcagtgggagcccagccgcggatggaacgactggacgcaagtgcctttttgctcccatcacttccacgaactgatcatgaaggatggtagagtactcgttgtgccatgtcggaatcaggacgagctgatcggcagggcccgcattagtcagggggctggatggtctttgaaagagacagcctgcttaggcaagagctacgcacagatgtggtccctgatgtattttcatagacgggacctcaggcttgctgccaacgcaatatgttcagccgtcccgagtcactgggtgcccacctctcgaactacatggagcatccatgcgaaacacgaatggatgaccactgaggatatgctgaccgtgtggaatcgtgtctggattcaagaaaacccttggatggaggacaagacaccagttgaatcctgggaggaggtgccctacctaggtaaaagagaagatcagtggtgcgggtcactgatcggactcacgagccgcgctacctgggccaagaacattcagactgcaatcaatcaggtacggtctttgataggcaacgaggaatatacagactacatgccttccatgaagaggttcagacgcgaggaagaggaggccggcgtgctgtggtga

SEQ ID NO: 14432 - RNA, 9876 nt, synthetic construct
  misc_feature 1..9876: note = derived and/or modified CDS sequence (opt3) from DENV-2__GQ868621__SS-prME
  source 1..9876: mol_type = other RNA
agcgcaggcatgatcattatgctgatacccaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacacgatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagcactggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgttctcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacattctcgggaggctgataactgtgaacccgatcgtcaccgagaaggatagccctgtgaacattgaagctgagcccccatttggcgactcgtacatcatcattggagttgagcctggccagttaaagctgaattggttcaaaaaggggtcttccataggacaaatgtttgaaacgaccatgcggggtgccaaacgaatggctatcctaggcgatacagcctgggacttcgggtcactcggaggcgtgtttacaagtattggtaaggcactgcatcaggtattcggggccatctatggcgctgcgtttagcggagtctcctggaccatgaaaattcttatcggcgtgataatcacatggattgggatgaactctcgcagcacttcattgagtgtttccctggtgctcgtcggaatcgtgaccctgtaccttggcgtaatggtgcaggcagatagcggttgtgttgtctcttggaagaataaggagctgaaatgcgggtcaggaattttcatcacggacaacgtgcacacatggaccgaacagtataagtttcaacccgagagtccaagcaaattggcctccgctatacagaaggcccaggaagagggcatttgtggtatcagatctgtgactaggctcgagaatctgatgtggaaacagattacacccgaattaaaccacatcctggcagagaatgaagtcaagctaaccataatgactggcgatatcaaagggattatgcaagccggaaagcggtcgctccgccctcagccaaccgagctgaagtacagctggaaaacatggggcaaggctaaaatgctttccacggaatcatataaccagaccttcttgatcgacgggccggagactgccgagtgccccaatacaaacagagcatggaatagtctggaagttgaggattacggatttggcgtgttcaccacaaacatttggctcaagctgaaagaaaagcaggacgcgttttgtgactctaagttaatgagcgctgccatcaaagataatagggcagtgcatgccgacatgggttattggatagagtccgctctgaacgatacttggaagattgagaaagcctcattcatcgaagtaaagaattgccactggcctaaaagccataccctttggtctaacggggtcttggagtccgaaatgatcattccaaagaacctcgcaggacccgtgagtcaacacaattaccgtcctggctaccacacgcagatcgctggtccatggcatctgggcaagctagagatggacttcgatttttgtgacgggacaaccgttattgtgactgaagattgcggaaaccggggccccagcctgcgaaccacaactgcctctgggaaactcataaccgagtggtgctgtagatcctgcacactgccgcctcttaggtatcgcggagaggacggctgttggtacggtatggaaatccggccattgaaggagaaagaagagaatctggtcaactcattagtgacggcggggcacggacaggttgataatttcagtctcggcgtgctgggtatggccctttttctggaagagatgttgagaaccagggtaggcactaagcatgctattctcctggtcgcagtgagcttcatgacactaatcaccgggaacatgtcgtttaaagacctgggacgcgtggtcgttatggtgggcgccactatggctgatgacattgggatgggagtaacatatctcgccctgcttgcagcgttcaaggtgcgacccacctttgccgctggcttgctgttacggaagctcacgtccaaagagctgatgatgactaccatcggtatagtccttctgtctcaaagcacaatccctgaaaccgtgctagagctcactgatgccctggcattggggatgatggttctgaagattgtgcgtaatatggaaaaataccagttagctgtcacaatcatggccattctctgcgtgcccaacgcagttatcctgcagaatgcctggaaggtgtcatgtaccatacttgctgtcgtaagtgtgtccccactgttgctcacatctagccagcagaaaactgactggattcctctggcgctaaccatcaagggactgaaccccacggccatcttccttacaaccctctccagaactaataaaaagaggtcatggccactgaacgaggcaattatggctgttggcatggtgagcatattggccagttctctgttaaagaatgacatcccgatgaccggccctctcgtcgccgggggactgcttacagtgtgctatgtactgactggtcgctccgctgatttggaactcgagcgggcaaccgacgtgaaatgggaggatcaggccgaaattagcggctcgtcacccatcctgtctattacgatcagtgaggacgggtccatgagcataaagaacgaagaggaggaacacacactaaccatcctgattagaactggacttctcgtcatctctggcctgtttccaattagcatccccataacagcggctgcctggtacttgtgggaggttaaaaagcagagggccggtgtgttatgggatgtgccttccccaccccctatggggaaagccgaactggaggacggagcttatcgaattaagcagaagggcatcctcggctactcacaaatcggggcaggagtctacaaagaaggtaccttccatactatgtggcacgtgacacgcggcgccgttctgatgcacaaggggaaacggattgagccgagttgggcggatgtaaagaaagaccttatcagctatggaggcggttggaagctggagggggaatggaaggagggagaagaggtgcaggtcttggctctagaaccaggcaaaaatcccagagccgtgcagaccaagcctggcctgtttaaaacgaacactgggaccataggagcagtttctctcgatttctccccaggtacatcaggcagtcccattatcgacaagaaagggaaggtggtcggactgtacggcaacggtgtggtaaccaggagcggggcctatgtctccgctattgcccagacagagaagtctatcgaggataatcctgaaatagaggacgatatttttcgtaaacgccggcttactatcatggacttacatccgggagcaggcaagaccaaaagatacctgcccgctatcgtgagggaagccattaagcgaggcctccggacgttgatcctggcgccaacacgcgttgtggccgcagagatggaagaggctctcagagggctgcctattaggtatcaaactcccgccatacgggctgagcacaccggacgagaaatcgtcgaccttatgtgtcatgcaacattcaccatgagactgttgtcgccagtgcgcgttcctaactacaatctaattatcatggatgaggcccacttcactgaccccgccagcatcgctgcgaggggttatatttcaacccgtgtggaaatgggcgaggcagccgggatatttatgacagctacgccaccgggatcccgggatcctttcccccagagtaacgccccaatcattgacgaggaaagagagatccccgaaaggtcttggaatagcggccatgagtgggtcactgattttaaaggtaagaccgtgtggttcgtaccttccattaaggcagggaacgacatcgccgcttgcctgcgcaaaaatggaaagaaagtgatacagctctcacgaaagacatttgattctgaatacgttaaaaccagaactaacgactgggatttcgtcgtgacaaccgacatcagcgagatgggcgcgaattttaaggccgagcgggtgattgatccaaggcgctgtatgaaacccgtcatcttaacggacggcgaagaacgtgtaattctggcagggcctatgccggtgactcacagttccgctgcccaaagacggggaaggatcggtcgcaacccaaagaatgaaaacgaccagtacatatatatgggcgagccccttgaaaatgatgaggactgcgcacactggaaggaggccaaaatgctgctcgataacattaatacacctgaagggatcattcccagcatgttcgagccagaacgagagaaggttgacgctatcgatggagaatacagattgcggggcgaggccaggaaaacctttgtggacctgatgcgcagaggtgatctccctgtctggctggcgtataaggtggcagccgaggggataaactacgctgacaggcggtggtgtttcgatggcatcaaaaacaatcagattcttgaagagaacgttgaagtggagatctggaccaaggagggagaacgtaagaaactaaagccccgctggctggacgcccgaatttattctgatccattggctttaaaagagtttaaggagttcgcagccggcagaaaatcactgactctcaatctgatcacagagatggggaggcttcctaccttcatgacacagaagactcgggacgctctggataacctcgccgtcttgcatacggcagaagcgggaggtcgcgcctacaatcacgctctgtccgagctaccggagaccctggaaacactccttctgttaactttgctggccaccgtgacaggcgggatatttctcttcctgatgagtggaagaggcattggtaagatgacccttgggatgtgctgcatcatcactgcaagcattctgctctggtatgctcaaatccagccccattggatagccgcatcgattatcttggagtttttcctgattgtattactaatcccagaacctgagaaacagaggacgccccaggacaaccaactgacctacgtggttatagccatcctcacagtcgtggctgcgactatggccaatgaaatgggctttcttgagaagaccaaaaaggacctgggattgggctctattgcaacacagcagccagagtccaacatcctggatattgacctccggcctgctagcgcctggaccctgtacgccgtggcaactacattcgtcacgcccatgcttcgacactcaatcgaaaatagttctgttaacgtgtccctcaccgctattgccaatcaggcgactgtactgatggggttgggaaaaggttggccgctgagcaagatggatatcggcgtgccattactagctatagggtgttattcacaagtcaaccctattacactgaccgccgcactccttctgttggtggcccactacgctatcatcggacccggcctgcaggcaaaggccaccagagaggcgcagaaacgcgctgccgcaggtattatgaagaatccaacagttgacgggataactgtgatcgatctcgaccccattccttatgatccgaaatttgaaaagcagctgggccaagtcatgcttttaatcctgtgcgtaacacaggtgctcatgatgaggaccacatgggccttgtgtgaggctctgactctagccaccggacccattagtacactgtgggaaggcaacccagggcggttctggaataccactatcgcagttagcatggctaacatatttcgtggatcctacctcgccggcgcgggtcttctgttctctatcatgaaaaatacgacaaacaccagaagggggactggaaacattggcgagaccttgggtgagaagtggaaaagccgcctgaatgccctcggcaagtccgaatttcagatctataagaaatcagggattcaagaggtggaccggacactggcaaaggaaggaatcaaacgaggcgagactgatcatcacgctgtctctagagggagtgccaagttaaggtggttcgtggagcgcaacatggtcacccctgaaggaaaagtggttgaccttggctgcggtagagggggatggtcgtactattgtggcggtctgaagaatgtgagagaggtaaagggcctcacaaaagggggacccggccatgaggaacctataccaatgagcacgtacgggtggaacctagtgcgtctgcagtccggagtcgatgtatttttcattccccctgaaaagtgcgacaccttgctgtgtgatatcggcgagtcttcaccaaatcccactgtggaggcaggtaggacactccgggtccttaacctggtggaaaattggttgaacaataacacccagttctgcatcaaagtactgaatccgtacatgcctagcgtgattgagaagatggaagctctccagcgcaaatatgggggagccttagttcgaaacccactgtccagaaatagtactcacgagatgtactgggtgtctaacgccagcggcaatatagtctcatccgtgaacatgatcagtaggatgcttattaaccggtttacaatgcgccataagaaggcgacctatgaacccgacgtcgacctgggcagcgggacgagaaatatcggaattgagtctgaggtgcctaacctagatatcataggtaaaaggatcgaaaagattaaacaagagcacgaaacctcctggcactacgaccaggatcatccatataagacatgggcttaccacggctcatatgagactaaacagaccgggagcgcatcgtctatggttaatggagtagtgcgactcctgacaaagccctgggacgtcttgccgactgtgacccagatggccatgacagataccactcctttcggccaacagcgggtttttaaggaaaaagtggacacgcgtacacaggagcccaaggagggtaccaaaaagctgatgaaaatcactgctgaatggctctggaaggagcttgggaaaaagaagaccccaagaatgtgtacacgcgaagagttcacgaggaaagtccggagtaacgccgcactgggagccatttttaccgatgagaataagtggaaatccgctagagaagcggtggaggacagccgcttctgggaattagtagataaggagaggaacctgcatttggaaggcaaatgcgagacttgtgtgtacaatatgatgggcaagcgagagaagaaactcggggaatttggaaaggccaaaggttcacgggcaatctggtacatgtggctgggcgctagattcctagagtttgaagcccttgggttcctgaacgaggaccactggttttccagggaaaattctctcagcggagttgagggcgagggtctgcacaagttggggtatattctgcgcgatgtcagtaaaaaggaaggaggcgcaatgtacgccgacgacacagctggctgggatacccgtataactctcgaggaccttaagaacgaagagatggtgacaaatcatatggaaggggagcacaaaaagctggccgaggcgatcttcaaattaacctatcagaacaaggtggtccgggttcaaagacctacacccaggggaactgtgatggatattatctcccgccgagaccagcggggtagcggccaggtagggacctacggactgaatacgtttaccaacatggaagcacaattgatcagacagatggagggcgaaggtgtgttcaaaaatattcagcatctcacagtcactgaggaggtggccgttcagaactggctggctagggtggggcgcgaaagactatctcggatggccatatcaggagatgactgcgtcgtgaagccacttgatgacaggttcgcaaacgctctgaccgccctcaatgatatgggcaagatccgtaaagacattcaacagtgggagcccagtaagggctggaacgattggacacaggtacctttttgctcccaccatttccacgaactgatcatgaaagacgggcgagttttggtggtcccatgtcgcaatcaggatgagttaattggacgggctcggatcagccaaggtgccggctggtctctgagggaaactgcatgcctcgggaagtcgtatgcgcagatgtggtcacttatgtactttcaccgcagagacctgcggctagccgctaacgccatatgtagcgcagtgccgtcccattgggtgcccaccagtaggacgacatggtctatccacgctaaacatgagtggatgaccactgaggacatgctgacagtctggaatcgagtttggattcgtgaaaacccttggatggaggataagaccccagtggaaagctgggaggaaatcccctatctcggaaagagagaggaccagtggtgcggctccttgattggtctgacttcacgcgccacctgggccaaaaatatccaggccgcgataaaccaagtacggagtcttattgggaatgaggaatacacagattacatgccttctatgaagaggttcagacgcgaggaagaggaagctggagtgctgtggtga

SEQ ID NO: 14433 - RNA, 9876 nt, synthetic construct
  misc_feature 1..9876: note = derived and/or modified CDS sequence (opt3) from DENV-2__FJ639704__SS-prME
  source 1..9876: mol_type = other RNA
agcgcaggaatgatcattatgctgatccccaccgtggtcgctttccacctcaccactcggaacggggaacctcatatgatcgttggcattcaggaaaagggtaaatcccttctgtttaagacggaggacggcgtgaatatgtgcaccttgatggcaatggatttaggggaactgtgtgaggacacaatcacttacaaatgcccactactcaggcaaaacgaaccggaggatattgactgttggtgcaattctacctcaacatgggtaacctatggaacttgtacaaccacgggcgagcaccggcgcgaaaagcgaagtgtggccctggtcccccatgtgggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggctctcattttcatcctgctgactgcagttgccccatctatgacaatgcgctgcatagggatttcgaacagagattttgtggaaggagtctcaggtggcagctgggtggacatcgtactcgagcacgggagttgtgttaccactatggctaagaataagcccacattagatttcgaactgattaaaaccgaggccaagcagcctgcgacgcttaggaaatattgcatcgaagcaaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgccatgtttacctgcaagaaaaacatggaaggaaagattgtgcagcctgagaatctcgaatacacaatagtcgttaccccacactccggtgaggagcatgctgtgggcaacgacactgggaaacacggaaaggaaatcaaagtaacgccgcagtcaagtattacagaggccgaactgaccggctatggtactgtgaccatggagtgtagccccagaacagggcttgatttcaatgaaatggtcctgttgcaaatggagaacaaggcatggctcgtgcacaggcagtggtttctggacttacctctgccatggctccccggcgctgataagcaggagtctaattggatccagaaagaaacccttgttactttcaagaaccctcatgccaaaaagcaagacgtggtcgtgctgggatcccaggagggcgcgatgcacacagccttgacgggggcaaccgaaatacagatgtcaagcggaaatctactgtttactggtcatctcaaatgccggctgcgtatggacaaacttcaactgaagggcatgagttactctatgtgtacagggaaattcaaggtagttaaagagattgctgagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagccgagcccccatttggcgactcgtacattatcatcggagtggagcctggccagttaaagctgaattggttcaaaaaggggtcttccattggacaaatgtttgaaacgaccatgcggggtgctaaacgaatggccatactaggcgatacagcatgggacttcgggtcactcggaggcgtatttacaagtatcggtaaggccctgcatcaggtcttcggggctatttatggcgcggcatttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggccgatagcggttgtgtcgtgtcttggaagaataaggagctgaaatgcgggtcaggaatcttcattacggacaacgtgcacacatggaccgaacagtataagtttcaacccgagagtccaagcaaattggcttccgccatccagaaggcacaggaagagggcatatgtggtattagatctgtcactaggctcgagaatctgatgtggaaacagatcacacccgaattaaaccacattctggccgagaatgaagttaagctaaccatcatgactggcgatataaaagggatcatgcaagctggaaagcggtcgctccgccctcagccaaccgagctgaagtacagctggaaaacatggggcaagacgaaaatgctttccaccgaatcatataaccagactttcttgattgacgggccggagacaaccgagtgccccaatacaaacagagcctggaatagtctggaagtggaggattacggatttggcgtgttcactaccaacatctggctcaagctgaaagaaaagcaggacgcattttgtgactctaagttaatgagcgcggctattaaagataatagggccgtacatgcagacatgggttattggatcgagtccgccctgaacgatacgtggaagatagagaaggcttcattcattgaagtcaagaattgccactggcctaaaagccatacactttggtctaacggggtgttggagtccgaaatgatcatcccaaagaacctcgccggacccgttagtcaacacaattaccgtcctggctaccacacccagattgcaggtccatggcatctgggcaagctagagatggacttcgatttttgtgacgggactaccgtgatcgtcacagaagattgcggaaaccggggccccagcctgcgaactaccacagcttctgggaaactcattacggagtggtgctgtagatcctgcaccctgccgcctcttaggtatcgcggagaggacggctgttggtacggtatggaaatacggccattgaaggagaaagaagagaatctggtgaactcattagttactgccgggcacggacaggtggataatttcagtctcggcgtactgggtatggcgctttttctggaagagatgttgagaacaagggtcggcaccaagcatgccatcctcctggtggctgtgagcttcgtcactctaattacagggaacatgtcgtttaaagacctgggacgcgttgtggtaatggtgggcgcaaccatggccgatgacatcgggatgggagtcacgtatctcgctctgcttgccgcattcaaggtgcgacccacttttgcggccggcttgctgttacggaagctcacctccaaagagctgatgatgacaaccattggtatcgttcttctgtctcaaagcactatacctgaaacaatcctagagctcaccgatgctctggccttggggatgatggtgctgaagattgtccgtaatatggaaaaataccagttagcagtgacaatcatggctattctctgcgttcccaacgccgtgatcctgcagaatgcatggaaggtctcatgtactatacttgccgtagtgagtgtttccccactgttgctcacctctagccagcaaaaagctgactggattcctctggcgctaacgatcaagggactgaaccccacagccatcttccttaccactctctccagaaccaataaaaagaggtcatggccactgaacgaggcaattatggctgtgggcatggtcagcatattggccagttctctgttaaagaatgacatcccgatgacaggccctctcgtggccgggggactgcttactgtatgctatgtgctgaccggtcgctccgctgatttggaactcgagcgggcaacggacgtcaaatgggaggaacaggccgagattagcggctcgtcacccatcctgtctattacaatcagtgaagatgggtccatgagcataaagaacgaggaggaagaacagaccctaactatcctgattagaacaggacttctcgttatctctggcctgtttccaattagcatccccataaccgcggctgcctggtacttgtgggaagtgaaaaagcagagggccggtgtgttatgggacgtcccttccccaccccctatggggaaagccgagctggaagatggagcttatcgaattaagcaaaagggcatcctcggctactcacagatcggggcaggagtgtacaaagagggtactttccacacaatgtggcatgttacccgcggcgccgtactgatgcacaaggggaaacggattgagccgagttgggcggacgtgaagaaagatcttatcagctatggaggcggttggaagctggaaggggagtggaaggaaggagaggaagtccaggtgttggctctagagccaggcaaaaatcccagagccgttcagacgaagcctggcctgtttaaaactaacaccgggacaataggagcagtgtctctcgacttctccccaggtacctcaggcagtcccattatcgataagaaagggaaggtcgtgggactgtacggcaacggtgtagtcacaaggagcggggcctatgtgtccgctattgcccaaactgagaagtctatcgaagacaatcctgagatagaagatgacatttttcgtaaacgccggcttaccatcatggatttacacccgggagcaggcaagacgaaaagatacctgcccgctatcgttagggaggccattaagcgaggcctccggacattgatcctggcgccaactcgcgtggtcgccgcagaaatggaggaggctctcagagggctgcctattaggtatcagacccccgccatacgggctgaacatacaggacgagagatcgtggaccttatgtgtcacgcaaccttcactatgagactgttgtcgccagttcgcgtgcctaactacaatctaattatcatggacgaagcccatttcaccgatcccgccagcatcgctgcgaggggttatatttcaacacgtgtcgagatgggcgaggcagccgggatatttatgacggctactccaccgggatcccgggaccctttcccccagagtaacgccccaatcattgatgaagagagagaaatccccgagaggtcttggaatagcggccacgaatgggtgaccgactttaaaggtaagacagtatggttcgtgccttccattaaggcagggaacgatatcgccgcttgcctgcgcaaaaatggaaagaaagttatacaactctcacgaaagacctttgactctgagtacgtcaaaactagaacaaacgattgggacttcgtggtgaccacggatatcagcgagatgggcgcgaattttaaggccgaacgggtcattgacccaaggcgctgtatgaaacccgtaatcttaactgatggcgaggaacgtgtgattctggcagggcctatgccggttacacatagttccgctgcccagagacggggaaggatcggtcgcaacccaaagaatgagaacgaccagtacatatatatgggcgaaccccttgagaatgacgaggattgcgcacactggaaggaagccaaaatgctgctcgacaacattaatacccctgaggggatcattcccagcatgttcgaaccagagcgagaaaaggtggatgctatcgacggagagtacagattgcggggcgaggccaggaaaacctttgtcgatctgatgcgcagaggtgacctccctgtgtggctggcgtataaggttgcagccgaagggataaactacgctgataggcggtggtgtttcgacggcatcaaaaacaatcagattcttgaggaaaacgtggaggtcgagatctggactaaggaaggagagcgtaagaaactaaagccccgctggctggatgcccgaatttattctgacccattggctttaaaagaatttaaggagttcgcagccggcagaaaatcactgacactcaatctgatcaccgaaatggggaggcttcctacattcatgactcaaaagacgcgggatgctctggacaacctcgccgtgttgcacaccgcagaggcgggaggtcgcgcctacaatcatgctctgtccgagctaccggaaacactggagactctccttctgttaaccttgctggccacagtaaccggcgggatatttctcttcctgatgagtggaagaggcattggtaagatgactcttgggatgtgctgcatcatcacggcaagcattctgctctggtatgctcagatccagccccactggatagccgcatcgattatcttggaatttttcctgattgtgttactaatcccagagcctgaaaaacagaggacaccccaagataaccagctgacatacgttgtcatagccatcctcactgtggtggctgcgaccatggccaatgagatgggctttcttgagaagactaaaaaggacctgggattgggctctattgcaacccagcagccagaatccaacatcctggacattgatctccggcctgctagcgcctggactctgtacgccgtcgcaacaacgttcatcacccccatgcttcgacattcaattgagaatagttctgttaacatctccctcactgctatagccaatcaagcgacagtgctgatggggttgggaaaaggttggccgctgagcaagatggacattggcgtaccattactagctatcgggtgttattcacaggtgaaccctatcaccctgaccgccgcactccttctgttggtcgcccactacgctattataggacccggcctgcaggcaaaggccacaagagaagcgcagaaacgcgctgccgcaggtatcatgaagaatccaactgtggatgggattacggttatcgacctcgatcccattccttatgacccgaaatttgagaagcaactgggccaggtgatgcttttaatcctgtgcgtcacccaggtactcatgatgaggacaacttgggccttgtgtgaagctctgaccctagccacaggacccataagtaccctgtgggagggcaacccagggcggttctggaatactacgatcgcagtgagcatggctaacatttttcgtggatcctacctcgccggcgcgggtcttctgttctctatcatgaaaaatacaaccaacactagaagggggaccggaaacattggcgagacattgggtgaaaagtggaaaagccgcctgaatgccctcggcaagtccgagtttcaaatctataagaaatcagggatacaggaagttgatcggactctggcaaaggagggaattaaacgaggcgagaccgaccaccatgctgtgtctagagggagtgccaagttaaggtggttcgtcgaacgcaacatggtgacacctgagggaaaagtcgtggatcttggctgcggtagagggggatggtcgtactattgtggcggtctgaagaatgttaaggaagtgaaaggcctcacgaaagggggacccggccacgaggaacctatcccaatgagcacctacgggtggaacctagtaagactgcagtccggagtggacgtctttttcataccccctgagaaatgcgatactttgctgtgtgacattggcgagtcttcaccaaatcccacagttgaagcaggtcgtaccctcagggtgcttaacctggtcgagaattggttgaacaataacactcagttctgcataaaggtgctgaatccgtacatgcctagcgtaatcgagaaaatggaggctctccaacggaagtatgggggagccttagtgcgcaacccactgtcccgaaatagtacacatgaaatgtactgggtttctaacgccagcggcaatattgtgtcatccgtcaacatgatcagtagaatgcttattaacaggtttaccatgcggcacaagaaagcgacgtatgagcccgatgtggacctgggcagcgggacccgcaatatcggaatagagtctgaagtccctaacctagacatcattggtaagagaatcgagaaaattaagcaggaacatgagacatcctggcactacgatcaggaccacccatataaaacttgggcttaccatggctcatatgaaaccaagcagacagggagcgcatcgtctatggtgaatggagttgtaaggctcctgactaagccctgggatgtgttgccgaccgtcacacaaatggccatgaccgacactacgcctttcggccagcagcgagtgtttaaagagaaggttgatacacggacccaggagcccaaagaaggtactaagaaactgatgaagatcaccgctgagtggctctggaaagaacttgggaagaagaaaacaccacgtatgtgtacgagagaggagttcacccgcaaggtgaggagtaacgccgcactgggagccatttttactgacgaaaataaatggaagtccgctcgggaggcggtcgaagatagcagattctgggagttagtggacaaagaacgcaacctgcacttggagggcaagtgcgagacatgtgtatacaatatgatgggcaagagggagaaaaagctcggggagtttggaaaagccaagggttcacgagcaatatggtacatgtggctgggcgctcggttcctagaatttgaggcccttgggttcctgaacgaagatcattggttttccagagaaaattctctcagcggagtggagggcgagggtctgcacaaattggggtatatcctgagggacgttagtaagaaggagggaggcgcaatgtacgccgatgacaccgctggctgggacactcgcattacactcgaagatcttaaaaacgaggaaatggtcaccaatcacatggagggggagcataagaaactggccgaagcgatcttcaagttaacatatcaaaacaaagtggtgcgtgtccagcggcctactcccagaggaaccgttatggacatcatttccaggcgcgatcagcgaggtagcggccaagtggggacgtacggactgaatacctttacaaacatggaggcacagttgatacggcagatggaaggcgagggtgtattcaagaatatccagcacctcactgtgaccgaggaagtcgccgtgcaaaactggctggctagagttgggagggagcgcctatctagaatggccatttcaggagacgattgcgtggtcaagccacttgacgatcggttcgcaaacgctctgacagccctcaatgacatgggcaaaatcaggaaggatattcagcagtgggaacccagtaaaggctggaacgactggactcaggtgcctttttgctcccatcacttccatgagctgatcatgaaggatgggcgtgtattggttgtgccatgtcgaaatcaagacgaattaataggacgcgctagaatcagccagggtgccggctggtctctgcgggagaccgcatgcctcgggaaatcgtatgcgcagatgtggtcacttatgtactttcacaggcgcgatctgagactagccgctaacgccatttgtagcgcagtcccgtcccactgggtgcccacgagtcggacaacctggtctatccatgctaagcacgagtggatgactacagaagacatgctgaccgtgtggaatagggtctggattcgagagaacccttggatggaagacaagactccagttgagagctgggaagagatcccctatctcggaaaacgtgaggatcagtggtgcggctccttgataggtctgacctcaagagccacatgggcaaagaatattcaagccgcgatcaaccaggtgcgcagtcttattgggaatgaagagtacacggactacatgccttctatgaaacggttcaggagagaagaggaagaggctggagtactgtggtga

SEQ ID NO: 14434 - RNA, 9876 nt, synthetic construct
  misc_feature 1..9876: note = derived and/or modified CDS sequence (opt3) from DENV-2__GQ868622__SS-prME
  source 1..9876: mol_type = other RNA
agcgccggaatgatcattatgctgatacccaccgtgatggctttccacctcaccactcggaacggggaacctcatatgatcgtaggtattcaagaaaagggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagaggatcgagacttggatactgaggcatcctggcttcaccatcatggccgcaattttggcctacacaatcggcaccacgcactttcagcgggctctcattttcatcctgctgactgcagtggccccatctatgacaatgcgctgcatagggatttcgaacagagattttgttgaaggagtgtcaggtggcagctgggtcgacatcgtgctcgagcacgggagttgtgtaaccactatggctaagaataagcccacattagatttcgaactgattaaaaccgaggccaggcagcctgcgacgcttcggaagtattgcatcgaagcaaaattgaccaacacaactaccgagtcccgctgtccaacacaaggagagccctctctgaaggaagaacaggacaaacgatttgtttgcaagcatagcatggtggatagaggctggggtaatgggtgtggactattcggcaagggcgggatcgtcacttgcgccatgtttacctgcaaaaagaacatggaaggaaaaattgtgcagcctgagaatctcgaatacacaatagtggtcaccccacactccggtgaggagcatgctgttggcaacgacactgggaagcacggaaaagaaatcaaggtgacgccgcagtcaagtattacagaggccgaactgaccggctatggtactgtaaccatggagtgtagccccaggacagggcttgatttcaatgaaatggtgctgttgcaaatggagaacaaagcatggctcgtccaccggcagtggtttctggacttacctctgccatggctccccggcgctgataagcagggatctaattggatccagaaggagacccttgtgactttcaaaaaccctcatgccaagaaacaagacgttgtggtcctgggctcccaggaaggggcgatgcacacagccttgacgggagcaaccgagatacagatgtcaagcggtaatctactgtttactggccatctcaagtgccgtctgcgcatggacaaacttcaactgaaggggatgagttactctatgtgtacaggaaagttcaaagtggtaaaggaaattgctgagacccagcacggcacaatcgttatcagagtgcagtatgagggtgatgggtccccatgcaaaattcccttcgaaatcatggacttggagaagaggtacgtcctcggccggctgattactgtgaacccgatagtcaccgaaaaagatagccctgtgaacatcgaggccgaacccccatttggagactcgtacattatcatcggcgttgagcctgggcagttaaagctgaattggttcaagaaaggatcttccattggtcaaatgtttgagacgaccatgcgaggcgctaagcgcatggccatactaggggatacagcatgggacttcggatcactcggcggtgtgtttacaagtatcgggaaagccctgcatcaggtattcggcgctatttatggagcggcatttagcggcgtctcctggaccatgaagatccttattggggtgatcataacatggatcggaatgaactctagaagcacttcattgagtgtttccctggtgctcgtcggcattgtgaccctgtaccttggtgtaatggtgcaggccgatagcgggtgtgttgtctcttggaaaaataaggaactgaagtgcggatcaggcatcttcattacggacaacgtgcacacatggaccgagcagtataaatttcaacccgaaagtccaagcaagttggcttccgccatccagaaagcacaggaggaaggtatatgtggcattaggtctgtgactcggctcgagaatctgatgtggaagcagatcacacccgagttaaaccacattctggccgaaaatgaggtcaaactaaccatcatgactggggatataaagggaatcatgcaagctggcaaacgctcgctcagacctcagccaaccgaactgaagtacagctggaagacatgggggaaagccaagatgctttccacggagtcacataaccagaccttcttgattgacggaccggaaactgcagagtgccccaatacaaacagggcgtggaatagtctggaggttgaagattatggctttggtgtgttcaccacaaacatctggctcaaactgaaggagaaacaggacgctttttgtgactctaagttaatgagcgccgcaattaaggataatcgtgccgtgcacgctgacatggggtactggatcgaatccgccctgaacgatacttggaaaatagagaaggcatcattcattgaggtcaagaattgccattggcctaagagccacaccctttggtctaacggagtcttggaatccgagatgatcatccccaaaaacctcgctggccccgtgagtcaacacaattatcggcctggttaccatacgcagattgccggcccatggcacctggggaagctagaaatggacttcgatttttgtgacggaacaaccgttatcgtgactgaggattgcggcaaccgagggcccagcctgagaaccacaactgcgtctggaaagctcattaccgaatggtgctgtaggtcctgcacactgccgcctcttcgctaccggggcgaggacggttgttggtatgggatggagataagaccattgaaagaaaaggaggaaaatctggtcaactcattagtgacggccggacatggccaggttgataatttcagtctcggtgtgctgggcatggctctttttctggaggaaatgttgaggacccgcgtagggactaaacacgcaatcctcctggtcgccgtgagcttcgtgacactaattaccggaaacatgtcgtttaaggacctgggccgagtcgttgtgatggtaggggctactatgacagatgacatcggaatgggcgtgacctacctcgccctgcttgcagcgttcaaagtccggcccacgtttgccgctggtttgctgttacgtaagctcacttccaaggagctgatgatgaccacaattgggatcgtgcttctgtctcaaagcaccatacctgagactatcctagaactcacagatgccctggcattgggaatgatggttctgaaaattgtgagagacatggagaagtatcagttagctgtcaccatcatggccattctctgcgtgcccaatgcagttatcctgcagaacgcctggaaagtgtcatgtacaatacttgctgtcgtaagtgtgtccccactgttgctcacttctagccagcaaaagaccgactggattcctctggcgctaacgatcaaaggcctgaatcccacagccatcttccttaccactctctccaggaccaacaagaaacgctcatggccactgaatgaagcaattatggctgttggcatggtgagcatattggccagttctctgttaaagaacgatatcccgatgacagggcctctcgtcgccggaggtctgcttactgtgtgctacgtactgaccggccggtccgctgacttggagctcgaaagagcaacggatgtgaagtgggaggaccaggccgagattagcgggtcgtcacccatcctgtctattacaatcagtgaagatggatccatgagcatcaaaaatgaggaagaggagcagaccctaactatcctgattaggacaggccttctcgtcatctctggtctgtttccagttagcattcccatcaccgcggctgcctggtatttgtgggaagtgaagaaacagcgagcaggggtgttatgggacgtcccttccccaccccctatgggaaaggccgagctggaagatggcgcttaccgcataaaacaaaagggcattctcgggtattcacagatcggagccggtgtgtacaaggagggcactttccatacaatgtggcacgttaccagaggggcagtactgatgcacaaaggaaagagaatcgaaccgagttgggcggacgtgaaaaaggatcttattagctacggcggtgggtggaaactggagggagagtggaaggaaggcgaggaagtccaggtgttggctctagagccaggcaagaaccccagggccgttcagacgaaacctgggctgtttaagactaataccggaacaatcggtgcagtgtctctcgacttctccccaggcacctcagggagtcccataattgataaaaagggaaaagtcgtgggcctgtatggtaacggggtagtcacacgtagcggagcctacgtgtccgctatcgcccaaactgaaaagtctattgaggacaaccctgagatcgaagatgacatatttcgcaagcggagacttaccattatggacttacatccgggcgcaggcaaaacgaagaggtatctgcccgctatcgttcgagaggccatcaaacgggggctccgcacattgattctggcgccaactagagtggtcgccgcagaaatggaggaagctctcaggggactgcctatccggtaccagacccccgccattcgagctgagcacacaggtagagagatagtggatcttatgtgtcatgcaaccttcactatgcgcctgttgtcgccagttagggtgcctaattataacctaatcattatggacgaagcccacttcaccgatcccgccagcatcgctgcgcgtggctacatctcaacacgggtcgagatgggggaagcagccggaatttttatgacggctactccaccgggctccagagaccctttcccccagagtaatgccccaataatcgatgaggagagggaaattcccgagcgctcttggaacagcggtcatgaatgggtgaccgactttaaggggaaaacagtatggttcgtgccttccatcaaggcaggaaatgatattgccgcttgcctgcgaaagaacggcaaaaaggttatccaactctcaagaaaaacctttgactctgagtatgtcaagactcggacaaatgattgggacttcgtggtgaccacggatataagcgaaatgggcgcgaactttaaagccgagagggtcatcgacccacgccgttgtatgaagcccgtaattttaactgacggggaggaaagagtgatcctggcaggacctatgccggttacacacagttccgctgcccagcggaggggtcgcattggccgaaatcccaaaaacgagaatgatcagtacatctacatgggggaaccccttgagaacgacgaagattgcgcacactggaaggaggccaagatgctgctcgacaatataaacacccctgagggaattatccccagcatgttcgaaccagagagagaaaaagtggatgctattgacggcgagtatcggttgaggggtgaagcccgcaagacctttgtcgatctgatgagaagaggggacctccctgtgtggctggcgtacaaagttgcagccgagggcatcaattatgctgatcggcgttggtgtttcgacggaataaagaacaaccagatccttgaggaaaatgtggaggtcgaaatttggactaaagagggcgagcgcaagaagctaaaaccccgatggctggatgccagaatctactctgacccattggctttaaaggaatttaaagagttcgcagccgggaggaagtcactgacactcaacctgattaccgaaatgggacggcttcctacattcatgactcagaaaacgcgcgatgctctggacaatctcgccgtgttgcataccgcagaggcgggtggcagagcctataaccacgctctgtccgaactaccggagacactggagactctccttctgttaaccttgctggccacagtaaccgggggaatctttctcttcctgatgagtggcaggggtatagggaagatgactcttggcatgtgctgcattatcacggcaagcatcctgctctggtacgctcagattcagccccattggatcgccgcatcgataattttggaatttttcctgatcgtgttactaattccagagcctgaaaagcagcggaccccacaagacaatcagctgacatatgttgtcatcgccatactcactgtggtggctgcgaccatggccaacgagatgggatttcttgagaaaactaagaaagatctgggcttggggtctatcgcaacccagcagccagaatccaatattctggacatcgatctccgacctgctagcgcctggactctgtacgccgtcgcaacaacgttcgttacccccatgcttagacactcaattgagaacagttctgtgaatgtatccctcactgctatcgccaaccaagcgacagtgctgatgggattgggtaagggctggccgctgagcaaaatggacattggggtcccattactagctatcggatgttactcacaggtgaatcctataaccctgaccgccgcactccttctgttggttgcccactatgctattatcggccccggtctgcaggcaaaggccacacgcgaagcgcagaagagggctgccgcagggatcatgaaaaacccaactgtggatggcattacggtcatagacctcgatcccatcccttacgacccgaagtttgagaaacaactgggacaggtaatgcttttaattctgtgcgtgacccaggttctcatgatgcggacaacttgggccttgtgtgaagctctgaccctagccacaggccccatcagtaccctgtgggaggggaatccaggacgtttctggaacactacgattgcagtgagcatggctaatatctttagaggctcctatctcgccggtgcggggcttctgttctctataatgaagaacacaaccaatactaggcgcggaaccggcaacatcggtgaaacattgggcgagaaatggaaaagccggctgaacgccctcgggaaatccgagtttcaaacttacaagaagtcaggcattcaggaagtcgatcgaaccctggcaaaagagggcatcaagagaggggaaacagaccatcacgctgtgtctaggggaagtgccaaattacgctggttcgtcgagcggaatatggtgacgcctgagggcaaggttgtggatcttggttgcgggagaggaggctggtcgtattactgtggtggcctgaaaaacgtacgtgaagtgaaggggctcaccaagggaggccccgggcatgaggaacctattccaatgagcacttatggatggaatctagtcaggctgcagtccggcgttgacgtgtttttcataccacctgagaaatgcgatacattgctgtgtgacataggtgaatcttcaccaaaccccaccgtcgaggcagggcggactctccgcgtgcttaatctggtagagaactggttgaataacaatacacagttctgcattaaggtgctgaacccgtacatgcctagcgttatcgagaaaatggaggctctccaacgaaagtacggaggcgccttagtgagaaatccactgtccaggaacagtacccacgaaatgtattgggtctctaatgccagcggcaacatcgtgtcatccgtcaatatgattagtcggatgcttataaaccgctttacgatgagacataaaaaggcgacctacgagcccgacgtggatctggggagcggaacaaggaacatcggtattgaatctgagatccctaatctagacattatcggcaagcgaatagagaaaatcaagcaggaacacgagacttcctggcactatgatcaggaccatccatacaaaacctgggcttatcacgggtcatacgaaacaaagcagactggaagcgcatcgtctatggttaacggcgtagtgcggctcctgaccaaaccctgggatgtcttgccgacagtgacccaaatggccatgactgacacgacacctttcggtcagcagcgtgtttttaaggagaaggtggataccagaactcaggaacccaaagaggggaccaagaaactgatgaagattacagctgagtggctctggaaagaacttggaaagaaaaagacgccacgcatgtgtaccagggaggagttcactcggaaggtcagaagtaatgccgcactgggcgccatctttacagacgagaacaaatggaagtccgctcgcgaggcggtggaagataggcgattctgggagttagtagacaaagaacggaatctgcatttggagggcaagtgcgaaacctgtgtgtataacatgatggggaaaagagagaagaagctcggagagtttggtaaagccaagggcagcagggcaatttggtacatgtggctgggggctcgcttcctagaatttgaggcccttggattcctgaatgaagatcactggttttcacgtgagaactccctctctggcgttgaaggtgaggggctgcacaaattgggatacatcctgcgggacgtcagcaagaaagagggcggcgcaatgtatgccgacgatactgctgggtgggacacaagaattaccctcgaagatcttaagaatgaggaaatggtgacaaaccatatggagggagaacacaagaaactggccgaggcgatattcaagttaacttaccaaaataaagtggtcagggttcagcgccctacaccccgaggtacggtgatggacatcattagtcggagagatcagaggggctccgggcaagtaggaacctatggcctgaacacatttactaatatggaggcacagttgatccgccagatggaaggtgagggggtgttcaagaacatccagcatctcaccgccacagaagaggtcgctgtgcaaaattggctggccagagttggacgggagaggctaagccgtatggcaatttctggcgacgattgcgtggtcaaaccacttgacgatcgattcgctaacgccctgactgctctcaacgacatgggcaagatacgcaaggatatccagcagtgggaaccctcaaaagggtggaatgactggacccaggtgcctttttgcagtcaccatttccacgagctgattatgaaggatggaagagtattggttgtgccatgtcggaaccaagacgaattaatcggtagggcccgcatttcccagggcgcagggtggagcctgagagagacggcgtgcctcggaaaatcttacgcccagatgtggtcgcttatgtattttcaccggagggacctgcgactagctgccaatgcaatctgttcagctgtcccgagccattgggtgcccacatcccgtaccacttggagtatacacgccaagcatgaatggatgacaaccgaggatatgctgactgtgtggaacagagtctggatccgcgagaatccttggatggaagacaaaaccccagttgagtcttgggaagagattccctacctcggcaagcgggaagatcagtggtgcggtagcttgatcgggctgacatccagggcaacgtgggccaagaacattcaagcggctatcaatcaggtgagatcacttataggaaacgaggagtataccgactacatgcctagtatgaaacgcttccggagggaagaggaagaggccggcgtactgtggtga

SEQ ID NO: 14435 - RNA, 9876 nt, synthetic construct
  misc_feature 1..9876: note = derived and/or modified CDS sequence (opt3) from DENV-2__FJ639705__SS-prME
  source 1..9876: mol_type = other RNA
agcgccggaatgatcattatgctgatacccaccgtgatggctttccacctcaccactcggaacggggaacctcatatgatcgtaggtattcaagaaaagggaaaatcccttctgtttaagacggaagacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagaggatcgagacttggatactgaggcatcctggcttcaccatcatggccgcaattttggcctacacaatcggcaccacgcactttcagcgggctctcattttcatcctgctgactgcagtggccccatctatgacaatgcgctgcatagggatttcgaacagagattttgttgaaggagtgtcaggtggcagctgggtcgacatcgtgctcgagcacgggagttgtgtaaccactatggctaagaataagcccacattagatttcgaactgattaaaaccgaggccaggcagcctgcgacgcttcggaagtattgcatcgaagcaaaattgaccaacacaactaccgagtcccgctgtccaacacaaggagagccctctctgaaggaagaacaggacaaacgatttgtttgcaagcatagcatggtggatagaggctggggtaatgggtgtggactattcggcaagggcgggatcgtcacttgcgccatgtttacctgcaaaaagaacatggaaggaaaaattgtgcagcctgagaatctcgaatacacaatagtggtcaccccacactccggtgaggagcatgctgttggcaacgacactgggaagcacggaaaagaaatcaaggtgacgccgcagtcaagtattacagaggccgaactgaccggctatggtactgtaaccatggagtgtagccccaggacagggcttgatttcaatgaaatggtgctgttgcaaatggagaacaaagcatggctcgtccaccggcagtggtttctggacttacctctgccatggctccccggcgctgataagcagggatctaattggatccagaaggagacccttgtgactttcaaaaaccctcatgccaagaaacaagacgttgtggtcctgggctcccaggaaggggcgatgcacacagccttgacgggagcaaccgagatacagatgtcaagcggtaatctactgtttactggccatctcaagtgccgtctgcgcatggacaaacttcaactgaaggggatgagttactctatgtgtacaggaaagttcaaagtggtaaaggaaattgctgagacccagcacggcacaatcgttatcagagtgcagtatgagggtgatgggtccccatgcaaaattcccttcgaaatcatggacttggagaagaggtacgtcctcggccggctgattactgtgaacccgatagtcaccgaaaaagatagccctgtgaacatcgaggccgaacccccatttggagactcgtacattatcatcggcgttgagcctgggcagttaaagctgaattggttcaagaaaggatcttccattggtcaaatgtttgagacgaccatgcgaggcgctaagcgcatggccatactaggggatacagcatgggacttcggatcactcggcggtgtgtttacaagtatcgggaaagccctgcatcaggtattcggcgctatttatggagcggcatttagcggcgtctcctggaccatgaagatccttattggggtgatcataacatggatcggaatgaactctagaagcacttcattgagtgtttccctggtgctcgtcggcattgtgaccctgtaccttggtgtaatggtgcaggccgatagcgggtgtgttgtctcttggaaaaataaggaactgaagtgcggatcaggcatcttcattacggacaacgtgcacacatggaccgagcagtataaatttcaacccgaaagtccaagcaagttggcttccgccatccagaaagcacaggaggaaggtatatgtggcattaggtctgtgactcggctcgagaatctgatgtggaagcagatcacacccgagttaaaccacattctggccgaaaatgaggtcaaactaaccatcatgactggggatataaagggaatcatgcaagctggcaaacgctcgctcagacctcagccaaccgaactgaagtacagctggaagacatgggggaaagccaagatgctttccacggagtcacataaccagaccttcttgattgacggaccggaaactgcagagtgccccaatacaaacagggcgtggaatagtctggaggttgaagattatggctttggtgtgttcaccacaaacatctggctcaaactgaaggagaaacaggacgctttttgtgactctaagttaatgagcgccgcaattaaggataatcgtgccgtgcacgctgacatggggtactggatcgaatccgccctgaacgatacttggaaaatagagaaggcatcattcattgaggtcaagaattgccattggcctaagagccacaccctttggtctaacggagtcttggaatccgagatgatcatccccaaaaacctcgctggccccgtgagtcaacacaattatcggcctggttaccatacgcagattgccggcccatggcacctggggaagctagaaatggacttcgatttttgtgacggaacaaccgttatcgtgactgaggattgcggcaaccgagggcccagcctgagaaccacaactgcgtctggaaagctcattaccgaatggtgctgtaggtcctgcacactgccgcctcttcgctaccggggcgaggacggttgttggtatgggatggagataagaccattgaaagaaaaggaggaaaatctggtcaactcattagtgacggccggacatggccaggttgataatttcagtctcggtgtgctgggcatggctctttttctggaggaaatgttgaggacccgcgtagggactaaacacgcaatcctcctggtcgccgtgagcttcgtgacactaattaccggaaacatgtcgtttaaggacctgggccgagtcgttgtgatggtaggggctactatgacagatgacatcggaatgggcgtgacctacctcgccctgcttgcagcgttcaaagtccggcccacgtttgccgctggtttgctgttacgtaagctcacttccaaggagctgatgatgaccacaattgggatcgtgcttctgtctcaaagcaccatacctgagactatcctagaactcacagatgccctggcattgggaatgatggttctgaaaattgtgagagacatggagaagtatcagttagctgtcaccatcatggccattctctgcgtgcccaatgcagttatcctgcagaacgcctggaaagtgtcatgtacaatacttgctgtcgtaagtgtgtccccactgttgctcacttctagccagcaaaagaccgactggattcctctggcgctaacgatcaaaggcctgaatcccacagccatcttccttaccactctctccaggaccaacaagaaacgctcatggccactgaatgaagcaattatggctgttggcatggtgagcatattggccagttctctgttaaagaacgatatcccgatgacagggcctctcgtcgccggaggtctgcttactgtgtgctacgtactgaccggccggtccgctgacttggagctcgaaagagcaacggatgtgaagtgggaggaccaggccgagattagcgggtcgtcacccatcctgtctattacaatcagtgaagatggatccatgagcatcaaaaatgaggaagaggagcagaccctaactatcctgattaggacaggccttctcgtcatctctggtctgtttccagttagcattcccatcaccgcggctgcctggtatttgtgggaagtgaagaaacagcgagcaggggtgttatgggacgtcccttccccaccccctatgggaaaggccgagctggaagatggcgcttaccgcataaaacaaaagggcattctcgggtattcacagatcggagccggtgtgtacaaggagggcactttccatacaatgtggcacgttaccagaggggcagtactgatgcacaaaggaaagagaatcgaaccgagttgggcggacgtgaaaaaggatcttattagctacggcggtgggtggaaactggagggagagtggaaggaaggcgaggaagtccaggtgttggctctagagccaggcaagaaccccagggccgttcagacgaaacctgggctgtttaagactaataccggaacaatcggtgcagtgtctctcgacttctccccaggcacctcagggagtcccataattgataaaaagggaaaagtcgtgggcctgtatggtaacggggtagtcacacgtagcggagcctacgtgtccgctatcgcccaaactgaaaagtctattgaggacaaccctgagatcgaagatgacatatttcgcaagcggagacttaccattatggacttacatccgggcgcaggcaaaacgaagaggtatctgcccgctatcgttcgagaggccatcaaacgggggctccgcacattgattctggcgccaactagagtggtcgccgcagaaatggaggaagctctcaggggactgcctatccggtaccagacccccgccattcgagctgagcacacaggtagagagatagtggatcttatgtgtcatgcaaccttcactatgcgcctgttgtcgccagttagggtgcctaattataacctaatcattatggacgaagcccacttcaccgatcccgccagcatcgctgcgcgtggctacatctcaacacgggtcgagatgggggaagcagccggaatttttatgacggctactccaccgggctccagagaccctttcccccagagtaatgccccaataatcgatgaggagagggaaattcccgagcgctcttggaacagcggtcatgaatgggtgaccgactttaaggggaaaacagtatggttcgtgccttccatcaaggcaggaaatgatattgccgcttgcctgcgaaagaacggcaaaaaggttatccaactctcaagaaaaacctttgactctgagtatgtcaagactcggacaaatgattgggacttcgtggtgaccacggatataagcgaaatgggcgcgaactttaaagccgagagggtcatcgacccacgccgttgtatgaagcccgtaattttaactgacggggaggaaagagtgatcctggcaggacctatgccggttacacacagttccgctgcccagcggaggggtcgcattggccgaaatcccaaaaacgagaatgatcagtacatctacatgggggaaccccttgagaacgacgaagattgcgcacactggaaggaggccaagatgctgctcgacaatataaacacccctgagggaattatccccagcatgttcgaaccagagagagaaaaagtggatgctattgacggcgagtatcggttgaggggtgaagcccgcaagacctttgtcgatctgatgagaagaggggacctccctgtgtggctggcgtacaaagttgcagccgagggcatcaattatgctgatcggcgttggtgtttcgacggaataaagaacaaccagatccttgaggaaaatgtggaggtcgaaatttggactaaagagggcgagcgcaagaagctaaaaccccgatggctggatgccagaatctactctgacccattggctttaaaggaatttaaagagttcgcagccgggaggaagtcactgacactcaacctgattaccgaaatgggacggcttcctacattcatgactcagaaaacgcgcgatgctctggacaatctcgccgtgttgcataccgcagaggcgggtggcagagcctataaccacgctctgtccgaactaccggagacactggagactctccttctgttaaccttgctggccacagtaaccgggggaatctttctcttcctgatgagtggcaggggtatagggaagatgactcttggcatgtgctgcattatcacggcaagcatcctgctctggtacgctcagattcagccccattggatcgccgcatcgataattttggaatttttcctgatcgtgttactaattccagagcctgaaaagcagcggaccccacaagacaatcagctgacatatgttgtcatcgccatactcactgtggtggctgcgaccatggccaacgagatgggatttcttgagaaaactaagaaagatctgggcttggggtctatcgcaacccagcagccagaatccaatattctggacatcgatctccgacctgctagcgcctggactctgtacgccgtcgcaacaacgttcgttacccccatgcttagacactcaattgagaacagttctgtgaatgtatccctcactgctatcgccaaccaagcgacagtgctgatgggattgggtaagggctggccgctgagcaaaatggacattggggtcccattactagctatcggatgttactcacaggtgaatcctataaccctgaccgccgcactccttagtctggttgcccactatgctattatcggccccggtttgcaggcaaaggccacacgcgaagcgcagaagagggctgccgcagggatcatgaaaaacccaactgtggatggcattacggtcatagacctggatcccatcccttacgacccgaagtttgagaaacaactcggacaggtaatgctgcttattttatgcgtgacccaggttctgatgatgcggacaacttgggccctctgtgaggctttgaccctggccacaggccccatcagcaccctatgggaggggaatccaggacgtttctggaacactacgattgcagtgtccatggctaatatctttagaggctcttatctggccggtgcggggctccttttcagcataatgaagaacacaaccaatactaggcgcggaaccggcaacatcggtgaaacactgggcgagaaatggaagtcccggttgaacgccctggggaaatcagagtttcaaacttacaagaagtctggcattcaggaagtcgatcgaaccctcgcaaaagagggcatcaagagaggggaaacagaccatcacgctgtgagtaggggatcggccaaactgcgctggttcgtcgagcggaatatggtgacgcctgagggcaaggttgtggatttaggttgcgggagaggaggctggagctattactgtggtggccttaaaaacgtacgtgaagtgaaggggctgaccaagggaggccccgggcatgaggaacctattccaatgtccacttatggatggaatctcgtcaggctacagtctggcgttgacgtgtttttcataccacctgagaaatgcgatacactgttgtgtgacataggtgaatcaagcccaaaccccaccgtcgaggcagggcggactctgcgcgtgctcaatcttgtagagaactggctgaataacaatacacagttctgcattaaggtgttgaacccgtacatgccttccgttatcgagaaaatggaggctctgcaacgaaagtacggaggcgccctcgtgagaaatccattaagtaggaactctacccacgaaatgtattgggtcagcaatgcctcaggcaacatcgtgtccagtgtcaatatgattagccggatgctgataaaccgctttacgatgagacataaaaaggcgacctacgagcccgacgtggatcttgggtctggaacaaggaacatcggtattgaatccgagatccctaatctggacattatcggcaagcgaatagagaaaatcaagcaggaacacgagacttcatggcactatgatcaggaccatccatacaaaacctgggcttatcacgggagctacgaaacaaagcagactggatcggcatctagtatggttaacggcgtagtgcggctactcaccaaaccctgggatgtcctgccgacagtgacccaaatggccatgactgacacgacacctttcggtcagcagcgtgtttttaaggagaaggtggataccagaactcaggaacccaaagaggggaccaagaaattgatgaagattacagctgagtggctgtggaaagaactcggaaagaaaaagacgccacgcatgtgtaccagggaggagttcactcggaaggtcagatccaatgccgcacttggcgccatctttacagacgagaacaaatggaaaagcgctcgcgaggcggtggaagattcaaggttctgggagctggtagacaaagaacgaaatttacatctggagggcaagtgcgaaacctgtgtgtataacatgatggggaaacgggagaagaagttgggagagtttggtaaagccaagggctccagagcaatttggtacatgtggctcggggctaggttcctggaatttgaggccctaggattccttaatgaagatcactggttttctcgcgagaacagcctgagtggcgttgaaggtgaggggctccacaaactgggatacatcttgcgtgacgtctccaagaaagagggcggcgcaatgtatgccgacgatactgctgggtgggacacacggattaccctggaagatctcaagaatgaggaaatggtgacaaaccatatggagggagaacacaagaaacttgccgaggcgatattcaagctgacttaccaaaataaagtggtcagagttcagaggcctacaccccgcggtacggtgatggacatcattagccgacgggatcagagaggctctgggcaagtaggaacctatggcttaaacacatttactaatatggaggcacagctgatcaggcagatggaaggtgagggggtgttcaagaacatccagcatttgaccgccacagaagaggtcgctgtgcaaaattggctcgcccgcgttggaagagagcggctgtcaaggatggcaattagtggcgacgattgcgtggtcaaaccactagacgatcgtttcgctaacgcccttactgctctgaacgacatgggcaagatacgaaaggatatccagcagtgggaaccctccaaagggtggaatgactggacccaggtgcctttttgcagccaccatttccacgagctcattatgaaggatggacgcgtactggttgtgccatgtagaaaccaagacgaattgatcggtcgggccaggatttctcagggcgcagggtggtcgttacgcgagacggcgtgcctgggaaaatcatacgcccagatgtggagcctcatgtattttcacagacgggaccttaggctggctgccaatgcaatctgttccgctgtcccgagtcattgggtgcccacatctcgaaccacttggagcatacacgccaagcatgaatggatgacaaccgaggatatgctaactgtgtggaaccgtgtctggatcagagagaatccttggatggaagacaaaaccccagttgagtcctgggaagagattccctacctgggcaagcgcgaagatcagtggtgcggttcactcatcgggttgacaagtcgggcaacgtgggccaagaacattcaagcggctatcaatcaggtgaggtctctgataggaaacgaggagtataccgactacatgcctagcatgaaaagattccgccgggaagaggaagaggccggcgtactttggtga

SEQ ID NO: 14436 - RNA, 9876 nt, synthetic construct
  misc_feature 1..9876: note = derived and/or modified CDS sequence (opt3) from DENV-2__FJ639706__SS-prME
  source 1..9876: mol_type = other RNA
agcgccggaatgatcattatgctgatacccaccgtgatggctttccacctcaccactagaaacggggagcctcatatgatcgtcggtattcaagaaaagggaaaatcccttctgtttaagacggaggacggagttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggctctcattttcatcctgctgactgcagtggccccatctatgacaatgcgctgcatagggatttcgaacagagattttgttgaaggagtgtcaggtggcagctgggtcgacatcgtgctcgagcacgggagttgtgttaccactatggctaagaataagcccacattagatttcgaactgattaaaaccgaggccaagcagcctgcgacgcttaggaaatattgcatcgaagcaaagttgaccaacacaactaccgagtcccggtgtccaacacaaggagagccctctctgaaagaagaacaggacaagcgctttgtttgcaagcatagcatggtggatcgaggctggggtaatgggtgtggactattcggcaaaggcgggatcgtcacttgcgccatgtttacctgcaagaaaaacatggaaggaaagattgtgcagcctgagaatctcgaatacacaatagtggtcaccccacactccggtgaggagcatgctgttggcaacgacactgggaaacacggaaaggaaatcaaagtgacgccgcagtcaagtattacagaggccgaactgaccggctatggtactgtaaccatggagtgtagccccagaacagggcttgatttcaatgaaatggtgctgttgcaaatggagaacaaggcatggctcgtccacaggcagtggtttctggacttacctctgccatggctccccggcgctgataagcagggatctaattggatccagaaagagacccttgtgactttcaagaaccctcatgccaaaaagcaagacgttgtggtcctgggctcccaggaaggggcgatgcacacagccttgacgggagcaaccgagatacagatgtcaagcggtaatctactgtttactggccatctcaaatgccggctgcgtatggacaaacttcaactgaaggggatgagttactctatgtgtacaggaaaattcaaggtggtaaaagaaattgctgagacccagcacggcacaatcgttatccgcgtgcagtatgagggtgatgggtccccatgcaagattcccttcgaaatcatggacttggagaaaagatacgtcctcggcaggctgattactgtgaacccgatagtcaccgaaaaggatagccctgtgaacatcgaggccgaacccccatttggagactcgtacattatcatcggcgttgagcctgggcagttaaagctgaattggttcaaaaagggatcttccattggtcaaatgtttgagacgaccatgcggggcgctaaacgaatggccatactaggggatacagcatgggacttcggatcactcggcggtgtgtttacaagtatcgggaaggccctgcatcaggtattcggcgctatttatggagcggcatttagcggcgtctcctggaccatgaaaatccttattggggtgatcataacatggatcggaatgaactctcgcagcacttcattgagtgtttccctggtgctcgtcggcattgtgaccctgtaccttggtgtaatggtgcaggccgatagcgggtgtgttgtctcttggaagaataaggaactgaaatgcggatcaggcatcttcattacggacaacgtgcacacatggaccgagcagtataagtttcaacccgaaagtccaagcaaattggcttccgccatccagaaggcacaggaggaaggtatatgtggcattagatctgtgactaggctcgagaatctgatgtggaaacagatcacacccgagttaaaccacattctggccgaaaatgaggtcaagctaaccatcatgactggggatataaaaggaatcatgcaagctggcaagcggtcgctccgccctcagccaaccgaactgaagtacagctggaaaacatgggggaaggccaaaatgctttccacggagtcacataaccagaccttcttgattgacggaccggaaactgcagagtgccccaatacaaacagagcgtggaatagtctggaggttgaagattatggctttggtgtgttcaccacaaacatctggctcaagctgaaagagaagcaggacgctttttgtgactctaagttaatgagcgccgcaattaaagataatagggccgtgcacgctgacatggggtactggatcgaatccgccctgaacgatacttggaagatagagaaagcatcattcattgaggtaaagaattgccattggcctaaaagccacaccctttggtctaacggagtcttggaatccgagatgatcatcccaaagaacctcgctggccccgtgagtcaacacaattatcgtcctggttaccatacgcagattgccggcccatggcacctggggaagctagaaatggacttcgatttttgtgacggaacaaccgttatcgtgactgaggattgcggcaaccgggggcccagcctgcgaaccacaactgcgtctggaaaactcattaccgaatggtgctgtagatcctgcacactgccgcctcttaggtaccgcggcgaggacggttgttggtatgggatggagatacggccattgaaggaaaaagaggaaaatctggtcaactcattagtgacggccggacatggccaggttgataatttcagtctcggtgtgctgggcatggctctttttctggaggaaatgttgagaaccagggtagggactaagcacgcaatcctcctggtcgccgtgagcttcgtgacactaattaccggaaacatgtcgtttaaagacctgggccgcgtcgttgtgatggtaggggctactatgacagatgacatcggaatgggcgtgacctacctcgccctgcttgcagcgttcaaggtccgacccacgtttgccgctggtttgctgttacggaagctcacttccaaagagctgatgatgaccacaattgggatcgcccttctgtctcaaagcaccatacctgagactatcctagaactcacagatgcactggctttgggaatgatggtgctgaagattgttcgtgacatggagaaatatcagttagccgtgaccatcatggcaattctctgcgtccccaatgccgtgatcctgcagaacgcttggaaggtttcatgtacaatacttgcggtggtcagtgtatccccactgttgctcacttctagccagcagaagaccgactggattcctctggccctaacgatcaagggcctgaatcccacagcaatcttccttaccactctctccagaaccaacaaaaagaggtcatggccactgaatgaagctattatggccgtgggcatggttagcatattggccagttctctgttaaagaacgatatcccgatgacagggcctctcgtggctggaggtctgcttactgtctgctacgtgctgaccggccgctccgcagacttggagctcgaacgggccacggatgtaaaatgggaggaccaggcggagattagcgggtcgtcacccatcctgtctattacaatcagtgaagatggatccatgagcataaagaatgaggaagaggagcagaccctaactatcctgattagaacaggccttctcgtgatctctggtctgtttccagtcagcattcccatcaccgctgccgcatggtatttgtgggaagttaaaaagcagagggccggggtgttatgggacgtgccttccccaccccctatgggaaaagctgagctggaagatggcgcataccgaataaagcaaaagggcattctcgggtattcacagatcggagccggtgtctacaaagagggcactttccatacaatgtggcacgtgacccgcggggcggttctgatgcacaagggaaaacggatcgaaccgagttgggctgacgtaaagaaagatcttattagctacggcggtgggtggaagctggagggagagtggaaggaaggcgaggaagtgcaggtcttggccctagagccaggcaaaaaccccagagcagtgcagacgaagcctgggctgtttaaaactaataccggaacaatcggtgccgtttctctcgacttctccccaggcacctcagggagtcccataattgataagaaaggaaaggtggtcggcctgtatggtaacggggtggtaacaaggagcggagcttacgtctccgccatcgcacaaactgaaaagtctattgaggacaaccctgagatcgaagatgacatatttcgtaaacgccggcttaccattatggacttacatccgggcgctggcaagacgaaaagatatctgcccgccatcgtgagggaggcgatcaagcgagggctccggacattgattctggccccaactcgcgttgtggcagctgaaatggaggaagccctcagaggactgcctatcaggtaccagacccccgctattcgggcagagcacacaggtcgagagatagtcgatcttatgtgtcatgccaccttcactatgagactgttgtcgccagtgcgcgttcctaattataacctaatcattatggacgaagcccacttcaccgatcccgctagcatcgcggcaaggggctacatctcaacacgtgtggagatgggggaagccgctggaatttttatgacggccactccaccgggctcccgggaccctttcccccagagtaatgcaccaataatcgatgaggagagagaaattcccgagaggtcttggaacagcggtcatgaatgggtcaccgactttaaagggaagacagtgtggttcgtaccttccatcaaggccggaaatgatattgctgcgtgcctgcgcaaaaacggcaagaaagtgatccaactctcacgaaagacctttgactctgagtatgttaaaactagaacaaatgattgggacttcgtcgtgaccacggatataagcgaaatgggcgccaactttaaggcagagcgggtgatcgacccaaggcgctgtatgaaacccgtcattttaactgacggggaggaacgtgtaatcctggctggacctatgccggtgacacacagttccgccgcacagagacggggtaggattggccgcaatccaaagaacgagaatgatcagtacatctacatgggggaaccccttgagaacgacgaagattgcgcccactggaaggaggctaaaatgctgctcgacaatataaacacccctgagggaattatccccagcatgttcgaaccagagcgagaaaaggttgatgccattgacggcgagtatagattgcggggtgaagcgaggaaaacctttgtggatctgatgcgcagaggggacctccctgtctggctggcatacaaggtggccgctgagggcatcaattatgccgataggcggtggtgtttcgacggaatcaaaaacaaccagatccttgaggaaaatgttgaggtggaaatttggactaaggagggcgagcgtaagaaactaaagccccgctggctggatgctcgaatctactctgacccattggcattaaaagaatttaaggagttcgccgctgggagaaaatcactgacactcaacctgattaccgaaatgggaaggcttcctacattcatgactcaaaagacgcgggatgccctggacaatctcgcagtcttgcataccgcggaggccggtggccgcgcttataaccacgccctgtccgaactaccggagacactggagactctccttctgttaaccttgctggcaacagtgaccgggggaatctttctcttcctgatgagtggcagaggtatagggaagatgactcttggcatgtgctgcattatcacggctagcatcctgctctggtacgcccagattcagccccattggatcgcagcctcgataattttggaatttttcctgatcgtattactaattccagagcctgaaaaacagaggacaccccaagacaatcagctgacatatgtggttatcgctatactcactgtcgtggcggccaccatggcaaacgagatgggatttcttgaaaagactaaaaaggatctgggcttggggtctatcgctacccagcagccagagtccaatattctggacatcgatctccggcctgccagcgcctggactctgtacgcagtggctacaacgttcgtcacccccatgcttcgacactcaattgagaacagttctgttaatgtgtccctcactgccatcgcgaaccaagctacagtactgatgggattgggtaaaggctggccgctgagcaagatggacattggggtgccattactagccatcggatgttactcacaggtcaatcctataaccctgaccgcagccctccttctgttggtggctcactatgcaattatcggccccggtctgcaggccaaggcgacaagagaagctcagaaacgcgccgcagccgggatcatgaagaacccaactgttgatggcattacggtgatagacctcgatcccatcccttacgacccgaaatttgagaagcaactgggacaggtcatgcttttaattctgtgcgtaacccaggtgctcatgatgaggacaacttgggctttgtgtgaagccctgaccctagcaacaggccccatcagtaccctgtgggaggggaatccaggacggttctggaacactacgattgctgttagcatggccaatatctttcgtggctcctatctcgcgggtgccgggcttctgttctctataatgaaaaacacaaccaatactagaaggggaaccggcaacatcggtgaaacattgggcgagaagtggaaaagccgcctgaacgcactcgggaagtccgagtttcaaacttacaagaaatcaggcattcaggaagtggatcggaccctggctaaggagggcatcaaacgaggggaaacagaccatcacgccgtctctagaggaagtgcaaagttaaggtggttcgtggagcgcaatatggtcacgcctgagggcaaagtggttgatcttggttgcgggcggggaggctggtcgtattactgtggtggcctgaagaacgtgagagaagtaaaggggctcaccaaaggaggccccgggcatgaggaacctattccaatgagcacttatggatggaatctagtgcgtctgcagtccggcgtcgacgtatttttcataccccctgagaagtgcgatacattgctgtgtgacataggtgaatcttcaccaaaccccaccgtggaggctgggaggactctccgggtccttaatctggtggagaactggttgaataacaatacacagttctgcattaaagtactgaacccgtacatgcctagcgtgatcgaaaagatggaggccctccaacgcaaatacggaggcgccttagttcgaaatccactgtccagaaacagtacccacgaaatgtattgggtgtctaatgcgagcggcaacatcgtctcatccgtgaatatgattagtaggatgcttataaaccggtttacgatgcgccataagaaggctacctacgagcccgacgtcgatctggggagcggaacaagaaacatcggtattgaatctgagatccctaatctagacattatcggcaaaaggatagagaagatcaaacaggaacacgagacttcctggcactatgatcaggaccatccatacaagacctgggcatatcacgggtcatacgaaacaaaacagactggaagcgcctcgtctatggtgaacggcgttgtacgactcctgaccaagccctgggatgtgttgccgacagtcacccaaatggctatgactgacacgacacctttcggtcagcagcgggtgtttaaggagaaagttgatacccgtactcaggaacccaaggaggggaccaaaaagctgatgaaaattacagccgagtggctctggaaggaacttggcaaaaagaagacgccaagaatgtgtacccgcgaggagttcactaggaaagtgcggagtaatgcagccctgggcgctatctttacagacgagaacaagtggaaatccgcgagagaggccgtcgaagatagccgcttctgggagttagtggacaaggaaaggaatctgcatttggagggcaaatgcgaaacctgtgtatataacatgatggggaagcgagagaagaaactcggagagtttggtaaggcaaaaggctcacgggctatttggtacatgtggctgggggccagattcctagaatttgaggcacttggattcctgaatgaagatcactggttttccagggagaactctctcagcggcgtggaaggtgaggggctgcacaagttgggatacatcctgcgcgacgttagtaaaaaggagggcggcgccatgtatgctgacgatactgccgggtgggacacacgtattaccctcgaagatcttaagaatgaggaaatggtcacaaaccatatggagggagaacacaaaaagctggcggaggcaatattcaaattaacttaccaaaataaggtggtgcgggtccagagacctacccccaggggtacggttatggacatcatttcccgcaaagatcagcgaggcagcgggcaagtgggaacctatggcctgaacacatttactaatatggaggcccagttgatccggcagatggaaggtgagggggtattcaagaacatccagcatctcaccgctacagaagaggtggccgtccaaaattggctggcaagagtgggaagggagcgcctatctagaatggctatttcaggcgacgattgcgttgtgaagccacttgacgatcggttcgccaacgctctgactgccctcaacgacatgggcaaaataaggaaggatatccagcagtgggaacccagtaaagggtggaatgactggacccaggtccctttttgctcccaccatttccacgagctgattatgaaggatggacgtgtgttggtagttccatgtcgaaaccaagacgaattaatcggtcgcgcaagaattagccagggcgcggggtggtctctgcgggagacggcctgcctcggaaaatcgtacgctcagatgtggtcacttatgtattttcacaggcgcgacctgagactagccgcaaatgctatctgtagcgccgtgccgtcccattgggtccccacaagtcggaccacttggtctatacacgcaaagcatgaatggatgacaaccgaggatatgctgactgtgtggaacagggtgtggatccgagagaatccttggatggaagacaagaccccagtcgagagctgggaagagattccctacctcggcaaacgtgaagatcagtggtgcggttccttgatcgggctgacatcaagagccacgtgggcgaagaacattcaagctgccatcaatcaggttcgcagtcttataggaaacgaggagtataccgactacatgccttctatgaaacggttcaggagagaagaggaagaggcaggcgtgctgtggtga

SEQ ID NO: 14437 - RNA, 9876 nt, synthetic construct
  misc_feature 1..9876: note = derived and/or modified CDS sequence (opt3) from DENV-2__FJ639707__SS-prME
  source 1..9876: mol_type = other RNA
agcgcaggcatgatcattatgctgatacccaccgtgatggctttccacctcaccactagaaacggggagcctcatatgatcgtcggtattcaagaaaagggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagcactggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacattctcgggaggctgataactgtgaacccgatcgtcaccgagaaggatagccctgtgaacattgaagctgagcccccatttggcgactcgtacatcatcattggagttgagcctggccagttaaagctgaattggttcaaaaaggggtcttccataggacaaatgtttgaaacgaccatgcggggtgccaaacgaatggctatcctaggcgatacagcctgggacttcgggtcactcggaggcgtgtttacaagtattggtaaggcactgcatcaggtattcggggccatctatggcgctgcgtttagcggagtctcctggaccatgaaaattcttatcggcgtgataatcacatggattgggatgaactctcgcagcacttcattgagtgtttccctggtgctcgtcggaatcgtgaccctgtaccttggcgtaatggtgcaggcagatagcggttgtgttgtctcttggaagaataaggagctgaaatgcgggtcaggaattttcatcacggacaacgtgcacacatggaccgaacagtataagtttcaacccgagagtccaagcaaattggcctccgctatacagaaggcccaggaagagggcatttgtggtatcagatctgtgactaggctcgagaatctgatgtggaaacagattacacccgaattaaaccacatcctggcagagaatgaagtcaagctaaccataatgactggcgatatcaaagggattatgcaagccggaaagcggtcgctccgccctcagccaaccgagctgaagtacagctggaaaacatggggcaaggctaaaatgctttccacggaatcatataaccagaccttcttgatcgacgggccggagactacagagtgccccaataccaacagagcctggaatagtctggaagttgaggattacggatttggcgtgttcacaactaacatttggctcaagctgaaagaaaagcaggacgcattttgtgactctaagttaatgagcgcggctatcaaagataatagggccgtgcatgcagacatgggttattggatagagtccgccctgaacgatacctggaagattgagaaggcttcattcatcgaagtaaagaattgccactggcctaaaagccatacgctttggtctaacggggtcttggagtccgaaatgatcattccaaagaacctcgccggacccgtgagtcaacacaattaccgtcctggctaccacacacagatcgcaggtccatggcatctgggcaagctagagatggacttcgatttttgtgacgggaccactgttattgtgaccgaagattgcggaaaccggggccccagcctgcgaacaactaccgcttctgggaaactcataacagagtggtgctgtagatcctgcacgctgccgcctcttaggtatcgcggagaggacggctgttggtacggtatggaaatccggccattgaaggagaaagaagagaatctggtcaactcattagtgaccgccgggcacggacaggttgataatttcagtctcggcgtgctgggtatggcgctttttctggaagagatgttgagaactagggtaggcacaaagcatgccattctcctggtcgctgtgagcttcatgaccctaatcactgggaacatgtcgtttaaagacctgggacgcgtggtcgttatggtgggcgcaacaatggccgatgacattgggatgggagtaacctatctcgctctgcttgccgcattcaaggtgcgacccacgtttgcggccggcttgctgttacggaagctcacttccaaagagctgatgatgaccacaatcggtatagtccttctgtctcaaagcaccatccctgaaactgtgctagagctcacagatgctctggccttggggatgatggttctgaagattgtgcgtaatatggaaaaataccagttagcagtcaccatcatggctattctctgcgtgcccaacgccgttatcctgcagaatgcatggaaggtgtcatgtacaatacttgccgtcgtaagtgtgtccccactgttgctcacttctagccagcagaaaaccgactggattcctctggctctaacgatcaagggactgaaccccacagcgatcttccttaccactctctccagaaccaataaaaagaggtcatggccactgaacgaggccattatggcagttggcatggtgagcatattggctagttctctgttaaagaatgacatcccgatgacaggccctctcgccgccgggggactgcttactgtctgctatgtgctgaccggtcgctccgctgatttggaactcgagcgggcaacggacgtaaaatgggaggatcaggccgaaattagcggctcgtcacccatcctgtctattacaatcagtgaggacgggtccatgagcataaagaacgaagaggaggaacagaccctaactatcctgattagaacaggacttctcgtgatctctggcctgtttccaattagcatccccataaccgcggctgcctggtacttgtgggaggtcaaaaagcagagggccggtgttttatgggatgtgccttccccaccccctatggggaaagccgaactggaggacggagcttatcgaattaagcaaaagggcatcctcggctactcacagatcggggcaggagtgtacaaagaaggtactttccacacaatgtggcatgtcacccgcggcgccgtgctgatgcacaaggggaaacggattgagccgagttgggcggatgttaagaaagaccttatcagctatggaggcggttggaagctggagggggaatggaaggagggagaagaggtacaggtgttggctctagaaccaggcaaaaatcccagagccgtccagacgaagcctggcctgtttaaaactaacaccgggacaataggagcagtgtctctcgatttctccccaggtacctcaggcagtcccattatcgacaagaaagggaaggttgtgggactgtacggcaacggtgtcgtgacaaggagcggggcctatgtatccgctattgcccaaactgagaagtctatcgaggataatcctgaaatagaggacgatatttttcgtaaacgccggcttaccatcatggacttacacccgggagcaggcaagacgaaaagatacctgcccgctatcgtcagggaagccattaagcgaggcctccggacattgatcctggcgccaactcgcgtggttgccgcagagatggaagaggctctcagagggctgcctattaggtatcagacccccgccatacgggctgagcatacaggacgagaaatcgtggaccttatgtgtcacgcaaccttcactatgagactgttgtcgccagtccgcgtgcctaactacaatctaattatcatggatgaggcccatttcaccgaccccgccagcatcgctgcgaggggttatatttcaacacgtgttgaaatgggcgaggcagccgggatatttatgacggctactccaccgggatcccgggatcctttcccccagagtaacgccccaatcattgacgaggaaagagagatccccgaaaggtcttggaatagcggccacgagtgggtgaccgattttaaaggtaagacagtctggttcgtgccttccattaaggcagggaacgacatcgccgcttgcctgcgcaaaaatggaaagaaagtaatacaactctcacgaaagacctttgattctgaatacgcgaaaactagaacaaacgactgggatttcgtggttaccacggacatcagcgagatgggcgccaattttaaggcagagcgggtcattgatccaaggcgctgtatgaaacccgtgatcttaactgacggcgaagaacgtgtgattctggctgggcctatgccggtcacacatagttccgccgcacagagacggggaaggatcggtcgcaacccaaagaatgaaaacgaccagtacatatatatgggcgagccccttgaaaatgatgaggactgcgcccactggaaggaggctaaaatgctgctcgataacattaatacccctgaagggatcattcccagcatgttcgagccagaacgagagaaggtagacgccatcgatggagaatacagattgcggggcgaggcgaggaaaacctttgtggacctgatgcgcagaggtgatctccctgtttggctggcatataaggtggccgctgaggggataaactacgccgacaggcggtggtgtttcgatggcatcaaaaacaatcagattcttgaagagaacgtcgaagtggagatctggactaaggagggagaacgtaagaaactaaagccccgctggctggactctcgaatttattcagatccattggctttaaaagagtttaaggagttcgcagccggcagaaaatccctgacactcaatctgatcaccgagatggggaggcttcctacattcatgactcaaaagacgcgggacgctctggataacctcgccgttttgcacaccgcagaagcgggaggtcgcgcctacaatcatgctctgagtgagctaccggagacactggaaactctccttctgttaaccttgctggccacagtgaccggcgggatatttctcttcctgatgagcggaagaggcattggtaagatgactcttgggatgtgctgcatcatcacggcatcgattctgctctggtatgctcagatccagccccactggatagccgcatctattatcttggagtttttcctgattgtcttactaatcccagaacctgagaaacagaggacaccccaagacaaccagctgacatacgtggtaatagccatcctcactgtggttgctgcgaccatggccaatgaaatgggctttcttgagaagactaagaaagacctgggattgggctccattgcaacccagcagccagagagcaacatcctggatattgacctccggcctgcttcagcctggactctgtacgccgtcgcaacaacgttcgtgacccccatgcttcgacatagtatcgaaaattcttccgtgaacgtcagcctcactgctattgccaatcaagcgacagttctggtggggttgggaaaaggttggccgctgtcaaaaatggatatcggcgtaccattactagctatagggtgttatagtcaggtgaaccctattaccctgaccgccgcactccttctgttggtcgcccactacgctatcatcggacccggcctgcaggcaaaggccacaagagaggcgcagaaacgcgctgccgcaggtattatgaagaatccaactgtggacgggataacggttatcgatctcgaccccattccttatgatccgaaatttgaaaagcaactgggccaggtgatgcttttaatcctgtgcgtcacccaggtactcatgatgaggacaacttgggccttgtgtgaggctctgaccctagccacaggacccattagcaccctgtgggaaggcaacccagggcggttctggaatactacgatcgcagtgtccatggctaacatatttcgtggatcttacctcgccggcgcgggtcttctgttcagcatcatgaaaaatacaaccaacactagaagggggaccggaaacattggcgagacattgggtgagaagtggaaatcccgcctgaatgccctcggcaagtcagaatttcaaatctataagaaatctgggattcaggaggttgaccggactctggcaaaggaaggaatcaaacgaggcgagaccgatcaccatgctgtgagtagagggtcggccaagttaaggtggttcgtcgagcgcaacatggtgacacctgaaggaaaagtcgtggaccttggctgcggtagagggggatggagctactattgtggcggtctgaagaatgttagagaggtgaagggcctcacgaaagggggacccggccacgaggaacctataccaatgtccacctacgggtggaacctagtacgtctgcagtctggagtggatgtctttttcattccccctgaaaagtgcgacactttgctgtgtgatatcggcgagtcaagcccaaatcccacagttgaggcaggtaggaccctccgggtgcttaacctggtcgaaaattggttgaacaataacactcagttctgcatcaaagtgctgaatccgtacatgccttccgtaattgagaagatggaagctctccaacgcaaatatgggggagccttagtgcgaaacccactgagtagaaattctacacatgagatgtactgggttagcaacgcctcaggcaatatagtgtccagtgtcaacatgatcagcaggatgcttattaaccggtttaccatgcgccacaagaaggcgacgtatgaacccgacgtggacctgggctctgggaccagaaatatcggaattgagtccgaggtccctaacctagatatcataggtaaaaggatcgaaaagattaaacaggagcatgaaacatcatggcactacgaccaggatcacccatataagacttgggcttaccatggcagctatgagaccaaacagacagggtcggcatctagtatggtgaatggagttgtacgactcctgactaagccctgggacgtgttgccgaccgtcacacaaatggccatgaccgatactacgcctttcggccagcagcgggtgtttaaggaaaaagttgacacacgtacccaggagcccaaggagggtactaaaaagctgatgaaaatcaccgctgaatggctctggaaggagcttgggaaaaagaagacaccaagaatgtgtacgcgcgaagagttcaccaggaaagtgcggtccaacgccgcactgggagccatttttactgatgagaataagtggaaaagcgctagagaagcggtcgaggactcacgcttctgggaattagtggataaggagaggaacctgcacttggaaggcaaatgcgagacatgtgtatacaatatgatgggcaagcgagagaagaaactcggggaatttggaaaggccaaaggttcccgggcaatctggtacatgtggctgggcgctagattcctagagtttgaagcccttgggttcctgaacgaggaccattggttttctagggaaaatagcctcagtggagtggagggcgagggtctgcacaagttggggtatattctgcgcgatgtttccaaaaaggaaggaggcgcaatgtacgccgacgacaccgctggctgggatactcgtataacactcgaggaccttaagaacgaagagatggtcaccaatcacatggaaggggagcataaaaagctggccgaggcgatcttcaaattaacatatcaaaacaaggtggtgcgggtccagagacctactcccaggggaaccgttatggatattatcagccgccgagaccagcggggttctggccaagtggggacgtacggactgaatacctttacaaacatggaagcacagttgatcagacagatggagggcgaaggtgtattcaaaaatattcagcacctcactgtgaccgaggaggtcgccgtgcaaaactggctggctagggttgggcgcgaaagactatcacggatggccataagtggagatgactgcgtggtcaagccacttgatgacaggttcgcaaacgctctgacagccctcaatgatatgggcaagatccgtaaagacattcagcagtgggagccctccaagggctggaacgattggactcaggtgcctttttgcagccatcacttccatgaactgatcatgaaagacgggcgagtattggttgtgccatgtcgcaatcaagatgagttaattggacgggctcggatctctcagggtgccggctggtcgctgagggaaaccgcatgcctcgggaagtcatatgcgcagatgtggagccttatgtactttcaccgcagagacctgcggctagccgctaacgccatatgttccgcagtcccgagtcactgggtgcccacgtctaggacaacctggagcatccatgctaaacacgagtggatgactacagaggacatgctgaccgtgtggaatcgagtctggattcgtgaaaacccttggatggaggataagactccagttgaatcctgggaggaaatcccctatctcggaaagagagaggaccagtggtgcggctcattgattggtctgaccagtcgcgccacatgggccaaaaatatccaagccgcgataaaccaggtgcggtctcttattgggaatgaggaatacacggattacatgcctagcatgaagaggttcagacgcgaggaagaggaagctggagtactgtggtga

SEQ ID NO: 14438 - RNA, 9876 nt, synthetic construct
  misc_feature 1..9876: note = derived and/or modified CDS sequence (opt3) from DENV-2__FJ639708__SS-prME
  source 1..9876: mol_type = other RNA
agcgcaggcatgatcattatgctgatacccaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacacgatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagcactggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgttctcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacattctcgggaggctgataactgtgaacccgatcgtcaccgagaaggatagccctgtgaacattgaagctgagcccccatttggcgactcgtacatcatcattggagttgagcctggccagttaaagctgaattggttcaaaaaggggtcttccataggacaaatgtttgaaacgaccatgcggggtgccaaacgaatggctatcctaggcgatacagcctgggacttcgggtcactcggaggcgtgtttacaagtattggtaaggcactgcatcaggtattcggggccatctatggcgctgcgtttagcggagtctcctggaccatgaaaattcttatcggcgtgataatcacatggattgggatgaactctcgcagcacttcattgagtgtttccctggtgctcgtcggaatcgtgaccctgtaccttggcgtaatggtgcaggcagatagcggttgtgttgtctcttggaagaataaggagctgaaatgcgggtcaggaattttcatcacggacaacgtgcacacatggaccgaacagtataagtttcaacccgagagtccaagcaaattggcctccgctatacagaaggcccaggaagagggcatttgtggtatcagatctgtgactaggctcgagaatctgatgtggaaacagattacacccgaattaaaccacatcctggcagagaatgaagtcaagctaaccataatgactggcgatatcaaagggattatgcaagccggaaagcggtcgctccgccctcagccaaccgagctgaagtacagctggaaaacatggggcaaggctaaaatgctttccacggaatcatataaccagaccttcttgatcgacgggccggagactgccgagtgccccaatacaaacagagcatggaatagtctggaagttgaggattacggatttggcgtgttcaccacaaacatttggctcaagctgaaagaaaagcaggacgcgttttgtgactctaagttaatgagcgctgccatcaaagataatagggcagtgcatgccgacatgggttattggatagagtccgctctgaacgatacttggaagattgagaaagcctcattcatcgaagtaaagaattgccactggcctaaaagccataccctttggtctaacggggtcttggagtccgaaatgatcattccaaagaacctcgcaggacccgtgagtcaacacaattaccgtcctggctaccacacgcagatcgctggtccatggcatctgggcaagctagagatggacttcgatttttgtgacgggacaaccgttattgtgactgaagattgcggaaaccggggccccagcctgcgaaccacaactgcctctgggaaactcataaccgagtggtgctgtagatcctgcacactgccgcctcttaggtatcgcggagaggacggctgttggtacggtatggaaatccggccattgaaggagaaagaagagaatctggtcaactcattagtgacggcggggcacggacaggttgataatttcagtctcggcgtgctgggtatggccctttttctggaagagatgttgagaaccagggtaggcactaagcatgctattctcctggtcgcagtgagcttcatgacactaatcaccgggaacatgtcgtttaaagacctgggacgcgtggtcgttatggtgggcgccactatggctgatgacattgggatgggagtaacatatctcgccctgcttgcagcgttcaaggtgcgacccacctttgccgctggcttgctgttacggaagctcacgtccaaagagctgatgatgactaccatcggtatagtccttctgtctcaaagcacaatccctgaaaccgtgctagagctcactgatgccctggcattggggatgatggttctgaagattgtgcgtaatatggaaaaataccagttagctgtcacaatcatggccattctctgcgtgcccaacgcagttatcctgcagaatgcctggaaggtgtcatgtaccatacttgctgtcgtaagtgtgtccccactgttgctcacatctagccagcagaaaactgactggattcctctggcgctaaccatcaagggactgaaccccacggccatcttccttacaaccctctccagaactaataaaaagaggtcatggccactgaacgaggcaattatggctgttggcatggtgagcatattggccagttctctgttaaagaatgacatcccgatgaccggccctctcgtcgccgggggactgcttacagtgtgctatgtactgactggtcgctccgctgatttggaactcgagcgggcaaccgacgtgaaatgggaggatcaggccgaaattagcggctcgtcacccatcctgtctattacgatcagtgaggacgggtccatgagcataaagaacgaagaggaggaacagacactaaccatcctgattagaactggacttctcgtcatctctggcctgtttccaattagcatccccataacagcggctgcctggtacttgtgggaggttaaaaagcagagggccggtgtgttatgggatgtgccttccccaccccctatggggaaagccgaactggaggacggagcttatcgaattaagcaaaagggcatcctcggctactcacagatcggggcaggagtctacaaagaaggtaccttccacactatgtggcatgtgacacgcggcgccgttctgatgcacaaggggaaacggattgagccgagttgggcggatgtaaagaaagaccttatcagctatggaggcggttggaagctggagggggaatggaaggagggagaagaggtgcaggtcttggctctagaaccaggcaaaaatcccagagccgtgcagaccaagcctggcctgtttaaaacgaacactgggaccataggagcagtttctctcgatttctccccaggtacatcaggcagtcccattatcgacaagaaagggaaggtggtcggactgtacggcaacggtgtggtaaccaggagcggggcctatgtctccgctattgcccaaacagagaagtctatcgaggataatcctgaaatagaggacgatatttttcgtaaacgccggcttactatcatggacttacacccgggagcaggcaagaccaaaagatacctgcccgctatcgtgagggaagccattaagcgaggcctccggacgttgatcctggcgccaacacgcgttgtggccgcagagatggaagaggctctcagagggctgcctattaggtatcagactcccgccatacgggctgagcataccggacgagaaatcgtcgaccttatgtgtcacgcaacattcaccatgagactgttgtcgccagtgcgcgttcctaactacaatctaattatcatggatgaggcccatttcactgaccccgccagcatcgctgcgaggggttatatttcaacccgtgtggaaatgggcgaggcagccgggatatttatgacagctacgccaccgggatcccgggatcctttcccccagagtaacgccccaatcattgacgaggaaagagagatccccgaaaggtcttggaatagcggccacgagtgggtcactgattttaaaggtaagaccgtgtggttcgtaccttccattaaggcagggaacgacatcgccgcttgcctgcgcaaaaatggaaagaaagtgatacaactctcacgaaagacatttgattctgaatacgttaaaaccagaactaacgactgggatttcgtcgtgacaaccgacatcagcgagatgggcgcgaattttaaggccgagcgggtgattgatccaaggcgctgtatgaaacccgtcatcttaacggacggcgaagaacgtgtaattctggcagggcctatgccggtgactcatagttccgctgcccagagacggggaaggatcggtcgcaacccaaagaatgaaaacgaccagtacatatatatgggcgagccccttgaaaatgatgaggactgcgcacactggaaggaggccaaaatgctgctcgataacattaatacacctgaagggatcattcccagcatgttcgagccagaacgagagaaggttgacgctatcgatggagaatacagattgcggggcgaggccaggaaaacctttgtggacctgatgcgcagaggtgatctccctgtctggctggcgtataaggtggcagccgaggggataaactacgctgacaggcggtggtgtttcgatggcatcaaaaacaatcagattcttgaagagaacgttgaagtggagatctggaccaaggagggagaacgtaagaaactaaagccccgctggctggacgcccgaatttattctgatccattggctttaaaagagtttaaggagttcgcagccggcagaaaatcactgactctcaatctgatcacagagatggggaggcttcctaccttcatgacacaaaagactcgggacgctctggataacctcgccgtcttgcacacggcagaagcgggaggtcgcgcctacaatcatgctctgtccgagctaccggagaccctggaaacactccttctgttaactttgctggccaccgtgacaggcgggatatttctcttcctgatgagtggaagaggcattggtaagatgacccttgggatgtgctgcatcatcactgcaagcattctgctctggtatgctcagatccagccccactggatagccgcatcgattatcttggagtttttcctgattgtattactaatcccagaacctgagaaacagaggacgccccaagacaaccagctgacctacgtggttatagccatcctcacagtcgtggctgcgactatggccaatgaaatgggctttcttgagaagaccaaaaaggacctgggattgggctctattgcaacacagcagccagagtccaacatcctggatattgacctccggcctgctagcgcctggaccctgtacgccgtggcaactacattcgtcacgcccatgcttcgacattcaatcgaaaatagttctgttaacgtgtccctcaccgctattgccaatcaagcgactgtactgatggggttgggaaaaggttggccgctgagcaagatggatatcggcgtgccattactagctatagggtgttattcacaggtcaaccctattacactgaccgccgcactccttctgttggtggcccactacgctatcatcggacccggcctgcaggcaaaggccaccagagaggcgcagaaacgcgctgccgcaggtattatgaagaatccaacagttgacgggataactgtgatcgatctcgaccccattccttatgatccgaaatttgaaaagcaactgggccaggtcatgcttttaatcctgtgcgtaacacaggtgctcatgatgaggaccacatgggccttgtgtgaggctctgactctagccaccggacccattagtacactgtgggaaggcaacccagggcggttctggaataccactatcgcagttagcatggctaacatatttcgtggatcctacctcgccggcgcgggtcttctgttctctatcatgaaaaatacgacaaacaccagaagggggactggaaacattggcgagaccttgggtgagaagtggaaaagccgcctgaatgccctcggcaagtccgaatttcaaatctataagaaatcagggattcaggaggtggaccggacactggcaaaggaaggaatcaaacgaggcgagactgatcaccatgctgtctctagagggagtgccaagttaaggtggttcgtggagcgcaacatggtcacccctgaaggaaaagtggttgaccttggctgcggtagagggggatggtcgtactattgtggcggtctgaagaatgtgagagaggtaaagggcctcacaaaagggggacccggccacgaggaacctataccaatgagcacgtacgggtggaacctagtgcgtctgcagtccggagtcgatgtatttttcattccccctgaaaagtgcgacaccttgctgtgtgatatcggcgagtcttcaccaaatcccactgtggaggcaggtaggacactccgggtccttaacctggtggaaaattggttgaacaataacacccagttctgcatcaaagtactgaatccgtacatgcctagcgtgattgagaagatggaagctctccaacgcaaatatgggggagccttagttcgaaacccactgtccagaaatagtactcatgagatgtactgggtgtctaacgccagcggcaatatagtctcatccgtgaacatgatcagtaggatgcttattaaccggtttacaatgcgccacaagaaggcgacctatgaacccgacgtcgacctgggcagcgggacgagaaatatcggaattgagtctgaggtgcctaacctagatatcataggtaaaaggatcgaaaagattaaacaggagcatgaaacctcctggcactacgaccaggatcacccatataagacatgggcttaccatggctcatatgagactaaacagaccgggagcgcatcgtctatggttaatggagtagtgcgactcctgacaaagccctgggacgtcttgccgactgtgacccaaatggccatgacagataccactcctttcggccagcagcgggtttttaaggaaaaagtggacacgcgtacacaggagcccaaggagggtaccaaaaagctgatgaaaatcactgctgaatggctctggaaggagcttgggaaaaagaagaccccaagaatgtgtacacgcgaagagttcacgaggaaagtccggagtaacgccgcactgggagccatttttaccgatgagaataagtggaaatccgctagagaagcggtggaggacagccgcttctgggaattagtagataaggagaggaacctgcacttggaaggcaaatgcgagacttgtgtgtacaatatgatgggcaagcgagagaagaaactcggggaatttggaaaggccaaaggttcacgggcaatctggtacatgtggctgggcgctagattcctagagtttgaagcccttgggttcctgaacgaggaccattggttttccagggaaaattctctcagcggagttgagggcgagggtctgcacaagttggggtatattctgcgcgatgtcagtaaaaaggaaggaggcgcaatgtacgccgacgacacagctggctgggatacccgtataactctcgaggaccttaagaacgaagagatggtgacaaatcacatggaaggggagcataaaaagctggccgaggcgatcttcaaattaacctatcaaaacaaggtggtccgggttcagagacctacacccaggggaactgtgatggatattatctcccgccgagaccagcggggtagcggccaagtagggacctacggactgaatacgtttaccaacatggaagcacagttgatcagacagatggagggcgaaggtgtgttcaaaaatattcagcacctcacagtcactgaggaggtggccgttcaaaactggctggctagggtggggcgcgaaagactatctcggatggccatatcaggagatgactgcgtcgtgaagccacttgatgacaggttcgcaaacgctctgaccgccctcaatgatatgggcaagatccgtaaagacattcagcagtgggagcccagtaagggctggaacgattggacacaggtacctttttgctcccatcacttccatgaactgatcatgaaagacgggcgagttttggtggtcccatgtcgcaatcaagatgagttaattggacgggctcggatcagccagggtgccggctggtctctgagggaaactgcatgcctcgggaagtcgtatgcgcagatgtggtcacttatgtactttcaccgcagagacctgcggctagccgctaacgccatatgtagcgcagtgccgtcccactgggtgcccaccagtaggacgacatggtctatccatgctaaacacgagtggatgaccactgaggacatgctgacagtctggaatcgagtttggattcgtgaaaacccttggatggaggataagaccccagtggaaagctgggaggaaatcccctatctcggaaagagagaggaccagtggtgcggctccttgattggtctgacttcacgcgccacctgggccaaaaatatccaagccgcgataaaccaggtacggagtcttattgggaatgaggaatacacagattacatgccttctatgaagaggttcagacgcgaggaagaggaagctggagtgctgtggtga

SEQ ID NO: 14439 - RNA, 9876 nt, synthetic construct
  misc_feature 1..9876: note = derived and/or modified CDS sequence (opt3) from DENV-2__FJ639709__SS-prME
  source 1..9876: mol_type = other RNA
agcgccggaatgatcattatgctgatacccaccgtgatggctttccacctcacgactagaaacggggagcctcatatgatcgtcgggattcaagagaagggtaaatcccttctgtttaagacggaggacggagttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggctctcattttcatcctgctgactgcagtggccccatctatgacaatgcgctgcatagggatttcgaacagagattttgttgaaggagtgtcaggtggcagctgggtcgacatcgtgctcgagcacgggagttgtgtaaccactatggctaagaataagcccacattagatttcgaactgattaaaaccgaggccaagcagcctgcgacgcttaggaaatattgcatcgaagcaaagttgaccaacacaactaccgagtcccggtgtccaacacaaggagagccctctctgaaagaggaacaggacaagcgctttgtttgcaagcatagcatggtggatcgaggctggggtaatgggtgtggactattcggcaaaggcgggatcgtcacttgcgccatgtttacctgcaagaaaaacatggaaggaaagattgtgcagcctgagaatctcgaatacacaatagtggtcaccccacactccggtgaggagcatgctgttggcaacgacactgggaaacacggaaaggaaatcaaagtgacgccgcagtcaagtattacagaggccgaactgaccggctatggtactgtaaccatggagtgtagccccagaacagggcttgatttcaatgaaatggtgctgttgcaaatggagaacaaggcatggctcgtccacaggcagtggtttctggacttacctctgccatggctccccggcgctgataagcagggatctaattggatccagaaagagacccttgtgactttcaagaaccctcatgccaaaaagcaagacgttgtggtcctgggctcccaggaaggggcgatgcacacagccttgacgggagcaaccgagatacagatgtcaagcggtaatctactgtttactggccatctcaaatgccggctgcgtatggacaaacttcaactgaaggggatgagttactctatgtgtacaggaaaattcaaggtggtaaaagaaattgctgagacccagcacggcacaatcgttatccgcgtgcagtatgagggtgatgggtccccatgcaagattcccttcgaaatcatggacttggagaaaagatacgtcctcggcaggctgattactgtgaacccgatagtcaccgaaaaggatagccctgtgaacatcgaggccgaacccccatttggagactcgtacattatcatcggcgttgagcctgggcagttaaagctgaattggttcaaaaagggatcttccattggtcaaatgtttgagacgaccatgcggggcgctaaacgaatggccatactaggggatacagcatgggacttcggatcactcggcggtgtgtttacaagtatcgggaaggccctgcatcaggtattcggcgctatttatggagcggcatttagcggcgtctcctggaccatgaaaatccttattggggtgatcataacatggatcggaatgaactctcgcagcacttcattgagtgtttccctggtgctcgtcggcattgtgaccctgtaccttggtgtaatggtgcaggccgatagcgggtgtgttgtctcttggaagaataaggaactgaaatgcggatcaggcatcttcattacggacaacgtgcacacatggaccgagcagtataagtttcaacccgaaagtccaagcaaattggcttccgccatccagaaggcacaggaggaaggtatatgtggcattagatctgtgactaggctcgagaatctgatgtggaaacagatcacacccgagttaaaccacattctggccgaaaatgaggtcaagctaaccatcatgactggggatataaaaggaatcatgcaagctggcaagcggtcgctccgccctcagccaaccgaactgaagtacagctggaaaacatgggggaaggccaaaatgctttccacggagtcacataaccagaccttcttgattgacggaccggaaactgcagagtgccccaatacaaacagagcgtggaatagtctggaggttgaagattatggctttggtgtgttcaccacaaacatctggctcaagctgaaagagaagcaggacgctttttgtgactctaagttaatgagcgccgcaattaaagataatagggccgtgcacgctgacatggggtactggatcgaatccgccctgaacgatacttggaagatagagaaagcatcattcattgaggtaaagaattgccattggcctaaaagccacaccctttggtctaacggagtcttggaatccgagatgatcatcccaaagaacctcgctggccccgtgagtcaacacaattatcgtcctggttaccatacgcagattgccggcccatggcacctggggaagctagaaatggacttcgatttttgtgacggaacaaccgttatcgtgactgaggattgcggcaaccgggggcccagcctgcgaaccacaactgcgtctggaaaactcattaccgaatggtgctgtagatcctgcacactgccgcctcttaggtaccgcggcgaggacggttgttggtatgggatggagatacggccattgaaggaaaaagaggaaaatctggtcaactcattagtgacggccggacatggccaggttgataatttcagtctcggtgtgctgggcatggctctttttctggaggaaatgttgagaaccagggtagggactaagcacgcaatcctcctggtcgccgtgagcttcgtgacactaattaccggaaacatgtcgtttaaagacctgggccgcgtcgttgtgatggtaggggctactatgacagatgacatcggaatgggcgtgacctacctcgccctgcttgcagcgttcaaggtccgacccacgtttgccgctggtttgctgttacggaagctcacttccaaagagctgatgatgaccacaattgggatcgtgcttctgtctcaaaccactatacctgagacaatcctagaactcaccgatgccctggcattgggaatgatggttctgaagattgtgcgtgacatggagaaatatcagttagctgtcacaatcatggccattctctgcgtgcccaatgcagttatcctgcagaacgcctggaaggtgagctgtactatacttgctgtcgtatcagtgagtccactgttgctcacctcctctcagcagaagacggactggattcctctggcgctaacaatcaagggcctgaatcccaccgccatcttccttactaccctcagcagaacaaacaaaaagaggtcctggccactgaatgaagcaattatggctgttggcatggtgtcaatattggccagcagtctgttaaagaacgatatcccgatgactgggcctctcgtcgccggaggtctgcttaccgtgtgctacgtactgacgggccgctctgctgacttggagctcgaacgggcaacagatgtgaaatgggaggaccaggccgagatttccgggagctcgcccatcctgtcaattaccatctctgaagatggaagtatgtccataaagaatgaggaagaggagcagactctaacaatcctgattagaaccggccttctcgtcatcagcggtctgtttccagtttctattcccatcactgcggctgcctggtatttgtgggaagtgaaaaagcagagggcaggggtgttatgggacgtccctagcccaccccctatgggaaaagccgagctggaagatggcgcttaccgaataaagcaaaagggcattctcgggtattcccagatcggagccggtgtgtacaaagagggcacattccataccatgtggcacgttacgcgcggggcagtactgatgcacaagggaaaacggatcgaaccgtcatgggcggacgtgaagaaagatcttattagttacggcggtgggtggaagctggagggagagtggaaggaaggcgaggaagtccaggtgttggctctagagccaggcaaaaaccccagagccgttcagactaagcctgggctgtttaaaaccaatacaggaaccatcggtgcagtgagcctcgacttctctccaggcacatccgggtcacccataattgataagaaaggaaaggtcgtgggcctgtatggtaacggggtagtcactaggagtggagcctacgtgagcgctatcgcccaaaccgaaaagtccattgaggacaaccctgagatcgaagatgacatatttcgtaaacgccggcttacgattatggacttacatccgggcgcaggcaagacaaaaagatatctgcccgctatcgttagggaggccatcaagcgagggctccggactttgattctggcgccaacccgcgtggtcgccgcagaaatggaggaagctctcagaggactgcctatcaggtaccagacacccgccattcgggctgagcacaccggtcgagagatagtggatcttatgtgtcatgcaactttcaccatgagactgttgtctccagttcgcgtgcctaattataacctaatcattatggacgaagcccacttcacagatcccgcctcgatcgctgcgaggggctacatcagcacgcgtgtcgagatgggggaagcagccggaatttttatgactgctaccccaccgggctcacgggaccctttcccccagtccaatgccccaataatcgatgaggagagagaaattcccgagaggagttggaactctggtcatgaatgggtgacagactttaaagggaagaccgtatggttcgtgcctagcatcaaggcaggaaatgatattgccgcttgcctgcgcaaaaacggcaagaaagttatccaactctcccgaaagacttttgactcagagtatgtcaaaacaagaaccaatgattgggacttcgtggtgacgactgatatatctgaaatgggcgcgaactttaaggccgagcgggtcatcgacccaaggcgctgtatgaaacccgtaattttaacagacggggaggaacgtgtgatcctggcaggacctatgccggttacccacagcagtgctgcccagagacggggtaggattggccgcaatccaaagaacgagaatgatcagtacatctacatgggggaaccccttgagaacgacgaagattgcgcacactggaaggaggccaaaatgctgctcgacaatataaacacccctgagggaattatcccctccatgttcgaaccagagcgagaaaaggtggatgctattgacggcgagtatagattgcggggtgaagccaggaaaacttttgtcgatctgatgcgcagaggggacctccctgtgtggctggcgtacaaggttgcagccgagggcatcaattatgctgataggcggtggtgtttcgacggaatcaaaaacaaccagatccttgaggaaaatgtggaggtcgaaatttggacaaaggagggcgagcgtaagaaactaaagccccgctggctggatgcccgaatctacagcgacccattggctttaaaagaatttaaggagttcgcagccgggagaaaatctctgaccctcaacctgattacagaaatgggaaggcttcctactttcatgacgcaaaagacccgggatgctctggacaatctcgccgtgttgcatacagcagaggcgggtggccgcgcctataaccacgctctgtcagaactaccggagactctggagaccctccttctgttaacattgctggccaccgtaactgggggaatctttctcttcctgatgtccggcagaggtatagggaagatgacgcttggcatgtgctgcattatcaccgcaagtatcctgctctggaatgctcagattcagccccattggatcgccgcaagcataattttggaatttttcctgatcgtgttactaattccagagcctgaaaaacagaggacaccccaagacaaccagctgacttacgttgtcatcgccatactcaccgtggtggctgcgacaatggccaatgagatgggatttcttgaaaagaccaaaaaggatctgggcttggggtcgatcgcaactcagcagccagagtctaacattctggacatcgatctccggcctgcttccgcctggacactgtatgccgtcgcaacgaccttcgttactcccatgcttcgacacagcattgaaaattcaagtgtgaacgtatctctcacagctatcgccaatcaagcgaccgtgctgatgggattgggtaaaggctggccgctgtccaagatggacattggggtcccattactagctatcggatgttacagccaggtgaaccctataaccctgacagccgcactccttctgttggttgcccactacgctattatcggccccggtctgcaggcaaaggccactagagaagcgcagaaacgcgctgccgcagggatcatgaagaatccaacggtggatggcattaccgtcatagacctcgatcccatcccttatgacccgaaatttgagaagcaactgggacaggtaatgcttttaattctgtgcgtgacacaggttctcatgatgaggactacctgggccttgtgtgaagctctgacactagccaccggccccatctcaactctgtgggaggggaacccaggacggttctggaatacgacaattgcagtgagtatggctaacatctttcgtggcagctacctcgccggtgcggggcttctgttctccataatgaaaaataccactaacaccagaaggggaacaggcaacatcggtgaaactttgggcgagaagtggaaatctcgcctgaatgccctcggaaagagcgagtttcaaacctataagaaatccggcattcaggaagtcgatcggacactggcaaaggagggcatcaaacgaggggaaacggaccatcacgctgtgtcaagaggatctgccaagttaaggtggttcgtcgagcgcaacatggtgacccctgagggcaaagttgtggatcttggttgcgggcggggaggctggagttactattgtggtggcctgaagaatgtaagagaagtgaaggggctcactaaaggaggccccgggcatgaggaacctattccaatgtcgacatacggatggaacctagtccgtctgcagagcggcgttgacgtgtttttcataccccctgagaagtgcgataccttgctgtgtgacataggtgaatcctctccaaatcccactgtcgaggcagggaggacactccgggtgcttaacctggtagagaattggttgaacaataacacccagttctgcattaaagtgctgaatccgtatatgccttcagttatcgaaaagatggaggctctccaacgcaaatacggaggcgccttagtgcgaaacccactgagcagaaattccacgcacgaaatgtactgggtcagtaacgcctctggcaatatcgtgagctcagtcaacatgatttccaggatgcttataaaccggtttaccatgcgccataagaaggcgacatatgagcccgacgtggatctggggagtggaactagaaatatcggtattgaaagcgagatccctaacctagacattatcggcaaaaggatagagaagatcaaacaggaacacgagacctcttggcactacgatcaggaccatccatataagacatgggcttaccacgggtcctatgaaactaaacagaccggatcagcaagctcgatggttaatggcgtagtgcgactcctgacaaagccctgggatgtcttgccgaccgtgactcaaatggccatgacggacacaacccctttcggtcagcagcgggtttttaaggagaaagtggatactcgtacccaggaacccaaggaggggactaaaaagctgatgaaaattacggctgagtggctctggaaggaacttggcaaaaagaagaccccaagaatgtgtactcgcgaggagttcacaaggaaagtccggtctaacgccgcactgggcgccatctttaccgacgagaataagtggaaaagtgctagagaggcggtggaagattcccgcttctgggagttagtagacaaggaaaggaacctgcatttggagggcaaatgcgaaacttgtgtgtacaatatgatggggaagcgagagaagaaactcggagagtttggtaaggccaaaggcagccgggcaatttggtatatgtggctgggggctagattcctagaatttgaggcccttggattcctgaacgaagatcactggttttcaagggaaaattccctctctggcgttgaaggtgaggggctgcacaagttgggatacatcctgcgcgacgtcagcaaaaaggagggcggcgcaatgtacgccgacgatacagctgggtgggacacccgtattacactcgaagatcttaagaacgaggaaatggtgactaatcatatggagggagaacacaaaaagctggccgaggcgatattcaaattaacctatcaaaacaaggtggtccgggttcagagacctacgcccaggggtaccgtgatggacatcattagtcgccgagatcagcggggctccgggcaagtaggaacatacggcctgaatacttttaccaacatggaggcacagttgatcagacagatggaaggtgagggggtgttcaaaaatatccagcatctcacagccactgaagaggtcgctgtgcaaaactggctggccagggttggacgcgagagactaagccggatggcaatttctggcgacgattgcgtggtcaagccacttgacgataggttcgctaacgccctgaccgctctcaatgacatgggcaagatacgtaaagatatccagcagtgggaaccctcaaaggggtggaacgactggacacaggtgcctttttgcagtcaccatttccacgagctgattatgaaagatggacgagtattggttgtgccatgtcgcaatcaagacgaattaatcggtagagcccggatttcccagggcgcagggtggagcctgagggagacagcgtgcctcggaaagtcttatgcccagatgtggtcgcttatgtactttcaccgcagagacctgcggctagctgccaacgcaatctgttcagctgtcccgagccattgggtgcccacctccaggactacatggagtatacacgccaaacatgaatggatgaccactgaggatatgctgaccgtgtggaatcgagtctggatccgtgagaacccttggatggaagacaagacaccagttgagtcttgggaagagattccctatctcggcaagagagaagatcagtggtgcggtagcttgatcgggctgacgtcccgcgcaacctgggccaaaaatattcaagcggctatcaaccaggtgcggtcacttataggaaatgaggagtacactgactatatgcctagtatgaagaggttcagacgcgaagaggaagaggccggcgtactgtggtga

SEQ ID NO: 14440 - RNA, 9876 nt, synthetic construct
  misc_feature 1..9876: note = derived and/or modified CDS sequence (opt3) from DENV-2__FJ639710__SS-prME
  source 1..9876: mol_type = other RNA
agcgccggaatgatcattatgctgataccaaccgtgatggctttccacctcactactagaaacggggagcctcatatgatcgtcggcattcaagaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggctctcattttcatcctgctgactgcagtggccccatctatgacaatgcgctgcatagggatttcgaacagagattttgttgaaggagtgtcaggtggcagctgggtcgacatcgtgctcgagcacgggagttgtgtaaccactatggctaagaataagcccacattagatttcgaactgattaaaaccgaggccaagcagcctgcgacgcttaggaaatattgcatcgaagcaaagttgaccaacacaactaccgagtcccggtgtccaacacaaggagagccctctctgaaagaggaacaggacaagcgctttgtttgcaagcatagcatggtggatcgaggctggggtaatgggtgtggactattcggcaaaggcgccatcgtcacttgcgctatgtttacctgcaagaaaaacatggaagggaagattgtgcagcctgagaatctcgaatacacaatagtggtcaccccacactccggagaggagcatgccgttggtaacgacactggcaaacacgggaaggaaatcaaagtgacgccgcagtcaagtattacagaggcagaactgaccggatatggcactgtaaccatggagtgtagccccagaacaggtcttgatttcaatgaaatggtgctgttgcaaatggagaacaaggcttggctcgtccacaggcagtggtttctggacttacctctgccatggctccccggggccgataagcaggagtctaattggatccagaaagaaacccttgtgactttcaagaaccctcatgcgaaaaagcaagacgttgtggtcctgggctcccaggagggagccatgcacacagcattgacgggcgctaccgaaatacagatgtcaagcgggaatctactgtttactggacatctcaaatgccggctgcgtatggacaaacttcaactgaagggtatgagttactctatgtgtacaggcaaattcaaggtggtaaaagagattgccgagacccagcacgggacaatcgttatccgcgtgcagtatgaaggagatggctccccatgcaagattcccttcgagatcatggacttggagaagcggtacgtcctcggtaggctgattactgtgaacccgatagtcaccgagaaggatagccctgtgaacatcgaagctgagcccccatttggggactcgtacattatcatcggcgttgagcctggacagttaaagctgaattggttcaaaaagggatcttccattgggcaaatgtttgaaacgaccatgcggggagccaaacgaatggcaatactaggtgatacagcctgggacttcggctcactcgggggagtgtttacaagtatcggcaaggctctgcatcaggtattcggtgcgatttatggggcagcctttagcggcgtctcctggaccatgaaaatccttattggagtgatcataacatggatcggcatgaactctcgcagcacttcattgagtgtttccctgattctcgtggggatcgtcaccctgtaccttggagtgatggtacaggctgatagcggctgtgtggtttcttggaagaataaggagctgaaatgcggttcagggattttcatcacggacaacgtccacacatggaccgaacagtataagtttcaacccgagagtccaagcaaattggcctccgcaatacagaaggcccaggaagagggaatttgtggcatcagatctgtgactaggctcgagaatctgatgtggaaacagattacacccgaattaaaccacatcctggctgagaatgaagtgaagctaaccataatgactggtgatatcaaaggcattatgcaagccgggcggcgctcgctcagacctcagccaaccgagctgaagtacagctggaagacatggggaaaagcaaagatgctttccacggaatcatataaccagaccttcttgatcgacggcccggagactacagagtgccccaataccaacagggcgtggaatagtctggaagtcgaggattacgggtttggagttttcacaactaacatttggctcaaactgaaggaaaaacaggacgctttttgtgactctaagttaatgagcgccgcaatcaaggataatcgtgccgtgcatgctgacatgggctattggatagagtccgccctgaacgatacctggaaaattgagaaggcatcattcatcgaagtgaaaaattgccactggcctaagagccatacgctttggtctaacggtgtattggagtccgaaatgatcattcccaagaacctcgctgggcccgtcagtcaacacaattaccggcctggataccacacacagatcgccggcccatggcatctgggtaagctagagatggacttcgatttttgtgacggcaccactgtgattgttaccgaagattgcgggaaccgaggacccagcctgagaacaactaccgcgtctggcaagctcataacagagtggtgctgtaggtcctgcacgctgccgcctcttcgctatagaggggaggacggatgttggtacggcatggaaatcagaccattgaaagagaaggaagagaatctggtgaactcattagtcaccgccggtcacggacaggtggataatttcagtctcggagttctgggcatggctctttttctggaagagatgttgaggactcgcgtgggtacaaaacatgcaattctcctggtagccgtcagcttcgtgaccctaatcactggcaacatgtcgtttaaggacctggggcgagtggtcgttatggtgggagctacaatggccgatgacattggcatgggggtaacctatctcgcactgcttgcggccttcaaagtgcggcccacgtttgctgccggattgctgttacgtaagctcacttccaaggagctgatgatgaccacaatcggcatagtccttctgtctcaaagcaccatccctgaaactattctagagctcacagatgcactggctttgggtatgatggtgctgaaaatcgttagaaatatggaaaagtaccagttagccgtgaccattatggcaatcctctgcgtccccaacgccgtgatactgcagaatgcttggaaagtttcatgtacaattcttgcggtggtcagtgtatccccactgttgctcacttctagccagcaaaagaccgactggatccctctggccctaacgatcaaagggctgaaccccacagcaattttccttaccactctctccaggaccaataagaaacgctcatggccactgaacgaggctataatggccgtgggaatggttagcatcttggccagttctctgttaaagaatgacattccgatgacaggccctctcgtggctggcgggctgcttactgtctgctatgtgctgaccggacggtccgcagatttggaactcgagagagccacggacgtaaagtgggaggaacaggcggagatcagcggttcgtcacccattctgtctatcacaataagtgaagatggctccatgagcatcaaaaacgaggaggaggagcagaccctaactattctgatcaggacagggcttctcgtgatttctggactgtttccaatcagcatacccattaccgctgccgcatggtacttgtgggaagtcaagaaacagcgagccggcgttttatgggacgtgccttccccaccccctatgggtaaggctgagctggaagatggggcatatcgcatcaaacaaaagggaatcctcggctactcacagattggcgccggggtgtacaaggagggaactttccacacaatgtggcatgtcacccggggtgcggtgctgatgcacaaaggcaagagaatcgagccgagttgggctgacgttaaaaaggatcttataagctatgggggaggctggaaactggaaggtgagtggaaggaaggggaggaagtacaggtgttggccctagagccaggaaagaatcccagggcagtccagacgaaacctggcctgtttaagactaacaccggcacaattggggccgtgtctctcgacttctccccaggaacctcaggtagtcccatcattgataaaaagggcaaagttgtggggctgtacggaaacggcgtcgtgacacgtagcggtgcttatgtatccgccatcgcacaaactgagaagtctatagaagacaatcctgagattgaagatgacatctttcgcaagcggagacttaccatcatggatttacacccgggggctggaaaaacgaagaggtacctgcccgccattgtccgagaggcgatcaaacggggcctccgcacattgattctggccccaactagagtggttgcagctgaaatggaggaggccctcaggggcctgcctatacggtatcagacccccgctatccgagcagaacatacagggagagagattgtggaccttatgtgtcacgccaccttcactatgcgcctgttgtcgccagtcagggtgcctaactacaatctaatcatcatggacgaagcccatttcaccgatcccgctagcattgcggcacgtggatatatatcaacacgggttgagatgggtgaggccgctggcatctttatgacggccactccaccggggtccagagaccctttcccccagagtaacgcaccaattatcgatgaagagagggaaattcccgagcgctcttggaatagcggacacgaatggatcaccgactttaagggcaaaacagtgtggttcgtcccttccataaaggccggtaacgatatcgctgcgtgcctgcgaaagaatgggaaaaaggtgattcaactctcaagaaaaacctttgactctgagtacgtaaagactcggacaaacgattgggacttcgtggttaccacggatatcagcgagatgggagccaattttaaagcagaaagggtcattgacccacgccgttgtatgaagcccgtgatcttaactgatggcgaggaaagagtgatactggctggccctatgccggtcacacatagttccgccgcacagcggagggggcgcattggacgaaaccccaaaaatgagaacgaccagtacatctatatgggtgaaccccttgagaatgacgaggattgcgcccactggaaggaagctaagatgctgctcgacaacattaatacccctgagggcatcatacccagcatgttcgaaccagagagagaaaaagtagatgccatcgacggggagtaccggttgaggggagaggcgcgcaagacctttgtggatctgatgagaaggggcgacctccctgtttggctggcatataaagtggccgctgaaggtattaactacgccgatcggcgttggtgtttcgacgggatcaagaacaatcagattcttgaggaaaacgtcgaggtggagatctggactaaagaaggcgagcgcaagaagctaaaaccccgatggctggatgctagaatatattctgacccattggcattaaaggaatttaaagagttcgccgctggaaggaagtcactgacactcaatctgattaccgaaatgggccggcttcctacattcatgactcagaaaacgcgcgatgccctggacaacctcgcagttttgcacaccgcggaggccgggggcagagcttacaatcatgccctgtccgagctaccggaaacactggagactctccttctgttaaccttgctggcaacagtgaccggtggcatctttctcttcctgatgagtgggaggggaatcggcaagatgactcttggtatgtgctgcattatcacggctagcatactgctctggtatgcccagattcagccccactggatcgcagcctcgattatcttggaatttttcctgatagtcttactaatcccagagcctgaaaagcagcggaccccacaagataaccagctgacatacgtggtaattgctatcctcactgtggttgcggccaccatggcaaatgagatggggtttcttgagaaaacaaagaaagacctgggcttgggatctattgctacccagcagccagaatccaacatcctggacattgatctccgacctgccagcgcctggactctgtacgcagtcgctacaacgttcatcacccccatgcttagacattcaatagagaatagttctgtgaacacttccctcacagccattgcgaatcaagctaccgtgctgatgggcttggggaagggatggccgctgagcaaaatggacatcggtgtcccattactagccatcggctgttattcacaggttaaccctattaccctgacagcagccctccttctgttggtggctcactacgcaataatcgggcccggactgcaggccaaggcgactcgcgaagctcagaagagggccgcagccggcattatgaaaaatccaacggtagatggtatcaccgtgattgacctcgatcccatcccttatgacccgaagtttgagaaacaactggggcaggtcatgcttttaatactgtgcgtgacacaggttctcatgatgcggactacctgggctttgtgtgaagccctgacactagcaaccggccccatcagtactctgtgggagggaaacccaggccgtttctggaatacgacaattgctgtgagcatggccaacatctttagagggtcctacctcgcgggagccggccttctgttctctattatgaagaataccactaacaccaggcgcggtacagggaacatcggagagactttgggcgaaaaatggaaaagccggctgaatgcactcggtaaatccgagtttcaaatatataagaagtcaggcattcaggaagtcgatcgaaccctggctaaagaggggatcaagagaggagagacagaccaccatgccgtatctaggggcagtgcaaaattacgctggttcgtggaacggaacatggttacgcctgaggggaaggtggtcgatcttggatgcggcagaggtgggtggtcgtactattgtggaggcctgaaaaatgtgaaggaagtcaagggtctcaccaaaggcgggcccggacacgaggaacctatcccaatgagcacttacggctggaacctagtgcgtctgcagtccggggttgacgtgtttttcattccccctgagaagtgcgatacattgctgtgtgacataggagagtcttcaccaaatcccaccgtagaagctggcaggactctccgggtgcttaacctggtcgagaattggttgaacaataacacacagttctgcatcaaagttctgaatccgtacatgcctagcgtgattgaaaagatggaggccctccaacgcaaatatggtggggccttagtccgaaacccactgtccagaaatagtacccatgaaatgtactgggtgtctaacgcgagcggaaatatcgtatcatccgtgaacatgattagtaggatgcttatcaaccggtttacgatgcgccacaagaaggctacctatgagcccgatgttgacctgggcagcggcacaagaaatatagggatcgagtctgaagtgcctaacctagacattatcggaaaaaggattgagaagatcaaacaggaacatgagacttcctggcactacgatcaggaccacccatataagacctgggcataccatggttcatatgaaacaaaacagactggcagcgcctcgtctatggtcaatggggtggtccgactcctgaccaagccctgggatgtgttgccgacagttacccaaatggctatgactgacacgacacctttcggacagcagcgggtatttaaggagaaagtggatacccgtactcaggagcccaaggaaggcaccaaaaagctgatgaaaattacagccgagtggctctggaaggaacttggtaaaaagaagacgccaagaatgtgtacccgcgaggagttcactaggaaagtccggagtaacgcagccctgggggctatatttacagacgaaaataagtggaaatccgcgagagaggccgtggaagatagccgcttctgggagttagttgacaaggaaaggaacctgcacttggagggaaaatgcgagacctgtgtgtacaatatgatgggcaagcgagaaaagaaactcggcgagtttgggaaggcaaaaggatcacgggctatctggtacatgtggctgggtgccagattcctagaatttgaggcacttggcttcctgaacgaagatcattggttttccagggaaaattctctcagcggggtcgagggagaaggcctgcacaagttgggttatattctgcgcgacgtgagtaaaaaggaaggcggggccatgtacgctgatgacactgccgggtgggacacacgtatcaccctcgaagatcttaagaacgaggaaatggtaacaaatcacatggagggcgagcataaaaagctggcggaagcaatcttcaaattaacttatcaaaacaaggtggttcgggtccagagacctacccccagggggacggtgatggacattatatcccgccgagatcagcggggaagcggtcaagtgggcacctacgggctgaatacatttactaacatggaggcccagttgatcagacagatggaaggagagggcgtcttcaaaaatattcagcacctcaccgttacagaggaagtggctgtacaaaactggctggccagggtgggtcgcgagagactatctcggatggcaatctcaggggacgattgcgtcgtgaagccacttgacgataggttcgctaacgccctgactgctctcaatgacatgggaaagattcgtaaagatatccagcagtgggaacccagtaagggctggaacgactggacccaggttcctttttgctcccatcacttccatgagctgataatgaaagatggccgagtgttggtcgtgccatgtcgcaatcaagacgaattaatcgggagagcccggattagccagggagcaggttggtctctgagggagacggcgtgcctcggcaagtcgtatgcccagatgtggtcacttatctactttcaccgcagagatctgcggctagctgccaacgcaatttgtagcgctgtaccgtcccactgggttcccacaagtaggaccacttggtctatccatgccaaacacgagtggatgacaaccgaagacatgctgactgtgtggaatcgagtctggatacgtgagaacccttggatggaagacaagaccccagtggagagctgggaagagattccctatctcgggaagagagaggatcagtggtgcggatccttgatcggcctgacatcacgcgcaacgtgggccaaaaatattcaagcggctatcaaccaggtgcggagtcttataggtaatgaagagtacaccgactacatgccttctatgaagaggttcagacgcgaagaggaagaggccggggtcctgtggtga

SEQ ID NO: 14441 - RNA, 9876 nt, synthetic construct
  misc_feature 1..9876: note = derived and/or modified CDS sequence (opt3) from DENV-2__GQ868623__SS-prME
  source 1..9876: mol_type = other RNA
agcgccggaatgatcattatgctgatacccaccgtgatggctttccacctcacaactagaaacggggaacctcatatgatcgtcgggattcaagaaaagggtaaatcccttctgtttaagacggaagacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggctctcattttcatcctgctgactgcagtggccccatctatgacaatgcgctgcatagggatttcgaacagagattttgttgaaggagtgtcaggtggcagctgggtcgacatcgtgctcgagcacgggagttgtgtaaccactatggctaagaataagcccacattagatttcgaactgattaaaaccgaggccaagcagcctgcgacgcttaggaaatattgcatcgaagcaaagttgaccaacacaactaccgagtcccggtgtccaacacaaggagagccctctctgaaagaagaacaggacaagcgctttgtttgcaagcatagcatggtggatcgaggctggggtaatgggtgtggactattcggcaaaggcgggatcgtcacttgcgccatgtttacctgcaagaaaaacatggaaggaaagattgtgcagcctgagaatctcgaatacacaatagtggtcaccccacactccggtgaggagcatgctgttggcaacgacactgggaaacacggaaaggaaatcaaagtgacgccgcagtcaagtattacagaggccgaactgaccggctatggtactgtaaccatggagtgtagccccagaacagggcttgatttcaatgaaatggtgctgttgcaaatggagaacaaggcatggctcgtccacaggcagtggtttctggacttacctctgccatggctccccggcgctgataagcagggatctaattggatccagaaagagacccttgtgactttcaagaaccctcatgccaaaaagcaagacgttgtggtcctgggctcccaggaaggggcgatgcacacagccttgacgggagcaaccgagatacagatgtcaagcggtaatctactgtttactggccatctcaaatgccggctgcgtatggacaaacttcaactgaaggggatgagttactctatgtgtacaggaaaattcaaggtggtaaaagaaattgctgagacccagcacggcacaatcgttatccgcgtgcagtatgagggtgatgggtccccatgcaagattcccttcgaaatcatggacttggagaaaagatacgtcctcggcaggctgattactgtgaacccgatagtcaccgaaaaggatagccctgtgaacatcgaggccgaacccccatttggagactcgtacattatcatcggcgttgagcctgggcagttaaagctgaattggttcaaaaagggatcttccattggtcaaatgtttgagacgaccatgcggggcgctaaacgaatggccatactaggggatacagcatgggacttcggatcactcggcggtgtgtttacaagtatcgggaaggccctgcatcaggtattcggcgctatttatggagcggcatttagcggcgtctcctggaccatgaaaatccttattggggtgatcataacatggatcggaatgaactctcgcagcacttcattgagtgtttccctggtgctcgtcggcattgtgaccctgtaccttggtgtaatggtgcaggccgatagcgggtgtgttgtctcttggaagaataaggaactgaaatgcggatcaggcatcttcattacggacaacgtgcacacatggaccgagcagtataagtttcaacccgaaagtccaagcaaattggcttccgccatccagaaggcacaggaggaaggtatatgtggcattagatctgtgactaggctcgagaatctgatgtggaaacagatcacacccgagttaaaccacattctggccgaaaatgaggtcaagctaaccatcatgactggggatataaaaggaatcatgcaagctggcaagcggtcgctccgccctcagccaaccgaactgaagtacagctggaaaacatgggggaaggccaaaatgctttccacggagtcacataaccagaccttcttgattgacggaccggaaactgcagagtgccccaatacaaacagagcgtggaatagtctggaggttgaagattatggctttggtgtgttcaccacaaacatctggctcaagctgaaagagaagcaggacgctttttgtgactctaagttaatgagcgccgcaattaaagataatagggccgtgcacgctgacatggggtactggatcgaatccgccctgaacgatacttggaagatagagaaagcatcattcattgaggtaaagaattgccattggcctaaaagccacaccctttggtctaacggagtcttggaatccgagatgatcatcccaaagaacctcgctggccccgtgagtcaacacaattatcgtcctggttaccatacgcagattgccggcccatggcacctggggaagctagaaatggacttcgatttttgtgacggaacaaccgttatcgtgactgaggattgcggcaaccgggggcccagcctgcgaaccacaactgcgtctggaaaactcattaccgaatggtgctgtagatcctgcacactgccgcctcttaggtaccgcggcgaggacggttgttggtatgggatggagatacggccattgaaggaaaaagaggaaaatctggtcaactcattagtgacggccggacatggccaggttgataatttcagtctcggtgtgctgggccttgctctgtttttggaggaaatgctcagaaccagggtagggactaagcacgcaatcctgctagtcgccgtgagcttcgtgacactgattaccggaaacatgtcggtcaaagacctcggccgcgttgtggtaatggtgggggctactatgacagatgacatcggaatgggcgtcacctacctggcccttttggcagcgtttaaggtgcgacccacgttcgccgctggtctgttactccggaagctgacttccaaagagcttatgatgaccacaattgggatcgttctgctatctcaaagcaccatacctgagactatcctcgaactgacagatgccttggcactgggaatgatggtgttaaagattgtccgtgacatggagaaatatcagctcgctgtgaccatcatggccattctgtgcgttcccaatgcagtgatccttcagaacgcctggaaggtctcatgtacaatactggctgtagtgagtgtttccccattgctcctgacttctagccagcagaagaccgactggattcctctagcgctgacgatcaagggccttaatcccacagccatctttctcaccactctgtccagaaccaacaaaaagaggtcatggccattgaatgaagcaattatggctgtgggcatggtcagcatactggccagttctttactcaagaacgatatcccgatgacagggcctctggtggccggaggtcttctgactgtatgctacgtgttgaccggccgctccgctgacctcgagctggaacgggcaacggatgtcaaatgggaggaccaggccgagattagcgggtcgtcacccatcctatctattacaatcagtgaagatggatccatgagcataaagaatgaggaagaggagcagaccctgactatccttattagaacaggcctcctggttatctctggtttgttcccagtgagcattcccatcaccgcggctgcctggtatttatgggaagtgaaaaagcagagggcaggggtcctgtgggacgtgccttccccaccccctatgggaaaagccgagctcgaagatggcgcttaccgaataaagcaaaagggcattctggggtattcacagatcggagccggtgtttacaaagagggcacttttcatacaatgtggcacgtaacccgcggggcagtgcttatgcacaagggaaaacggatcgaaccgagttgggcggacgtcaagaaagatctgattagctacggcggtgggtggaagttggagggagagtggaaggaaggcgaggaagtgcaggttctagctctggagccaggcaaaaaccccagagccgtgcagacgaagcctggactcttcaaaactaataccggaacaatcggtgcagtctctctggacttttccccaggcacctcagggagtcccataattgataagaaaggaaaggtggtaggcctttatggtaacggggtcgtgacaaggagcggagcctacgtttccgctatcgcccaaactgaaaagtctattgaggacaaccctgagatcgaagatgacatattccgtaaacgccggttaaccattatggacctgcatccgggcgcaggcaagacgaaaagatatctccccgctatcgtgagggaggccatcaagcgagggttgcggacactgattctcgcgccaactcgcgtcgtggccgcagaaatggaggaagctctgagaggacttcctatcaggtaccagacccccgccattcgggctgagcacacaggtcgagagatagttgatctgatgtgtcatgcaacctttactatgagattgctatcgccagtgcgcgtccctaattataacctgatcattatggacgaagcccacttcaccgatcccgccagcatcgctgcgaggggctacatctcaacacgtgtggagatgggggaagcagccggaattttcatgacggctactccaccgggctcccgggacccttttccccagagtaatgccccaataatcgatgaggagagagaaattcccgagaggtcttggaacagcggtcatgaatgggtaaccgacttcaaagggaagacagtgtggtttgttccttccatcaaggcaggaaatgatattgccgcttgcctccgcaaaaacggcaagaaagtcatccaattatcacgaaagaccttcgactctgagtatgtgaaaactagaacaaatgattgggactttgtggtcaccacggatataagcgaaatgggcgcgaacttcaaggccgagcgggtaatcgacccaaggcgctgtatgaaacccgtgattctgactgacggggaggaacgtgttatccttgcaggacctatgccggtgacacacagttccgctgcccagagacggggtaggattggccgcaatccaaagaacgagaatgatcagtacatctacatgggggaacccctggagaacgacgaagattgcgcacactggaaggaggccaaaatgctcttggacaatataaacacccctgagggaattatccccagcatgtttgaaccagagcgagaaaaggtcgatgctattgacggcgagtatagactgcggggtgaagccaggaaaaccttcgtggatctcatgcgcagaggggacctgcctgtttggcttgcgtacaaggtggcagccgagggcactaattatgctgataggcggtggtgttttgacggaatcaaaaacaaccagatactagaggaaaatgtcgaggtggaaatctggacaaaggagggcgagcgtaagaaactgaagccccgctggttggatgcccgaatttactctgacccattagctctgaaagagttcaaggagtttgcagccgggagaaaatcactcaccctgaaccttatcacagaaatgggaaggctgcctactttcatgacgcaaaagacccgggatgctctcgacaatttggccgtactgcatacagcagaggcgggtggccgcgcctataaccacgctctatccgaactgccggagactctcgagacccttctgttattgacactgctcgccaccgtgactgggggaattttcctgtttcttatgagtggcagaggtatcgggaagatgacgctgggcatgtgctgcataattaccgcaagcatcctcttgtggtacgctcagatccagccccattggattgccgcatcgatcatactggagttctttttaattgttctactgatcccagagcctgaaaaacagaggacaccccaagacaatcagctcacttatgtcgtgattgccatccttaccgtggtcgctgcgacaatggccaacgagatgggattcctggaaaagaccaaaaaggatttgggcctggggtctatagcaactcagcagccagagtccaatatcctcgacattgatctgcggcctgctagcgcctggacactttacgccgttgcaacgacctttgtgactcccatgctccgacactcaatcgagaacagttctgtaaatgtgtccctgacagctattgccaaccaagcgaccgtcttgatgggactgggtaaaggctggccgttaagcaagatggacatcggggtgccactactggctattggatgttactcacaggttaatcctatcaccctcacagccgcacttctgttgctggtggcccactatgctataattggccccggtctccaggcaaaggccactagagaagcgcagaaacgcgctgccgcagggatcatgaagaacccaacggtcgatggcatcaccgtaattgacctggatcccataccttacgacccgaaattcgagaagcaacttggacaggtgatgttactgatcctctgcgttacacaggtgttgatgatgaggactacctgggccctgtgtgaagctctaacactggccaccggccccattagtactctctgggaggggaatccaggacggttttggaacacgacaatcgcagtcagcatggctaatattttccgtggctcctatcttgccggtgcggggctgttgttttctatcatgaaaaacaccactaataccagaaggggaacaggcaacataggtgaaactctgggcgagaagtggaaaagccgcctcaacgccctggggaagtccgagttccaaacctacaagaaatcaggaatccaggaagtggatcggacattagcaaaggagggcattaaacgaggggaaacggaccatcacgctgtctctagaggaagtgccaaacttaggtggtttgtggagcgcaatatggttacccctgagggcaaagtggtagatctgggttgcgggcggggaggctggtcgtattactgtggtggcctcaagaacgtgagagaagtcaaggggctaactaaaggaggccccgggcatgaggaacctatcccaatgagcacatatggatggaatctggttcgtttgcagtccggcgtggacgtcttctttattccccctgagaagtgcgataccctgctctgtgacatcggtgaatcttcaccaaaccccactgtggaggcagggaggacacttcgggtactgaatttggtggagaactggctgaataacaatacccagttctgcataaaagttctcaacccgtacatgcctagcgtgattgaaaagatggaggctttacaacgcaaacacggaggcgccctggtccgaaatccactttccagaaacagtacgcatgaaatgtactgggtgtctaatgccagcggcaacatcgtctcatccgtgaatatgatcagtaggatgctgattaaccggttcaccatgcgccacaagaaggcgacatatgagcccgacgttgatctagggagcggaactagaaacataggtatcgaatctgagattcctaatctcgacatcattggcaaaaggatcgagaagataaaacaggaacacgagacctcctggcattacgatcaggaccacccatataagacatgggcttaccatgggtcatatgaaactaaacagaccggaagcgcatcgtctatggtaaacggcgtggtccgactgttgacaaagccctgggatgtgctgccgaccgttactcaaatggccatgacggacacaaccccttttggtcagcagcgggtgttcaaggagaaagtcgatactcgtacccaggaacccaaggaggggactaagaagctcatgaaaatcacggctgagtggctttggaaggaactgggcaaaaagaagaccccaagaatgtgtactcgcgaggaatttacaaggaaagtgcggagtaatgccgcattaggcgccattttcaccgacgagaacaagtggaaatccgctagagaggcggtagaagatagccgcttttgggagctggtggacagggaacgaaatttgcacctcgagggcaagtgcgaaacttgtgtttacaacatgatggggaaacgggagaagaagctgggagagttcggtaaagccaagggctcaagagcaatctggtatatgtggctaggggctaggtttcttgagttcgaggccctgggatttctcaatgaagatcactggttctcccgcgagaactctctgagcggcgtcgaaggtgaggggttgcataaactgggatacattctccgtgacgtgagtaagaaagagggcggcgcaatgtacgccgacgatacagctgggtgggacacccggatcacacttgaagatctgaagaatgaggaaatggtgactaaccacatggagggagaacataagaaattagccgaggcgatttttaagctgacctatcaaaataaagtcgttagagtgcagaggcctacgccccgcggtaccgtaatggacataatctcccgacgggatcagagaggcagcgggcaagtgggaacatacggcttgaacactttcaccaatatggaggcacagctcattaggcagatggaaggtgagggggtctttaagaacatccagcacctgacagccactgaagaggtggctgttcaaaattggctagcccgcgtgggaagagagcggctttctaggatggcaatctcaggcgacgattgcgtcgtgaaaccactggacgatcgtttcgctaacgccctcaccgctctgaacgacatgggcaagattcgaaaggatatacagcagtgggaacccagtaaagggtggaatgactggacgcaggtacctttctgctcccatcactttcacgagttgatcatgaaggatggacgcgttttagtggtcccatgtagaaaccaagacgaactgattggtcgggccaggatcagccagggcgcagggtggtctctccgcgagacagcgtgccttggaaaatcgtatgcccagatgtggtcactgatgtacttccatagacgggacctaaggctggctgccaatgcaatttgtagcgctgtgccgtcccactgggtgcccaccagtcgaactacatggtctatccatgccaagcacgaatggatgaccactgaggatatgctcaccgtctggaaccgtgtttggataagagagaatccttggatggaagacaaaacaccagtggagagctgggaagagatcccctatttgggcaagcgcgaagatcagtggtgcggttccctgattgggcttacgtcacgggcaacctgggccaagaacatccaagcggctattaatcaggtaaggagtctgatcggaaacgaggagtacactgactatatgccttctatgaaaagatttcgccgggaagaggaagaggccggcgtgctctggtga

SEQ ID NO: 14442 - RNA, 9876 nt, synthetic construct
  misc_feature 1..9876: note = derived and/or modified CDS sequence (opt3) from DENV-2__GQ868624__SS-prME
  source 1..9876: mol_type = other RNA
agcgccggaatgatcattatgctgataccaaccgtgatggctttccacctcactactcggaacggggagcctcatatgatcgtcggtattcaagaaaagggaaaatcccttctgtttaagacggaggacggcgttaatatgtgcaccttgatggcaatggatttaggggaactgtgtgaggacacgatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccacatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaggaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaatggaaatcaaggtaacgccgcagtcaagtattacagaggctgaactgaccggctatggtactgtgaccatggagtgtagccccagaacagggcttgatttcaatgaaatggtcctgttgcaaatggagaacaaagcctggctcgtgcacaggcagtggtttctggacttacctctgccatggctccccggcgcagataagcaggagtctaattggatccagaaggaaacccttgttactttcaaaaaccctcatgctaagaaacaagacgtggtcgtgctgggatcccaggagggcgccatgcacacagcgttgacgggggccaccgaaatacagatgtcaagcggaaatctactgtttactggtcatctcaagtgccggctgcgtatggacaaacttcaactgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccagttaaagctgaattggttcaagaaagggtcttccattggacaaatgtttgaaacgaccatgcggggtgccaagcgaatggctatactaggcgatacagcctgggacttcgggtcactcggaggcgtatttacaagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacagtataaatttcaacccgagagtccaagcaagttggcctccgctatccagaaagcccaggaagagggcatatgtggtattagatctgtcactaggctcgagaatctgatgtggaagcagatcacacccgaattaaaccacattctggcagagaatgaagttaaactaaccatcatgactggcgatataaaggggatcatgcaagccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaggacgcgttttgtgactctaagttaatgagcgctgccattaaggataatagggcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatccccaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaagctcattaccgagtggtgctgtagatcctgcacactgccgcctcttaggtatcgcggagaggacggctgttggtacggtatggaaatacggccattgaaagagaaggaagagaatctggtgaactcattagttacggcggggcacggacaggtggataatttcagtctcggcgtactgggtatggccctttttctggaagagatgttgagaaccagggtcggcactaaacatgctatcctcctggtggcagtgagcttcgtcacactaattaccgggaacatgtcgtttaaggacctgggacgcgttgtggtaatggtgggcgccactatggctgatgacatcgggatgggagtcacatatctcgccctgcttgcagcgttcaaagtgcgacccacctttgccgctggcttgctgttacggaagctcacgtccaaggagctgatgatgactaccattggtatcgttcttctgtctcaaagcacaatacctgaaaccgtgctagagctcactgatgccctggcattggggatgatggtcctgaaaatcgtgcgtaatatggaaaagtaccagttagctgttacaattatggccatcctctgcgtgcccaacgcagtcattctgcagaatgcctggaaagtatcatgtaccatccttgctgtggttagtgtgtccccactgttgctcacatctagccagcaaaagactgactggatacctctggcgctaaccattaaaggactgaaccccacggccatcttccttacaaccctctccagaactaataagaaaaggtcatggccactgaacgaggcaatcatggctgtcggcatggtgagcattttggccagttctctgttaaagaatgacataccgatgaccggccctctcgtagccgggggactgcttacagtgtgctatgtcctgactggtcgctccgctgatttggaactcgagcgggcaaccgacgttaagtgggaggatcaggccgaaatcagcggctcgtcacccattctgtctatcacgattagtgaggacgggtccatgagcatcaaaaacgaagaggaggaacagacactaaccatactgatcagaactggacttctcgtgatttctggcctgtttccaatcagcattcccatcacagcggctgcctggtacttgtgggaggtgaagaaacagagggccggtgtcttatgggatgtgccttccccaccccctatggggaaggccgaactggaggacggagcttatcgaataaaacaaaagggcattctcggctactcacagatcggggcaggagtttacaaggaaggtaccttccacactatgtggcatgtaacacgcggcgccgtgctgatgcacaaagggaagcggatcgagccgagttgggcggatgtcaaaaaggaccttattagctatggaggcggttggaaactggagggggaatggaaggagggagaagaggtgcaggttttggctctagaaccaggcaagaatcccagagccgtgcagaccaaacctggcctgtttaagacgaacactgggaccatcggagcagtctctctcgatttctccccaggtacatcaggcagtcccataattgacaaaaaggggaaagtggtaggactgtacggcaacggtgtcgtgaccaggagcggggcctatgtttccgctatcgcccaaacagagaagtctattgaggataatcctgaaatcgaggacgatatatttcgtaagcgccggcttactattatggacttacacccgggagcaggcaaaaccaagagatacctgcccgctatcgtgagggaagccatcaaacgaggcctccggacgttgattctggcgccaacacgcgtcgtggccgcagagatggaagaggctctcagagggctgcctatcaggtatcagactcccgccattcgggctgagcataccggacgagaaatagttgaccttatgtgtcacgcaacattcaccatgagactgttgtcgccagtgcgcgtccctaactacaatctaatcattatggatgaggcccatttcactgaccccgccagcatcgctgcgaggggttatatctcaacccgtgtggaaatgggcgaggcagccgggatttttatgacagctacgccaccgggatcccgggatcctttcccccagagtaacgccccaataatcgacgaggaaagagagattcccgaaaggtcttggaatagcggccacgagtgggtaactgattttaagggtaaaaccgtgtggttcgttccttccatcaaggcagggaacgacattgccgcttgcctgcgcaagaatggcaagaaggtcatccaactctcacgaaaaacatttgattctgaatacgtgaagaccagaactaacgactgggatttcgtggtcacaaccgacataagcgagatgggcgcgaattttaaagccgagcgggtaatcgatccaaggcgctgtatgaagcccgtgattttaacggacggcgaagaacgtgttatcctggcagggcctatgccggtgactcatagttccgctgcccagagacggggaaggattggtcgcaaccccaaaaatgaaaacgaccagtacatctatatgggcgagccccttgaaaatgatgaggactgcgcacactggaaggaggccaagatgctgctcgataacataaatacacctgaagggattatccccagcatgttcgagccagaacgagagaaagtcgacgctattgatggagaatacagattgcggggcgaggccaggaagacctttgtggacctgatgcgcagaggtgatctccctgtttggctggcgtataaagtggcagccgaggggatcaactacgctgacaggcggtggtgtttcgatggcataaagaacaatcagatccttgaagagaacgtcgaagtggagatttggaccaaagagggagaacgtaagaagctaaaaccccgctggctggacgcccgaatctattctgatccattggctttaaaggagtttaaagagttcgcagccggcagaaagtcactgactctcaatctgattacagagatggggaggcttcctaccttcatgacacagaaaactcgggacgctctggataacctcgccgtattgcacacggcagaagcgggaggtcgcgcctacaatcatgctctgtccgagctaccggagaccctggaaacactccttctgttaactttgctggccaccgtgacaggcgggatctttctcttcctgatgagtggaagaggcataggtaagatgacccttgggatgtgctgcattatcactgcaagcatcctgctctggtatgctcagattcagccccactggatcgccgcatcgataattttggagtttttcctgatcgttttactaattccagaacctgagaagcagaggacgccccaagacaaccagctgacctacgtcgtgatcgccatactcacagtggtcgctgcgactatggccaatgaaatgggctttcttgagaaaaccaagaaagacctgggattgggctctatcgcaacacagcagccagagtccaacattctggatatcgacctccggcctgctagcgcctggaccctgtacgccgttgcaactacattcgtgacgcccatgcttcgacattcaattgaaaatagttctgtaaacgtgtccctcaccgctatcgccaatcaagcgactgtcctgatggggttgggaaagggttggccgctgagcaaaatggatattggcgtgccattactagctatcgggtgttattcacaggttaaccctataacactgaccgccgcactccttctgttggtggcccactacgctattatcggacccggcctgcaggcaaaggccaccagagaggcgcagaagcgcgctgccgcaggtatcatgaaaaatccaacagtcgacgggattactgtaatagatctcgaccccatcccttatgatccgaagtttgaaaaacaactgggccaggtgatgcttttaattctgtgcgttacacaggtgctcatgatgaggaccacatgggccttgtgtgaggctctgactctagccaccggacccatcagtacactgtgggaaggcaacccagggcggttctggaataccactattgcagtcagcatggctaacatctttcgtggatcctacctcgccggcgcgggtcttctgttctctataatgaagaatacgacaaacaccagaagggggactggaaacatcggcgagaccttgggtgagaaatggaaaagccgcctgaatgccctcggcaaatccgaatttcaaatttataagaagtcagggatccaggaggtggaccggacactggcaaaagaaggaattaagcgaggcgagactgatcaccatgctgtctctagagggagtgccaaattaaggtggttcgtggagcgcaacatggttacccctgaaggaaaggtggtagaccttggctgcggtagagggggatggtcgtactattgtggcggtctgaaaaatgtgagagaggtcaagggcctcacaaaagggggacccggccacgaggaacctatcccaatgagcacgtacgggtggaacctagttcgtctgcagtccggagtggatgtctttttcataccccctgaaaaatgcgacaccttgctgtgtgatattggcgagtcttcaccaaatcccactgtggaggcaggtaggacactccgggtacttaacctggtggaaaattggttgaacaataacacccagttctgcatcaaggttctgaatccgtacatgcctagcgtgatcgagaaaatggaagctctccaacgcaagtatgggggagccttagtccgaaacccactgtccagaaatagtactcatgagatgtactgggtgtctaacgccagcggcaatattgtctcatccgtgaacatgataagtaggatgcttatcaaccggtttacaatgcgccacaaaaaggcgacctatgaacccgacgttgacctgggcagcgggacgagaaatattggaatcgagtctgagattcctaacctagatatcataggtaagaggatcgagaaaattaaggaggaacatgagacctcctggcactacgaccaggatcacccatataaaacatgggcttaccatggctcatatgaaactaagcagaccgggagcgcatcgtctatggtaaatggagtggtccgactcctgacaaaaccctgggacgtgttgccgactgttacccagatggccatgacagataccactcctttcggccaacagcgggtgtttaaggagaaggtcgacacgcgtacacaggagcccaaagaaggtaccaagaaactgatgaagatcactgctgagtggctctggaaagaacttgggaagaaaaagaccccaagaatgtgtacacgcgaggagttcacgaggaaggtgcggagtaacgccgcactgggagccatttttaccgatgaaaataaatggaagtccgctagagaggcggtagaagacagccgcttctgggagttagtggataaagaaaggaacctgcacttggagggcaagtgcgagacttgtgtttacaatatgatgggcaaacgagaaaagaagctcggggagtttggaaaagccaagggttcacgggcaatctggtacatgtggctgggcgctagattcctagaatttgaggcccttgggttcctgaacgaagaccattggttttccagggaaaattctctcagcggagtcgagggcgaaggtctgcacaaattggggtatattctgcgcgatgtgagtaagaaagagggaggcgcaatgtacgccgacgacacagctggctgggatacccgtataactctcgaagaccttaagaacgaggaaatggtgacaaatcacatggagggggagcataagaaactggccgaagcgatcttcaagttaacctatcagaacaaagtcgttcgggtgcaaagacctacacccaggggaactgtaatggatattatctcccgccgagaccagcggggtagcggccaggtggggacctacggactgaatacgtttaccaacatggaggcacaattgatcagacagatggaaggcgagggtgtcttcaagaatattcagcacctcacagtgactgaggaagccgctgttcagaactggctggccagggtggggcgcgagagactatctcggatggcaatatcaggagatgactgcgtcgtgaaaccacttgatgacaggttcgctaacgccctgaccgctctcaatgatatgggcaagatccgtaaggacattcaacagtgggaacccagtaaaggctggaacgattggacacaggtacctttttgctcccatcacttccatgagctgatcatgaaggacgggcgagttttggtggtcccatgtcgcaatcaggatgaattaattggtagagcacggatcagccaaggagcaggctggtctctgagggagactgcgtgcctcgggaaatcgtatgcccagatgtggtcacttatgtactttcaccgcagagacctgcggctagctgccaacgcaatatgtagcgctgtgccgtcccactgggtgcccaccagtaggacgacatggtctatccatgccaagcacgagtggatgaccactgaagacatgctgacagtctggaatcgagtttggattcgtgagaacccttggatggaagataaaaccccagtggagagctgggaagagatcccctatctcggaaagagagaggaccagtggtgcggctccttgattggtctgacttcacgcgcaacctgggccaagaatatccaggcggctataaaccaagtacggagtcttattgggaatgaagagtacacagattacatgccttctatgaaaaggttcagacgcgaagaggaagaggccggagtgctgtggtga

SEQ ID NO: 14443 - RNA, 9876 nt, synthetic construct
  misc_feature 1..9876: note = derived and/or modified CDS sequence (opt3) from DENV-2__FJ639717__SS-prME
  source 1..9876: mol_type = other RNA
agcgcaggaatgatcattatgctgatccccaccgtgatggctttccacctcaccactagaaacggggagcctcatatgatcgtcggcattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagcactggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggctctcattttcatcctgctgactgcagtggccccatctatgacaatgcgctgcatagggatttcgaacagagattttgttgaaggagtgtcaggtggcagctgggtcgacatcgtgctcgagcacgggagttgtgtaaccactatggctaagaataagcccacattagatttcgaactgattaaaaccgaggccaagcagcctgcgacgcttaggaaatattgcatcgaagcaaagttgaccaacacaactaccgagtcccggtgtccaacacaaggagagccctctctgaaagaggaacaggacaagcgctttgtttgcaagcatagcatggtggatcgaggctggggtaatgggtgtggactattcggcaaaggcgggatcgtcacttgcgccatgtttacctgcaagaaaaacatggaaggaaagattgtgcagcctgagaatctcgaatacacaatagtggtcaccccacactccggtgaggagcatgctgttggcaacgacactgggaaacacggaaaggaaatcaaagtgacgccgcagtcaagtattacagaggccgaactgaccggctatggtactgtaaccatggagtgtagccccagaacagggcttgatttcaatgaaatggtgctgttgcaaatggagtctaaggcatggctcgtccacaggcagtggtttctggacttacctctgccatggctccccggcgctgataagcagggatccaactggatccagaaagagacccttgtgactttcaagaatcctcatgccaaaaagcaagacgttgtggtcctgggctcacaggaaggggcgatgcacacagccttgacgggagcaaccgagatacagatgagcagtggtaacctactgtttactggccatctcaaatgccggctgcgtatggacaaacttcaactgaaggggatgtcttactccatgtgtacaggaaaattcaaggtggtaaaagaaattgctgagacccagcacggcacaatcgttatccgcgtgcagtatgagggtgatgggagcccatgcaagattcccttcgaaatcatggacttggagaaaagatacgtcctcggcaggctgattactgtgaatccgatagtcaccgaaaaggattcgcctgtgaacatcgaggccgaacccccatttggagactcttacattatcatcggcgttgagcctgggcagttaaagctgaactggttcaaaaagggatcctcaattggtcaaatgtttgagacgaccatgcggggcgctaaacgaatggccatactaggggatacagcatgggacttcggaagtctcggcggtgtgtttactagcatcgggaaggccctgcatcaggtattcggcgctatttatggagcggcattttccggcgtctcttggaccatgaaaatccttattggggtgatcataacatggatcggaatgaatagccgctcaacaagtttgtccgttagcctggtgctcgtcggcattgtgaccctgtaccttggtgtaatggtgcaggccgattctgggtgtgttgtctcatggaagaacaaggaactgaaatgcggaagtggcatcttcattacggacaatgtgcacacatggaccgagcagtataagtttcaacccgaaagcccatccaaattggcttctgccatccagaaggcacaggaggaaggtatatgtggcattagatcggtgactaggctcgagaacctgatgtggaaacagatcacacccgagttaaatcacattctggccgaaaacgaggtcaagctaaccatcatgactggggatataaaaggaatcatgcaagctggcaagcggagcctccgccctcagccaaccgaactgaagtactcctggaaaacatgggggaaggccaaaatgctttcaacggagagtcataatcagaccttcttgattgacggaccggaaactgcagagtgccccaacacaaatagagcgtggaactctctggaggttgaagattatggctttggtgtgttcaccacaaatatctggctcaagctgaaagagaagcaggacgctttttgtgacagcaagttaatgtccgccgcaattaaagataacagggccgtgcacgctgacatggggtactggatcgaatcagccctgaatgatacttggaagatagagaaagccagcttcattgaggtaaagaactgccattggcctaaatctcacaccctttggtccaatggagtcttggaaagtgagatgatcatcccaaagaacctcgctggccccgtgagccaacacaactatcgtcctggttaccatacgcagacagccggcccatggcacctggggaagctagaaatggacttcgatttttgtgacggaaccactgttattgtgaccgaggattgcggcaatcgggggccctctctgcgaacaactaccgcgtccggaaaactcatcacagaatggtgctgtagatcatgcacgctgccgcctcttaggtaccgcggcgaggacggttgttggtatgggatggagattcggccattgaaggaaaaagaggaaaacctggtcaatagtttagtgaccgccggacatggccaggttgataacttcagcctcggtgtgctgggcatggctctttttctggaggaaatgttgagaactagggtagggacaaagcacgcaatactcctggtcgccgtgtcgttcgtgaccctaatcactggaaatatgtcctttaaagacctgggccgcgtcgttgtgatggtagggacaaccatgacggatgacattggaatgggcgtgacttacctcgctctgcttgccgcattcaaggtccgacccacctttgcggccggtttgctgttacggaagctcacatctaaagagctgatgatgaccactatcgggattgtgcttctgagccaatcaacaatccctgagaccatactagaactcacagatgctctggccttgggaatgatggttctgaagatcgtgcgtgacatggagaaatatcagttagcagtcactattatggctatcctctgcgtgcccaacgccgttattctgcagaatgcatggaaggtgagttgtaccatccttgccgtcgtatccgtgtctccactgttgctcacgagctcccagcaaaagactgactggatacctctggctctaaccattaagggcctgaaccccactgcgatcttccttaccacactctcaagaactaataaaaagaggagctggccactgaacgaagccatcatggcagttggcatggtgagtattttggcttcttccctgttaaagaatgatataccgatgaccgggcctctcgtcgccggaggtctgcttacggtgtgctacgtactgacaggccgcagcgccgacttggagctcgaacgggctaccgatgtgaaatgggaggaccaggcagagatctcggggtcatctcccattctgagtatcactatttccgaagatggaagcatgtctatcaagaacgaggaagaggagcagacactaaccatactgatcagaactggccttctcgtcattagcggtctgtttccagtttccatccccattacagccgcggcttggtatttgtgggaagtgaaaaagcagagggccggggtgttatgggacgtcccttcaccaccccctatgggaaaagcagagctggaagatggcgcctaccgaatcaagcaaaagggcatactcgggtatagtcagattggagctggtgtgtacaaagagggcaccttccatacgatgtggcacgttactcgcggggcagtactgatgcacaagggaaaacggatcgaaccgagctgggccgacgtgaagaaagatcttatctcttacggcggtgggtggaagctggagggagagtggaaggaaggcgaggaagtccaggtgttggcgctagagccaggcaaaaatcccagagctgttcagaccaagcctgggctgtttaaaacaaacaccggaacaattggtgccgtgtccctcgacttctcaccaggcacaagtgggagccccatcatagataagaaaggaaaggtcgtgggcctgtatggtaatggggtagtcaccaggtccggagcatacgtgtctgccattgctcaaacggaaaagtcgatcgaggacaaccctgagattgaagatgacatctttcgtaaacgccggcttacaataatggacttacatccgggcgccggcaagactaaaagatatctgcccgcaattgttagggaggctatcaagcgagggctccggaccttgatcctggccccaacacgcgtggtcgcggccgaaatggaggaagcactcagaggactgcctattaggtaccagacccccgctatccgggccgagcacactggtcgagagattgtggatcttatgtgtcatgctaccttcacaatgagactgttgagcccagttcgcgtgcctaactataatctaataatcatggacgaagcacacttcacggatcccgcctcaattgccgctaggggctacatctccactcgtgtcgagatgggggaagcggcaggaatctttatgaccgccacaccaccgggcagtcgggaccctttcccccagtctaacgctccaattatagatgaggagagagaaatccccgagaggagctggaataccggtcatgaatgggtgactgactttaaagggaagacagtatggttcgtgccttccattaaggccggaaacgatatcgcagcctgcctgcgcaaaaatggcaagaaagttattcaactctcacgaaagacctttgactctgagtatgtcaaaacgagaactaacgattgggacttcgtggtgacaaccgatatcagcgaaatgggcgctaattttaaggcggagcgggtcatagacccaaggcgctgtatgaaacccgtaatcttaaccgacggggaggaacgtgtgattctggccggacctatgccggttactcacagttccgcagctcagagacggggtaggatcggccgcaacccaaagaatgagaacgatcagtacatttacatgggggaaccccttgagaatgacgaagattgcgcccactggaaggaggcaaaaatgctgctcgacaacatcaatacacctgagggaataattcccagcatgttcgaaccagagcgagaaaaggtggatgccatcgacggcgagtatagattgcggggtgaagctaggaaaacctttgtcgatctgatgcgcagaggggacctccctgtgtggctggcctacaaggttgcggcagagggcattaactatgccgataggcggtggtgtttcgacggaatcaaaaataaccagatacttgaggaaaacgtggaggtcgaaatctggacaaaggagggcgagcgtaagaaactaaagccccgctggctggatgctcgaatttactctgacccattggccttaaaagaatttaaggagttcgctgcagggagaaaatcactgactctcaatctgatcacggaaatgggaaggcttcctaccttcatgacacaaaagactcgggatgccctggacaacctcgctgtgttgcataccgccgaggcgggtggacgcgcatataatcacgccctgtccgaactaccggagacactggagaccctccttctgttaactttgctggctacggtaaccgggggaatttttctcttcctgatgagtggcagaggtatcgggaagatgacacttggcatgtgctgcataattactgccagcgtgctgctctggtacgcacagatccagccccattggatcgctgcctcgattatcttggaatttttcctgatagttttactaattccagagcctgaaaaacagaggacaccccaagacaaccagctgacatatgtcgtgatcgcaattctcaccgtggtcgccgctactatggcgaatgagatgggatttcttgaaaagactaaaaaggatctgggcttggggtctatcgccacgcagcagccagagtccaacatactggacatcgatctccggcctgcaagcgcttggaccctgtacgccgttgccactacattcgtgacccccatgcttcgacactcaattgagaatagttctgtaaacgtgtccctcaccgcaatcgctaatcaagccacagtcctgatgggattgggtaaaggctggccgctgagcaagatggacattggggtgccattactagcgatcggatgttactcacaggttaaccctattactctgacggctgccctccttctgttggtggcacactatgccatcataggccccggtctgcaggctaaggcaaccagagaagcccagaaacgcgcggctgccgggattatgaagaatccaacagtcgatggcatcactgtaatcgacctcgatcccattccttacgacccgaaatttgagaagcaactgggacaggtgatgcttttaatactgtgcgttacccaggtgctcatgatgaggacaacctgggcattgtgtgaagccctgactctagctacgggccccatcagtacactgtgggaggggaacccaggacggttctggaataccactattgccgtcagcatggcaaacatctttcgtggctcctatctcgctggtgccgggcttctgttctctattatgaaaaataccacaaacactagaaggggaaccggcaatatcggtgaaacattgggcgagaagtggaaaagccgcctgaacgcgctcgggaagtccgagtttcaaacgtacaagaaatcaggaatacaggaagtggatcggaccctggccaaggagggcatcaaacgaggggaaactgaccatcacgcagtctctagaggaagtgctaagttaaggtggttcgtggagcgcaacatggttacacctgagggcaaagtggtagatcttggttgcgggcggggaggctggtcgtattactgtggtggcctgaagaatgtgagagaagtcaaggggctcaccaaaggaggccccgggcatgaggaacctattccaatgagcacttatggatggaacctagttcgtctgcagtccggcgtggacgtctttttcataccccctgagaagtgcgatacattgctgtgtgacattggtgaatcttcaccaaatcccaccgtggaggccgggaggacgctccgggtacttaacctggtggagaattggttgaacaataacacccagttctgcatcaaagttctgaatccgtacatgcctagcgtgatagaaaagatggaggcactccaacgcaaatacggaggcgctttagtccgaaacccactgtccagaaatagtacacacgaaatgtattgggtgtctaacgccagcggcaatattgtctcatccgtgaacatgatcagtaggatgcttatcaatcggtttactatgcgccataagaaggccacctacgagcccgacgttgatctggggagcggaacaagaaacattggtatagaatctgagatccctaacctagacattatcggcaaaaggattgagaagatcaaacaggaacacgagacttcctggcactatgatcaggaccatccatacaagacctgggcgtatcacgggtcatacgaaacaaaacagaccggaagcgcttcgtctatggtaaatggcgtggtccgactcctgactaagccctgggatgtgttgccgacggttacacaaatggcaatgaccgacactacccctttcggtcagcagcgggtgtttaaggagaaagtcgatacacgtacgcaggaacccaaggaggggaccaaaaagctgatgaaaataactgccgagtggctctggaaggaacttggcaaaaagaagacaccaagaatgtgtacccgcgaggagttcactaggaaagtgcggagtaacgctgccctgggcgcaatctttacagacgagaataagtggaaatccgccagagaggctgtagaagatagccgcttctgggagttagtggacaaggaaaggaacctgcatttggagggcaaatgcgaaacctgtgtttataatatgatggggaagcgagagaagaaactcggagagtttggtaaggcgaaaggctcacgggccatttggtacatgtggctgggggcaagattcctagaatttgaggctcttggattcctgaacgaagatcactggttttccagggaaaattctctcagcggcgtcgaaggtgaggggctgcacaagttgggatacatcctgcgcgacgtgagtaaaaaggagggcggcgccatgtatgcagacgatacagccgggtgggacactcgtattaccctcgaagatcttaagaacgaggaaatggtgacgaatcatatggagggagaacacaaaaagctggctgaggccatcttcaaattaacctaccaaaacaaggtcgttcgggtgcagagacctacacccaggggtactgtaatggacattatatcccgccgagatcagcggggcagcgggcaagtgggaacctatggcctgaatacatttactaacatggaggcgcagttgatcagacagatggaaggtgagggggtcttcaaaaatattcagcatctcaccgcaacggaagaggtggccgttcaaaactggctggctagggtgggacgcgagagactatctcggatggccatctcaggcgacgattgcgtcgtgaagccacttgacgataggttcgcaaatgctctgacagccctcaacgacatgggcaagatccgtaaagatattcagcagtgggaacccagtaaggggtggaacgactggacccaggtacctttttgctcccaccatttccacgagctgataatgaaagatggacgagttttggtggtcccatgtcgcaatcaagacgaattaatcggtagagctcggattagccagggcgccgggtggtctctgagggagactgcatgcctcggaaagtcgtacgcgcagatgtggtcacttatgtattttcaccgcagagacctgcggctagccgctaacgccatctgtagcgcagtgccgtcccattgggtgcccacaagtaggaccacttggtctattcacgctaaacatgaatggatgaccacagaggatatgctgacggtctggaatcgagtttggatccgtgagaacccttggatggaagacaagaccccagtggagagctgggaagagataccctacctcggcaagagagaagatcagtggtgcggttccttgatcgggctgacttcacgcgccacatgggccaaaaatattcaagccgcgatcaaccaggtacggagtcttattggaaatgaggagtataccgactacatgccttctatgaagaggttcagacgcgaagaggaagaggctggcgtgctgtggtga

SEQ ID NO: 14444 - RNA, 9876 nt, synthetic construct
  misc_feature 1..9876: note = derived and/or modified CDS sequence (opt3) from DENV-2__FJ639718__SS-prME
  source 1..9876: mol_type = other RNA
agcgccggcatgatcattatgctgatacccaccgtgatggctttccacctcacaactagaaacggggagcctcatatgatcgtcggaattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagagcaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaatggaaatcaaggtaacgccgcagtcaagtattacagaggctgaactgaccggctatggtactgtgaccatggagtgtagccccagaacagggcttgatttcaatgaaatggtcctgttgcaaatggagaacaaagcctggctcgtgcacaggcagtggtttctggacttacctctgccatggctccccggcgcagataagcaggagtctaattggatccagaaggaaacccttgttactttcaaaaaccctcatgctaagaaacaagacgtggtcgtgctgggatcccaggagggcgccatgcacacagcgttgacgggggccaccgaaatacagatgtcaagcggaaatctactgtttactggtcatctcaagtgccggctgcgtatggacaaacttcaactgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccagttaaagctgaattggttcaagaaagggtcttccattggacaaatgtttgaaacgaccatgcggggtgccaagcgaatggctatactaggcgatacagcctgggacttcgggtcactcggaggcgtatttactagtatcggtaaagcactgcatcaggtcttcggggccatttatggcgctgcgtttagcggagtgtcctggaccatgaagatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacagtataaatttcaacccgagagtccaagcaagttggcctccgctatccagaaagcccaggaagagggcatatgtggtattagatctgtcactaggctcgagaatctgatgtggaagcagatcacacccgaattaaaccacattctggcagagaatgaagttaaactaaccatcatgactggcgatataaaggggatcatgcaagccggaaaacggtcgctccgccctcagccaaccgagctgaagtacagctggaagacatggggcaaagctaagatgctttccacggaatcatataaccagaccttcttgattgacgggccggagactgccgagtgccccaatacaaacagagcatggaatagtctggaagtggaggattacggatttggcgtgttcaccacaaacatctggctcaaactgaaggaaaaacaggacgcgttttgtgactctaagttaatgagcgctgccattaaggataatagggcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatcccaaaaaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaagctcattaccgagtggtgctgtagatcctgcacactgccgcctcttaggtatcgcggagaggacggctgttggtacggtatggaaatacggccattgaaagagaaggaagagaatctggtgaactcattagttacggcggggcacggacaggtggataatttcagtctcggcgtactgggtatggccctttttctggaagagatgttgagaaccagggtcggcactaaacatgctatcctcctggtggcagtgagcttcgtcacactaattaccgggaacatgtcgtttaaggacctgggacgcgttgtggtaatggtgggcgccactatggctgatgacatcgggatgggagtcacatatctcgccctgcttgcagcgttcaaagtgcgacccacctttgccgctggcttgctgttacggaagctcacgtccaaggagctgatgatgactaccattggtatcgttcttctgtctcaaagcacaatacctgaaaccgtgctagagctcactgatgccctggcattggggatgatggtcctgaaaatcgtgcgtaatatggaaaagtaccagttagctgttacaattatggccatcctctgcgtgcccaacgcagtcattctgcagaatgcctggaaagtatcatgtaccatccttgctgtggttagtgtgtccccactgttgctcacatctagccagcaaaagactgactggatacctctggcgctaaccattaaaggactgaaccccacggccatcttccttacaaccctctccagaactaataagaaaaggtcatggccactgaacgaggcaatcatggctgtcggcatggtgagcattttggccagttctctgttaaagaatgacataccgatgaccggccctctcgtagccgggggactgcttacagtgtgctatgtcctgactggtcgctccgctgatttggaactcgagaaggcaaccgacgttaaatgggaggatcaggccgaaatcagcggctcgtcacccattctgtctatcacgattagtgaggacgggtccatgagcatcaagaacgaagaggaggaacagacactaaccatactgatccggactggacttctcgtgatttctggcctgtttccaatcagcattcccatcacagcggctgcctggtacttgtgggaggtgaaaaagcagagagcaggtgtcttatgggatgtgccttccccaccccctatggggaaagccgaactggaggacggagcttataggataaagcaaaagggcattctcggctactcacagatcggggcaggagtttacaaagaaggtaccttccacactatgtggcatgtaacacgaggcgccgtgctgatgcacaaggggaaacgcatcgagccgagttgggcggatgtcaagaaagaccttattagctatggaggcggttggaagctggagggggaatggaaggagggagaagaggtgcaggttttggctctagaaccaggcaaaaatccccgggccgtgcagaccaagcctggcctgtttaaaacgaacactgggaccatcggagcagtctctctcgatttctccccaggtacatcaggcagtcccataattgacaagaaagggaaggtggtaggactgtacggcaacggtgtcgtgaccagaagcggggcctatgtttccgctatcgcccaaacagagaagtctattgaggataatcctgaaatcgaggacgatatatttaggaaacgtcgccttactattatggacttacacccgggagcaggcaagaccaaacggtacctgcccgctatcgtgagagaagccatcaagaggggcctccgaacgttgattctggcgccaacacgggtcgtggccgcagagatggaagaggctctccgcgggctgcctatcagatatcagactcccgccattagggctgagcataccggacgggaaatagttgaccttatgtgtcacgcaacattcaccatgcgactgttgtcgccagtgagagtccctaactacaatctaatcattatggatgaggcccatttcactgaccccgccagcatcgctgcgcgcggttatatctcaaccagggtggaaatgggcgaggcagccgggatttttatgacagctacgccaccgggatcccgtgatcctttcccccagagtaacgccccaataatcgacgaggaacgggagattcccgaaagatcttggaatagcggccacgagtgggtaactgattttaaaggtaagaccgtgtggttcgttccttccatcaaggcagggaacgacattgccgcttgcctgaggaaaaatggaaagaaagtcatccaactctcacgcaagacatttgattctgaatacgtgaaaacccgaactaacgactgggatttcgtggtcacaaccgacataagcgagatgggcgcgaattttaaggccgagagagtaatcgatccacggaggtgtatgaaacccgtgattttaacggacggcgaagagcgcgttatcctggcagggcctatgccggtgactcatagttccgctgcccagcgtagaggacggattggtaggaacccaaagaatgaaaacgaccagtacatctatatgggcgagccccttgaaaatgatgaggactgcgcacactggaaggaggccaaaatgctgctcgataacataaatacacctgaagggattatccccagcatgttcgagccagaacgcgagaaggtcgacgctattgatggagaataccgattgagaggcgaggcccggaaaacctttgtggacctgatgaggcgcggtgatctccctgtttggctggcgtataaggtggcagccgaggggatcaactacgctgacagaaggtggtgtttcgatggcataaaaaacaatcagatccttgaagagaacgtcgaagtggagatttggaccaaggagggagaacggaagaaactaaagccccgttggctggacgcccgcatctattctgatccattggctttaaaagagtttaaggaattcgcagccggccgaaaatcactgactctcaatctgattacagagatggggagacttcctaccttcatgacacaaaagactagggacgctctggataacctcgccgtattgcacacggcagaagcgggaggtcgggcctacaatcatgctctgtccgagctaccggagaccctggaaacactccttctgttaactttgctggccaccgtgacaggcgggatctttctcttcctgatgagtggacgcggcataggtaagatgacccttgggatgtgctgcattatcactgcaagcatcctgctctggtatgctcagattcagccccactggatcgccgcatcgataattttggagtttttcctgatcgttttactaattccagaacctgagaaacagagaacgccccaagacaaccagctgacctacgtcgtgatcgccatactcacagtggtcgctgcgactatggccaatgaaatgggctttcttgagaagaccaaaaaggacctgggattgggctctatcgcaacacagcagccagagtccaacattctggatatcgacctcaggcctgctagcgcctggaccctgtacgccgttgcaactacattcgtgacgcccatgcttcggcattcaattgaaaatagttctgtaaacgtgtccctcaccgctatcgccaatcaagcgactgtcctgatggggttgggaaaaggttggccgctgagcaagatggatattggcgtgccattactagctatcgggtgttattcacaggttaaccctataacactgaccgccgcactccttctgttggtggcccactacgctattatcggacccggcctgcaggcaaaggccacccgagaggcgcagaaaagagctgccgcaggtatcatgaagaatccaacagtcgacgggattactgtaatagatctcgaccccatcccttatgatccgaaatttgaaaagcaactgggccaggtgatgcttttaattctgtgcgttacgcaggtgctcatgatgcgcaccacatgggccttgtgtgaggctctgactctagccaccggacccatcagtacactgtgggaaggcaacccagggaggttctggaataccactattgcagtcagcatggctaacatctttcggggatcctacctcgccggcgcgggtcttctgttctctataatgaaaaatacgacaaacacccgtagagggactggaaacatcggcgagaccttgggtgagaagtggaaaagcaggctgaatgccctcggcaagtccgaatttcaaatttataagaaatcagggatccaggaggtggaccgcacactggcaaaggaaggaattaaacggggcgagactgatcaccatgctgtctctcgagggagtgccaagttaagatggttcgtggagaggaacatggttacccctgaaggaaaagtggtagaccttggctgcggtcgcgggggatggtcgtactattgtggcggtctgaagaatgtgcgggaggtcaagggcctcacaaaagggggacccggccacgaagagcctatcccaatgagcacgtacgggtggaacctagttagactgcagtccggagtggatgtctttttcataccccctgaaaagtgcgacaccttgctgtgtgatattggcgagtcttcaccaaatcccactgtggaggcaggtcgtacactcagggtacttaacctggtggaaaattggttgaacaataacacccagttctgcatcaaagttctgaatccgtacatgcctagcgtgatcgagaagatggaagctctccaacggaaatatgggggagccttagtccgcaacccactgtcccgaaatagtactcatgagatgtactgggtgtctaacgccagcggcaatattgtctcatccgtgaacatgataagtagaatgcttatcaacaggtttacaatgcggcacaagaaggcgacctatgaacccgacgttgacctgggcagcgggacgcgcaatattggaatcgagtctgagattcctaacctagatatcataggtaaaagaatcgaaaagattaaagaggaacatgagacctcctggcactacgaccaggatcacccatataagacatgggcttaccatggctcatatgaaactaaacagaccgggagcgcatcgtctatggtaaatggagtggtcaggctcctgacaaagccctgggacgtgttgccgactgttacccagatggccatgacagataccactcctttcggccaacagcgagtgtttaaggagaaagtcgacacgcggacacaggagcccaaggaaggtaccaaaaagctgatgaaaatcactgctgagtggctctggaaggaacttgggaaaaagaagaccccacgtatgtgtacaagagaggagttcacgcgcaaagtgaggagtaacgccgcactgggagccatttttaccgatgaaaataagtggaaatccgctcgggaggcggtagaagacaacagattctgggagttagtggataaggaacgcaatctgcacttggagggcaaatgcgagacttgtgtttacaacatgatgggcaagagggaaaagaaactcggggagtttggaaaggccaaaggtagccgagcaatctggtacatgtggctgggcgctcggttcctagaatttgaggcccttgggttcctgaatgaagaccattggttttcaagagagaactccctctctggagtcgagggcgaaggtctgcacaagttggggtatattctgagggatgtgagcaaaaaggagggaggcgcaatgtacgccgacgacacagctggctgggatacccgcataactctcgaagaccttaagaatgaggaaatggtgacaaaccacatggagggggagcataaaaagctggccgaagcgatcttcaaattaacctatcagaataaggtcgttcgtgtgcaacggcctacacccagaggaactgtaatggatattatcagtaggcgcgaccagcgaggttccggccaggtggggacctacggactgaacacgtttaccaatatggaggcacaattgatccggcagatggaaggcgagggtgtcttcaaaaacattcagcacctcacagtgactgaggaagccgctgttcagaactggctggccagagtggggagggagcgcctaagcagaatggcaatatctggagatgactgcgtcgtgaagccacttgatgaccggttcgctaatgccctgaccgctctcaacgatatgggcaagatcaggaaagacattcaacagtgggaaccctcaaagggctggaatgattggacacaggtacctttttgcagtcatcacttccatgagctggttatgaaagacgggcgtgtgttggtcgtgccatgtcgaaaccaggatgaattaatcggacgcgccagaatttcccaaggtgcaggctggagcctgcgggagactgcgtgcctcgggaagtcttatgcccagatgtggtcgcttatgtactttcacaggcgcgacctgagactagctgccaatgcaatctgttcagctgtgccgagccactgggtccccacctcccggacgacatggagtatacatgccaaacacgagtggatgaccactgaagacatgctgacagtttggaacagggtgtggatccgagagaatccttggatggaagataagaccccagtagagtcttgggaagagattccctatctcggaaagcgtgaggaccagtggtgcggcagcttgatcggtctgacttccagagcaacctgggccaaaaacattcaggcggctatcaatcaagtgcgctcacttatagggaacgaagagtacacagattacatgcctagtatgaagcggttcaggagagaagaggaagaggccggagtcctgtggtga

SEQ ID NO: 14445 - RNA, 9876 nt, synthetic construct
  misc_feature 1..9876: note = derived and/or modified CDS sequence (opt3) from DENV-2__GQ868625__SS-prME
  source 1..9876: mol_type = other RNA
agcgccggcatgatcattatgctgatacccaccgtgatggctttccacctcacaactagaaacggggagcctcatatgatcgtcggaattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagagcaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaatggaaatcaaggtaacgccgcagtcaagtattacagaggctgaactgaccggctatggtactgtgaccatggagtgtagccccagaacagggcttgatttcaatgaaatggtcctgttgcaaatggagaacaaagcctggctcgtgcacaggcagtggtttctggacttacctctgccatggctccccggcgcagataagcaggagtctaattggatccagaaggaaacccttgttactttcaaaaaccctcatgctaagaaacaagacgtggtcgtgctgggatcccaggagggcgccatgcacacagcgttgacgggggccaccgaaatacagatgtcaagcggaaatctactgtttactggtcatctcaagtgccggctgcgtatggacaaacttcaactgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccagttaaagctgaattggttcaagaaagggtcttccattggacggatgtttgaaacgaccatgcgaggtgccaagcgcatggctatactaggcgatacagcctgggacttcgggtcactcggaggcgtatttactagtatcggtaaagcactgcatcaagtcttcggggccatttatggcgctgcgtttagcggagtgtcctggaccatgaagatccttattggcgttatcataacatggatcgggatgaactctagaagcacttcattgagtgtgtccctggtcctcgtgggaattgtaaccctgtaccttggcgtgatggttcaggcagatagcggttgtgtcgtgtcttggaaaaataaggagctgaagtgcgggtcaggaatcttcattacggacaacgtgcacacatggaccgaacagtataaatttcagcccgagagtccaagcaagttggcctccgctatccaaaaagcccaggaagagggcatatgtggtattaggtctgtcactcggctcgagaatctgatgtggaagcagatcacacccgaattaaaccacattctggcagagaatgaagttaaactaaccatcatgactggcgatataaaggggatcatgcaggccggaaaacgctcgctcagacctcaaccaaccgagctgaagtacagctggaagacatggggcaaagctaagatgctttccacggaatcatataaccagaccttcttgattgacgggccggagactgccgagtgccccaatacaaacagggcatggaatagtctggaagtggaggattacggatttggcgtgttcaccacaaacatctggctcaaactgaaggaaaaacaggacgcgttttgtgactctaagttaatgagcgctgccattaaggataatcgtgcagtacatgccgacatgggttattggatcgagtccgctctgaacgatacttggaaaatagagaaggcctcattcattgaagtcaaaaattgccactggcctaagagccataccctttggtctaacggggtgttggagtccgaaatgatcatcccaaaaaacctcgcaggacccgttagtcagcacaattaccggcctggctaccacacgcaaattgctggtccatggcatctgggcaagctagagatggacttcgatttttgtgacgggacaaccgtgatcgtcactgaagattgcggaaaccgaggccccagcctgagaaccacaactgcctctgggaagctcattaccgagtggtgctgtaggtcctgcacactgccgcctcttcgctatcggggagaggacggctgttggtacggtatggaaataagaccattgaaagagaaggaagagaatctggtgaactcattagttacggcggggcacggacaggtggataatttcagtctcggcgtactgggtatggccctttttctggaagagatgttgaggacccgcgtcggcactaaacatgctatcctcctggtggcagtgagcttcgtcacactaattaccgggaacatgtcgtttaaggacctgggacgagttgtggtaatggtgggcgccactatggctgatgacatcgggatgggagtcacatatctcgccctgcttgcagcgttcaaagtgcggcccacctttgccgctggcttgctgttacgtaagctcacgtccaaggagctgatgatgactaccattggtatcgttcttctgtctcagagcacaatacctgaaaccgtgctagagctcactgatgccctggcattggggatgatggtcctgaaaatcgtgagaaatatggaaaagtaccaattagctgttacaattatggccatcctctgcgtgcccaacgcagtcattctgcagaatgcctggaaagtatcatgtaccatccttgctgtggttagtgtgtccccactgttgctcacatctagccagcagaagactgactggatacctctggcgctaaccattaaaggactgaaccccacggccatcttccttacaaccctctccaggactaataagaaacgctcatggccactgaacgaggcaatcatggctgtcggcatggtgagcattttggccagttctctgttaaagaatgacataccgatgaccggccctctcgtagccgggggactgcttacagtgtgctatgtcctgactggtcggtccgctgatttggaactcgagagagcaaccgacgttaagtgggaggatcaagccgaaatcagcggctcgtcacccattctgtctatcacgattagtgaggacgggtccatgagcatcaaaaacgaagaggaggaacagacactaaccatactgatcaggactggacttctcgtgatttctggcctgtttccaatcagcattcccatcacagcggctgcctggtacttgtgggaggtgaagaaacagcgagcaggtgtcttatgggatgtgccttccccaccccctatggggaaggccgaactggaggacggagcttatcgcataaaacagaagggcattctcggctactcacaaatcggggcaggagtttacaaggaaggtaccttccacactatgtggcatgtaacacggggcgccgtgctgatgcacaaagggaagagaatcgagccgagttgggcggatgtcaaaaaggaccttattagctatggaggcggttggaaactggagggggaatggaaggagggagaagaggtgcaggttttggctctagaaccaggcaagaatcccagggccgtgcagaccaaacctggcctgtttaagacgaacactgggaccatcggagcagtctctctcgatttctccccaggtacatcaggcagtcccataattgacaaaaaggggaaagtggtaggactgtacggcaacggtgtcgtgacccgtagcggggcctatgtttccgctatcgcccagacagagaagtctattgaggataatcctgaaatcgaggacgatatatttcgcaagcggagacttactattatggacttacacccgggagcaggcaaaaccaagaggtacctgcccgctatcgtgcgagaagccatcaaacggggcctccgcacgttgattctggcgccaacaagagtcgtggccgcagagatggaagaggctctcagggggctgcctatccggtatcaaactcccgccattcgagctgagcataccggaagagaaatagttgaccttatgtgtcacgcaacattcaccatgcgcctgttgtcgccagtgagggtccctaactacaatctaatcattatggatgaggcccatttcactgaccccgccagcatcgctgcgcgtggttatatctcaacccgggtggaaatgggcgaggcagccgggatttttatgacagctacgccaccgggatccagagatcctttcccccagagtaacgccccaataatcgacgaggaaagggagattcccgaacgctcttggaatagcggccacgagtgggtaactgattttaagggtaaaaccgtgtggttcgttccttccatcaaggcagggaacgacattgccgcttgcctgcgaaagaatggaaaaaaggtcatccagctctcaagaaaaacatttgattctgaatacgtgaagacccggactaacgactgggatttcgtggtcacaaccgacataagcgagatgggcgcgaattttaaagccgagagggtaatcgatccacgccgttgtatgaagcccgtgattttaacggacggcgaagagagagttatcctggcagggcctatgccggtgactcatagttccgctgcccaacggaggggacgcattggtcgaaacccaaaaaatgaaaacgaccagtacatctatatgggcgagccccttgaaaatgatgaggactgcgcacactggaaggaggccaagatgctgctcgataacataaatacacctgaagggattatccccagcatgttcgagccagaaagagagaaagtcgacgctattgatggagaataccggttgaggggcgaggcccgcaagacctttgtggacctgatgagaaggggtgatctccctgtttggctggcgtataaagtggcagccgaggggatcaactacgctgaccggcgttggtgtttcgatggcataaagaacaatcagatccttgaagagaacgtcgaagtggagatttggaccaaagagggagaacgcaagaagctaaaaccccgatggctggacgccagaatctattctgatccattggctttaaaggagtttaaagaattcgcagccggcaggaagtcactgactctcaatctgattacagagatggggcggcttcctaccttcatgacacagaaaactcgcgacgctctggataacctcgccgtattgcacacggcagaagcgggaggtagagcctacaatcatgctctgtccgagctaccggagaccctggaaacactccttctgttaactttgctggccaccgtgacaggcgggatctttctcttcctgatgagtggaaggggcataggtaagatgacccttgggatgtgctgcattatcactgcaagcatcctgctctggtatgctcaaattcagccccactggatcgccgcatcgataattttggagtttttcctgatcgttttactaattccagaacctgagaagcagcggacgccccaggacaaccaactgacctacgtcgtgatcgccatactcacagtggtcgctgcgactatggccaatgaaatgggctttcttgagaaaaccaagaaagacctgggattgggctctatcgcaacacagcagccagagtccaacattctggatatcgacctccgacctgctagcgcctggaccctgtacgccgttgcaactacattcgtgacgcccatgcttagacattcaattgaaaatagttctgtaaacgtgtccctcaccgctatcgccaatcaggcgactgtcctgatggggttgggaaagggttggccgctgagcaaaatggatattggcgtgccattactagctatcgggtgttattcacaagttaaccctataacactgaccgccgcactccttctgttggtggcccactacgctattatcggacccggcctgcaggcaaaggccacccgcgaggcgcagaagagggctgccgcaggtatcatgaaaaatccaacagtcgacgggattactgtaatagatctcgaccccatcccttatgatccgaagtttgaaaaacagctgggccaagtgatgcttttaattctgtgcgttacgcaggtgctcatgatgcggaccacatgggccttgtgtgaggctctgactctagccaccggacccatcagtacactgtgggaaggcaacccagggcgtttctggaataccactattgcagtcagcatggctaacatctttagaggatcctacctcgccggcgcgggtcttctgttctctataatgaagaatacgacaaacaccaggcgcgggactggaaacatcggcgagaccttgggtgagaaatggaagagccggctgaatgccctcggcaaatccgaatttcagatttataagaagtcagggatccaagaggtggaccgaacactggcaaaagaaggaattaagagaggcgagactgatcaccatgctgtctctagggggagtgccaaattacgctggttcgtggagcggaacatggttacccctgaaggaaaggtggtagaccttggctgcggtagagggggatggtcgtactattgtggcggtctgaaaaatgtgcgtgaggtcaagggcctcacaaaggggggacccggccacgaagagcctatcccaatgagcacgtacgggtggaacctagttaggctgcagtccggagtggatgtctttttcataccccctgaaaaatgcgacaccttgctgtgtgatattggcgagtcttcaccaaatcccactgtggaggcaggtcggacactccgcgtacttaacctggtggaaaattggttgaacaataacacccagttctgcatcaaggttctgaatccgtacatgcctagcgtgatcgagaaaatggaagctctccagcgaaagtatgggggagccttagtcagaaacccactgtccaggaatagtactcatgagatgtactgggtgtctaacgccagcggcaatattgtctcatccgtgaacatgataagtcggatgcttatcaaccgctttacaatgagacacaaaaaggcgacctatgaacccgacgttgacctgggcagcgggacgaggaatattggaatcgagtctgagattcctaacctagatatcataggtaagcgaatcgaaaaaattaaggaggaacatgagacctcctggcactacgaccaagatcacccatataaaacatgggcttaccatggctcatatgaaactaagcagaccgggagcgcatcgtctatggtaaatggagtggtccggctcctgacaaaaccctgggacgtgttgccgactgttacccagatggccatgacagataccactcctttcggccagcaacgtgtgtttaaggagaaggtcgacacgagaacacaggagcccaaagaaggtaccaagaaactgatgaagatcactgctgagtggctctggaaagaacttgggaagaaaaagaccccacgcatgtgtacaagggaggagttcacgcggaaggtgagaagtaacgccgcactgggagccatttttaccgatgaaaataaatggaagtccgctcgcgaggcggtagaagacagcaggttctgggagttagtggataaagaacgaaacctgcacttggagggcaagtgcgagacttgtgtttacaatatgatgggcaaacgggaaaagaagctcggggagtttggaaaagccaagggttcaagagcaatctggtacatgtggctgggcgctaggttcctagaatttgaggcccttgggttcctgaacgaagaccattggttttcccgcgagaattctctcagcggagtcgagggcgaaggtctgcacaaattggggtatattctgcgtgatgtgagtaagaaagagggaggcgcaatgtacgccgacgacacagctggctgggatacccggataactctcgaagaccttaagaacgaggaaatggtgacaaatcacatggagggggagcataagaaactggccgaagcgatcttcaagttaacctatcagaacaaagtcgttagagtgcagaggcctacaccccgcggaactgtaatggatattatctcccgacgggaccaaagaggtagcggccaggtggggacctacggactgaatacgtttaccaacatggaggcacagttgatcaggcaaatggaaggcgagggtgtcttcaagaatattcagcacctcacagtgactgaggaagccgctgttcagaactggctggcccgcgtggggagagagcggctatctaggatggcaatatcaggagatgactgcgtcgtgaaaccacttgatgaccgtttcgctaacgccctgaccgctctcaatgatatgggcaagatccgaaaggacattcagcaatgggaacccagtaaaggctggaacgattggacacaggtacctttttgctcccatcacttccatgagctggttatgaaggacgggcgcgtgttggtcgtgccatgtagaaatcaggatgaattaatcggacgggccaggattagccagggtgcaggctggtctctgcgcgagactgcgtgcctcgggaaatcgtatgcccaaatgtggtcacttatgtactttcacagacgggacctgaggctagctgccaacgcaatctgtagcgctgtgccgtcccactgggtccccaccagtcgaacgacatggtctatacatgccaagcacgagtggatgaccactgaagacatgctgacagtttggaatcgtgtgtggatcagagagaacccttggatggaagataaaaccccagtagagagctgggaagagattccctatctcggaaagcgcgaggaccagtggtgcggctccttgatcggtctgacttcacgggcaacctgggccaagaatattcaggcggctatcaaccaggtgaggagtcttatagggaatgaagagtacacagattacatgccttctatgaaaagattccgccgggaagaggaagaggccggagtcctgtggtga

SEQ ID NO: 14446 - RNA, 9876 nt, synthetic construct
  misc_feature 1..9876: note = derived and/or modified CDS sequence (opt3) from DENV-2__KF955401__SS-prME
  source 1..9876: mol_type = other RNA
agcgccggaatgatcattatgctgataccaaccgtgatggctttccacctcactactagaaatggggagcctcatatgatcgtcgggattcaagaaaagggtaaatcccttctgtttaagacggaggacggagttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccacatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaatggaaatcaaggtaacgccgcagtcaagtattacagaggctgaactgaccggctatggtactgtgaccatggagtgtagccccagaacagggcttgatttcaatgaaatggtcctgttgcaaatggagaacaaagcctggctcgtgcacaggcagtggtttctggacttacctctgccatggctccccggcgcagataagcaggagtctaattggatccagaaggaaacccttgttactttcaaaaaccctcatgctaagaaacaagacgtggtcgtgctgggatcccaggagggcgccatgcacacagcgttgacgggggccaccgaaatacagatgtcaagcggaaatctactgtttactggtcatctcaagtgccggctgcgtatggacaaacttcaactgaagggcatgagttactctatgtgtacagggaagttcaaagtagttaaggagattgcagagacccagcacggaacaatcgtgatccgcgtccagtatgaaggcgatggttccccatgcaaaattcccttcgagatcatggacttggaaaagagatacgtgctcgggaggctgattactgtcaacccgatagtgaccgagaaagatagccctgttaacatcgaagctgagcccccatttggcgactcgtacattatcatcggagtggagcctggccagttaaagctgaattggttcaagaaagggtcttccattggacaaatgtttgaaacgaccatgcggggtgccaagcgaatggctatactaggcgatacagcctgggacttcgggtcactcggaggcgtatttacaagtatcggtaaagcactgcatcaggtcttcggggccatttatggcgtggcttttagcggagtttcctggaccatgaagatccttattggcgtgatcataacatggatcgggatgaactctcgcagcacttcattgagtgtctccctggtgctcgtaggaattgtgaccctgtaccttggcgttatggtccaggcggatagcggttgtgtggtgtcttggaaaaataaggagctgaagtgcgggtcaggaatcttcattacggacaacgtccacacatggaccgaacagtataaatttcaacccgagagtccaagcaagttggcatccgccatccagaaagctcaggaagagggcatatgtggtattagatctgttactaggctcgagaatctgatgtggaagcagatcacacccgaattaaaccacattctggccgagaatgaagtgaaactaaccatcatgactggcgatataaaggggatcatgcaagcaggaaaacggtcgctccgccctcagccaaccgagctgaagtacagctggaagacatggggcaaagccaagatgcttttcacggaatcctataaccagacctttttgattgacgggccggagactgctgagtgccccaatacaaacagagcctggaactcactggaagtggaggattacggattcggcgtatttaccacaaacatctggctcaaactgaaggaaaaacaggacgcattctgtgacagtaagttaatgtctgcggctattaaggataatagggccgtccatgcagacatgggttattggatcgagagcgccctgaacgatacttggaaaatagagaaggcttccttcattgaagtgaaaaattgccactggcctaagtcacataccctttggagcaacggggttttggagtctgaaatgatcatccccaagaatctcgccggacccgtgtcccaacacaattaccgtcctggctaccacacgcagattgcaggtccatggcatctgggcaagctagagatggactttgatttctgtgacgggacaaccgtcatcgtgactgaagattgcggaaaccggggccccagtctgcgaaccacaactgctagcgggaagctcattaccgagtggtgctgtagatcttgcacactgccgcctcttaggtatcgcggagaggacggctgttggtacggtatggaaatacggccattgaaagagaaggaagagaatctggttaactccttagtgacggccgggcacggacaggtagataatttttcactcggcgtcctgggtatggcgcttttcctggaagagatgttgagaaccagggtgggcactaaacatgccatcctcctggtggctgtcagttttgttacactaattaccgggaacatgagcttcaaggacctgggacgcgtggtagtgatggtcggcgcaactatggccgatgacatcgggatgggagtgacatatctcgctctgcttgccgcatttaaagttcgacccaccttcgcggccggcttgctgttacggaagctcacgtcgaaggagctgatgatgactaccattggtatcgtgcttctgtcccaatctacaatacctgaaaccgtcctagagctcactgatgctctggccttggggatgatggtgctgaaaatcgttcgtaatatggaaaagtaccagttagcagtgacaattatggctatcctctgcgtccccaacgccgtaattctgcagaatgcatggaaagtgagctgtaccatccttgccgttgtgtcagtcagtccactgttgctcacatcctctcagcaaaagactgactggatacctctggctctaaccattaaaggactgaaccccacggcgatctttcttacaaccctcagcagaactaataagaaaaggtcctggccactgaacgaggccatcatggcagtgggcatggtatcaattttggctagcagtctgttaaagaatgacataccgatgaccggccctctcgtggccgggggactgcttacagtctgctatgttctgactggtcgctctgccgatttggaactcgagcgggctaccgacgtgaagtgggaggatcaggcagaaatctccggcagctcgcccattctgtcaatcacgatttctgaggacgggagtatgtccatcaaaaacgaagaggaggaacagacactaaccatactgatcagaactggacttctcgtgattagcggcctgttcccaatctctattcccatcacagccgcggcttggtacttgtgggaggtcaagaaacagagggccggtgtgttatgggatgttcctagcccaccccctatggggaaggcagaactggaggacggagcctatcgaataaaacaaaagggcattctcggctactcccagatcggggctggagtatacaaggaaggtacctttcacactatgtggcatgtgacacgcggcgcagtcctgatgcacaaagggaagcggatcgagccgtcatgggccgatgtgaaaaaggaccttattagttatggaggcggttggaaactggagggggaatggaaggagggagaagaggttcaggtgttggcgctagaaccaggcaagaatcccagagctgtccagaccaaacctggcctgttcaagacgaacactgggaccatcggagccgtgagcctcgatttttctccaggtacatccggctcacccataattgacaaaaaggggaaagtagtcggactgtacggcaacggtgtggttaccaggagtggggcatatgtgagcgccatcgctcaaacagagaagtccattgaggataatcctgaaatcgaggacgatatattccgtaagcgccggcttactattatggacttacacccgggagccggcaaaaccaagagatacctgcccgcaatcgtcagggaagctatcaaacgaggcctccggacgttgattctggccccaacacgcgtggttgcggccgagatggaagaggcactcagagggctgcctatcaggtatcagactcccgctattcgggccgagcataccggacgagaaatagtggaccttatgtgtcacgctacattcaccatgagactgttgtctccagtccgcgtgcctaactacaatctaatcattatggatgaggcacattttactgaccccgcctcgatcgccgctaggggttatatcagcacccgtgtagaaatgggcgaggcggcagggattttcatgacagccacgccaccgggatcacgggatccttttccccagtccaacgctccaataatcgacgaggaaagagagattcccgaaaggagttggaactctggccacgagtgggtgactgatttcaagggtaaaaccgtttggtttgtccctagcatcaaggccgggaacgacattgcagcctgcctgcgcaagaatggcaaaaaggtgatccaactctcccgaaaaacattcgattcagaatacgtgaagaccagaactaacgactgggattttgtcgtaacaaccgacatatctgagatgggcgctaatttcaaagcggagcgggtgatcgatccaaggcgctgtatgaagcccgttattttaacggacggcgaagaacgtgtgatcctggccgggcctatgccggtcactcatagcagtgcagctcagagacggggaaggattggtcgcaaccccaaaaatgaaaacgaccagtacatctatatgggcgagccccttgaaaatgatgaggactgcgcccactggaaggaggcaaagatgctgctcgataacataaatacacctgaagggattatcccctccatgtttgagccagaacgagagaaagtggacgccattgatggagaatacagattgcggggcgaggctaggaagaccttcgttgacctgatgcgcagaggtgatctccctgtgtggctggcctataaagtcgcggcagaggggatcaactacgccgacaggcggtggtgttttgatggcataaagaacaatcagatccttgaagagaacgtggaagtagagatttggaccaaagagggagaacgtaagaagctaaaaccccgctggctggacgctcgaatctatagcgatccattggccttaaaggagttcaaagagttcgctgcaggcagaaagtctctgactctcaatctgattacagagatggggaggcttcctacctttatgacacagaaaactcgggacgccctggataacctcgctgtgttgcacacggccgaagcaggaggtcgcgcgtacaatcatgccctgtcagagctaccggagaccctggaaacactccttctgttaactttgctggctaccgttacaggcgggatcttcctctttctgatgtccggaagaggcataggtaagatgacccttgggatgtgctgcattatcactgccagtatcctgctctggtatgcacagattcagccccactggatcgctgccagcataattttggagttctttctgatcgtcttactaattccagaacctgagaagcagaggacgccccaagacaaccagctgacctacgtggtgatcgcaatactcacagtcgttgccgctactatggcgaatgaaatgggcttccttgagaaaaccaagaaagacctgggattgggctcgatcgccacacagcagccagagtctaacattctggatatcgacctccggcctgcatccgcttggaccctgtacgccgtggccactacatttgtaacgcccatgcttcgacatagcattgaaaattcaagtgtgaacgtctctctcaccgcaatcgctaatcaagccactgtgctgatggggttgggaaagggttggccgctgtccaaaatggatattggcgttccattactagcgatcgggtgttatagccaggtgaaccctataacactgaccgctgccctccttctgttggtcgcacactacgccattatcggacccggcctgcaggctaaggcaaccagagaggcccagaagcgcgcggctgccggtatcatgaaaaatccaacagtagacgggattactgtgatagatctcgaccccatcccttatgatccgaagttcgaaaaacaactgggccaggttatgcttttaattctgtgcgtgacgcaggtcctcatgatgaggaccacatgggcattgtgtgaggccctgactctagctaccggacccatctcaacactgtgggaaggcaacccagggcggttttggaataccactattgccgtgagtatggcaaacatcttccgtggaagctacctcgctggcgccggtcttctgttttccataatgaagaatacgacaaacaccagaagggggactggaaacatcggcgagaccttgggtgagaaatggaagtctcgcctgaatgcgctcggcaaaagcgagttccaaatttataagaagtccgggatccaggaggtcgaccggacactggccaaagaaggaattaagcgaggcgagactgatcaccatgcagtgtcaagagggtctgctaaattaaggtggtttgttgagcgcaacatggtgacccctgaaggaaaggtagtggaccttggctgcggtcggggaggatggagttactattgtggcggtctgaaaaatgtcagagaggttaagggcctcacaaaagggggacccggccacgaagaacctatcccaatgtcgacgtacgggtggaacctagtgcgtctgcagagcggagtcgatgtgttcttcataccccctgaaaaatgcgacaccttgctgtgtgatattggcgagtcctctccaaatcccactgtagaggccggtaggacactccgggtgcttaacctggttgaaaattggttgaacaataacacccagttttgcatcaaggtgctgaatccgtacatgccttcagtcatcgagaaaatggaagcactccaacgcaagtatgggggagctttagtgcgaaacccactgagcagaaattccactcatgagatgtactgggtcagtaacgcctctggcaatattgtgagctcagttaacatgatatccaggatgcttatcaaccggttcacaatgcgccacaaaaaggccacctatgaacccgacgtagacctgggcagtgggacgagaaatattggaatcgagagcgagacccctaacctagatattatcggtaagaggatagagaaaatcaaggaggaacatgagacatcttggcactacgaccaggatcacccatataaaacttgggcgtaccatggctcctatgaaaccaagcagacagggtcagctagctcgatggtgaatggagtcgtgcgactcctgactaaaccctgggacgttttgccgaccgtgacacagatggcaatgaccgatactacgccttttggccaacagcgggtcttcaaggagaaggtggacacacgtacccaggagcccaaagaaggtactaagaaactgatgaagattaccgccgagtggctctggaaagaacttgggaagaaaaagacaccaagaatgtgtacgcgcgaggagtttaccaggaaggtacggtctaacgctgccctgggagcaatcttcactgatgaaaataaatggaagagtgccagagaggctgtggaagactcccgcttttgggagttagttgataaagaaaggaacctgcacttggagggcaagtgcgagacatgtgtctacaatatgatgggcaaacgagaaaagaagctcggggagttcggaaaagcgaagggtagccgggccatttggtacatgtggctgggcgcaagatttctagagttcgaggctcttgggtttctgaacgaagaccattggttctcaagggaaaattccctctctggagtggagggcgaaggtctgcacaaattggggtatatcctgcgcgatgtgagcaagaaagagggaggcgccatgtacgcagacgacaccgccggctgggatactcgtattacactcgaagaccttaagaacgaggaaatggtcaccaatcacatggagggggagcataagaaactggctgaagccatatttaagttaacatatcagaacaaagttgtgcgggtacaaagacctactcccaggggaaccgtgatggatatcattagtcgccgagaccagcggggttccggccaggtcgggacgtacggactgaataccttcacaaacatggaggcgcaattgatcagacagatggaaggcgagggtgtgttcaagaatatccagcacctcactgttaccgaggaagcagccgtgcagaactggctggctagggtcgggcgcgagagactaagccggatggccatttctggagatgactgcgtggtaaaaccacttgatgacaggtttgcaaacgctctgacagccctcaatgatatgggcaagatacgtaaggacatccaacagtgggaaccctcaaaaggctggaacgattggactcaggttcctttctgcagtcatcactttcatgagctgattatgaaggacgggcgagtgttggtcgtgccatgtcgcaatcaggatgaattaatcggcagagctcggatttcccaaggtgccggctggagcctgagggagaccgcatgcctcgggaaatcttatgcgcagatgtggtcgcttatgtacttccaccgcagagacctgcggctagccgctaacgccatctgttcagcagtgccgagccactgggtccccacgtccaggacaacctggagtatacatgctaagcacgagtggatgactacagaagacatgctgaccgtttggaatcgagtgtggatccgtgagaacccttggatggaagataaaactccagtagagtcttgggaagagattccctatctcggaaagagagaggaccagtggtgcggcagcttgatcggtctgacctcccgcgccacatgggcaaagaatattcaggccgcgatcaaccaagtgcggtcacttatagggaatgaagagtacacggattacatgcctagtatgaaaaggtttagacgcgaagaggaagaggctggagtcctgtggtga

SEQ ID NO: 14447 - RNA, 9876 nt, synthetic construct
  misc_feature 1..9876: note = derived and/or modified CDS sequence (opt3) from DENV-2__JF730047__SS-prME
  source 1..9876: mol_type = other RNA
agcgcaggaatgatcattatgctgatacccaccgtgatggctttccacctcactactagaaacggggagcctcatatgatcgtcggcattcaggaaaagggtaaatcccttctgtttaagacggaggacggcgttaatatgtgcaccttgatggcaatggatttaggggaactgtgtgaggacaccatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggctctcattttcatcctgctgactgcagtggccccatctatgacaatgcgctgcatagggatttcgaacagagattttgttgaaggagtgtcaggtggcagctgggtcgacatcgtgctcgagcacgggagttgtgtaaccactatggctaagaataagcccacattagatttcgaactgattaaaaccgaggccaagcagcctgcgacgcttaggaaatattgcatcgaagcaaagttgaccaacacaactaccgagtcccggtgtccaacacaaggagagccctctctgaaagaggaacaggacaagcgctttgtttgcaagcatagcatggtggatcgaggctggggtaatgggtgtggactattcggcaaaggcgggatcgtcacttgcgccatgtttacctgcaagaaaaacatggaaggaaagattgtgcagcctgagaatctcgaatacacaatagtggtcaccccacactccggtgaggagcatgctgttggcaacgacactgggaaacacggaaaggaaatcaaagtgacgccgcagtcaagtattacagaggccgaactgaccggctatggtactgtaaccatggagtgtagccccagaacagggcttgatttcaatgaaatggtgctgttgcaaatggagtctaaggcatggctcgtccacaggcagtggtttctggacttacctctgccatggctccccggcgctgataagcagggatccaactggatccagaaagagacccttgtgactttcaagaatcctcatgccaaaaagcaagacgttgtggtcctgggctcacaggaaggggcgatgcacacagccttgacgggagcaaccgagatacagatgagcagtggtaacctactgtttactggccatctcaaatgccggctgcgtatggacaaacttcaactgaaggggatgtcttactccatgtgtacaggaaaattcaaggtggtaaaagaaattgctgagacccagcacggcacaatcgttatccgcgtgcagtatgagggtgatgggagcccatgcaagattcccttcgaaatcatggacttggagaaaagatacgtcctcggcaggctgattactgtgaatccgatagtcaccgaaaaggattcgcctgtgaacatcgaggccgaacccccatttggagactcttacattatcatcggcgttgagcctgggcagttaaagctgaactggttcaaaaagggatcctcaattggtcaaatgtttgagacgaccatgcggggcgctaaacgaatggccatactaggggatacagcatgggacttcggaagtctcggcggtgtgtttactagcatcgggaaggccctgcatcaggtattcggcgctatttatggagcggcattttccggcgtctcttggaccatgaaaatccttattggggtgatcataacatggatcggaatgaatagccgctcaacaagtttgtccgttagcctggtgctcgtcggcattgtgaccctgtaccttggtgtaatggtgcaggccgattctgggtgtgttgtctcatggaagaacaaggaactgaaatgcggaagtggcatcttcattacggacaatgtgcacacatggaccgagcagtataagtttcaacccgaaagcccatccaaattggcttctgccatccagaaggcacaggaggaaggtatatgtggcattagatcggtgactaggctcgagaacctgatgtggaaacagatcacacccgagttaaatcacattctggccgaaaacgaggtcaagctaaccatcatgactggggatataaaaggaatcatgcaagctggcaagcggagcctccgccctcagccaaccgaactgaagtactcctggaaaacatgggggaaggccaaaatgctttcaacggagagtcataatcagaccttcttgattgacggaccggaaactgcagagtgccccaacacaaatagagcgtggaactctctggaggttgaagattatggctttggtgtgttcaccacaaatatctggctcaagctgaaagagaagcaggacgctttttgtgacagcaagttaatgtccgccgcaattaaagataacagggccgtgcacgctgacatggggtactggatcgaatcagccctgaatgatacttggaagatagagaaagccagcttcattgaggtaaagaactgccattggcctaaatctcacaccctttggtccaatggagtcttggaaagtgagatgatcatcccaaagaacctcgctggccccgtgagccaacacaactatcgtcctggttaccatacgcagacagccggcccatggcacctggggaagctagaaatggacttcgatttttgtgacggaaccactgttattgtgaccgaggattgcggcaatcgggggccctctctgcgaacaactaccgcgtccggaaaactcatcacagaatggtgctgtagatcatgcacgctgccgcctcttaggtaccgcggcgaggacggttgttggtatgggatggagattcggccattgaaggaaaaagaggaaaacctggtcaatagtttagtgaccgccggacatggccaggttgataacttcagcctcggtgtgctgggcatggctctttttctggaggaaatgttgagaactagggtagggacaaagcacgcaatactcctggtcgccgtgtcgttcgtgaccctaatcactggaaatatgtcctttaaagacctgggccgcgtcgttgtgatggtagggacaaccatgacggatgacattggaatgggcgtgacttacctcgctctgcttgccgcattcaaggtccgacccacctttgcggccggtttgctgttacggaagctcacatctaaagagctgatgatgaccactatcgggattgtgcttctgagccaatcaacaatccctgagaccatactagaactcacagatgctctggccttgggaatgatggttctgaagatcgtgcgtgacatggagaaatatcagttagcagtcactattatggctatcctctgcgtgcccaacgccgttattctgcagaatgcatggaaggtgagttgtaccatccttgccgtcgtatccgtgtctccactgttgctcacgagctcccagcaaaagactgactggatacctctggctctaaccattaagggcctgaaccccactgcgatcttccttaccacactctcaagaactaataaaaagaggagctggccactgaacgaagccatcatggcagttggcatggtgagtattttggcttcttccctgttaaagaatgatataccgatgaccgggcctctcgtcgccggaggtctgcttacggtgtgctacgtactgacaggccgcagcgccgacttggagctcgaacgggctaccgatgtgaaatgggaggaccaggcagagatctcggggtcatctcccattctgagtatcactatttccgaagatggaagcatgtctatcaagaacgaggaagaggagcagacactaaccatactgatcagaactggccttctcgtcattagcggtctgtttccagtttccatccccattacagccgcggcttggtatttgtgggaagtgaaaaagcagagggccggggtgttatgggacgtcccttcaccaccccctatgggaaaagcagagctggaagatggcgcctaccgaatcaagcaaaagggcatactcgggtatagtcagattggagctggtgtgtacaaagagggcaccttccatacgatgtggcacgttactcgcggggcagtactgatgcacaagggaaaacggatcgaaccgagctgggccgacgtgaagaaagatcttatctcttacggcggtgggtggaagctggagggagagtggaaggaaggcgaggaagtccaggtgttggcgctagagccaggcaaaaatcccagagctgttcagaccaagcctgggctgtttaaaacaaacaccggaacaattggtgccgtgtccctcgacttctcaccaggcacaagtgggagccccatcatagataagaaaggaaaggtcgtgggcctgtatggtaatggggtagtcaccaggtccggagcatacgtgtctgccattgctcaaacggaaaagtcgatcgaggacaaccctgagattgaagatgacatctttcgtaaacgccggcttacaataatggacttacatccgggcgccggcaagactaaaagatatctgcccgcaattgttagggaggctatcaagcgagggctccggaccttgatcctggccccaacacgcgtggtcgcggccgaaatggaggaagcactcagaggactgcctattaggtaccagacccccgctatccgggccgagcacactggtcgagagattgtggatcttatgtgtcatgctaccttcacaatgagactgttgagcccagttcgcgtgcctaactataatctaataatcatggacgaagcacacttcacggatcccgcctcaattgccgctaggggctacatctccactcgtgtcgagatgggggaagcggcaggaatctttatgaccgccacaccaccgggcagtcgggaccctttcccccagtctaacgctccaattatagatgaggagagagaaatccccgagaggagctggaataccggtcatgaatgggtgactgactttaaagggaagacagtatggttcgtgccttccattaaggccggaaacgatatcgcagcctgcctgcgcaaaaatggcaagaaagttattcaactctcacgaaagacctttgactctgagtatgtcaaaacgagaactaacgattgggacttcgtggtgacaaccgatatcagcgaaatgggcgctaattttaaggcggagcgggtcatagacccaaggcgctgtatgaaacccgtaatcttaaccgacggggaggaacgtgtgattctggccggacctatgccggttactcacagttccgcagctcagagacggggtaggatcggccgcaacccaaagaatgagaacgatcagtacatttacatgggggaaccccttgagaatgacgaagattgcgcccactggaaggaggcaaaaatgctgctcgacaacatcaatacacctgagggaataattcccagcatgttcgaaccagagcgagaaaaggtggatgccatcgacggcgagtatagattgcggggtgaagctaggaaaacctttgtcgatctgatgcgcagaggggacctccctgtgtggctggcctacaaggttgcggcagagggcattaactatgccgataggcggtggtgtttcgacggaatcaaaaataaccagatacttgaggaaaacgtggaggtcgaaatctggacaaaggagggcgagcgtaagaaactaaagccccgctggctggatgctcgaatttactctgacccattggccttaaaagaatttaaggagttcgctgcagggagaaaatcactgactctcaatctgatcacggaaatgggaaggcttcctaccttcatgacacaaaagactcgggatgccctggacaacctcgctgtgttgcataccgccgaggcgggtggacgcgcatataatcacgccctgtccgaactaccggagacactggagaccctccttctgttaactttgctggctacggtaaccgggggaatttttctcttcctgatgagtggcagaggtatcgggaagatgacacttggcatgtgctgcataattactgccagcatcctgctctggtacgcacagatccagccccattggattgctgcctcgatcatattggaatttttcctgattgtgttactaatcccagagcctgaaaaacagaggacaccccaagacaaccagctgacatatgttgtcattgcaatcctcaccgtggtggccgctactatggcgaatgagatgggatttcttgaaaagactaaaaaggatctgggcttggggtctatagccacgcagcagccagagtccaacatcctggacattgatctccggcctgcaagcgcttggaccctgtacgccgtcgccactacattcgttacccccatgcttcgacactcaatcgagaatagttctgtgaacgtatccctcaccgcaattgctaatcaagccacagtgctgatgggattgggtaaaggctggccgctgagcaagatggacatcggggtcccattactagcgattggatgttactcacaggtgaaccctatcactctgacggctgccctccttctgttggttgcacactatgccataattggccccggtctgcaggctaaggcaaccagagaagcccagaaacgcgcggctgccgggatcatgaagaatccaacagtggatggcatcactgtcattgacctcgatcccataccttacgacccgaaatttgagaagcaactgggacaggtaatgcttttaatcctgtgcgtgacccaggttctcatgatgaggacaacctgggcattgtgtgaagccctgactctagctacgggccccattagtacactgtgggaggggaacccaggacggttctggaataccactatcgccgtgagcatggcaaacatttttcgtggctcctatctcgctggtgccgggcttctgttctctatcatgaaaaataccacaaacactagaaggggaaccggcaatataggtgaaacattgggcgagaagtggaaaagccgcctgaacgcgctcgggaagtccgagtttcaaacgtacaagaaatcaggaatccaggaagtcgatcggaccctggccaaggagggcattaaacgaggggaaactgaccatcacgcagtgtctagaggaagtgctaagttaaggtggttcgtcgagcgcaacatggtgacacctgagggcaaagttgtggatcttggttgcgggcggggaggctggtcgtattactgtggtggcctgaagaatgtaagagaagtgaaggggctcaccaaaggaggccccgggcatgaggaacctatcccaatgagcacttatggatggaacctagtccgtctgcagtccggcgttgacgtgtttttcattccccctgagaagtgcgatacattgctgtgtgacatcggtgaatcttcaccaaatcccaccgtcgaggccgggaggacgctccgggtgcttaacctggtagagaattggttgaacaataacacccagttctgcataaaagtgctgaatccgtacatgcctagcgttattgaaaagatggaggcactccaacgcaaatacggaggcgctttagtgcgaaacccactgtccagaaatagtacacacgaaatgtattgggtctctaacgccagcggcaatatcgtgtcatccgtcaacatgatcagtaggatgcttattaatcggtttactatgcgccataagaaggccacctacgagcccgacgtggatctggggagcggaacaagaaacataggtatcgaatctgagattcctaacctagacatcattggcaaaaggatcgagaagataaaacaggaacacgagacttcctggcactatgatcaggaccatccatacaagacctgggcgtatcacgggtcatacgaaacaaaacagaccggaagcgcttcgtctatggttaatggcgtagtgcgactcctgactaagccctgggatgtcttgccgacggtgacacaaatggcaatgaccgacactacccctttcggtcagcagcgggtttttaaggagaaagtggatacacgtacgcaggaacccaaggaggggaccaaaaagctgatgaaaatcactgccgagtggctctggaaggaacttggcaaaaagaagacaccaagaatgtgtacccgcgaggagttcattaggaaagtccggagtaacgctgccctgggcgcaatctttactgacgagaataagtggaaatccgccagagaggctgtggaagatagccgcttctgggagttagtagacaaggaaaggaacctgcatttggagggcaaatgcgaaacatgtgtgtataatatgatggggaagcgagagaagaaactcggagagtttggtaaggcgaaaggctcacgggccatttggtacatgtggctgggggcaagattcctagaatttgaggctcttggattcctgaacgaagatcactggttttccagggaaaattctctcagcggcgttgaaggtgaggggctgcacaagttgggatacatcctgcgcgacgtcagtaaaaaggagggcggcgccatgtatgcagacgataccgccgggtgggacacacgtattactctcgaagatcttaagaacgaggaaatggtgaccaatcatatggagggagaacacaaaaagctggctgaggccatattcaaattaacgtaccaaaacaaggtggtccgggttcagagacctacccccaggggtacagtgatggacatcatttcccgccgagatcagcggggcagcgggcaagtaggaacttatggcctgaatacctttacaaacatggaggcgcagttgatcagacagatggaaggtgagggggtgttcaaaaatatccagcatctcactgcaaccgaagaggtcgccgtgaagaactggctggctagggttggacgcgagagactatctcggatggccatttcaggcgacgattgcgtggtcaagccacttgacgataggttcgcaaatgctctgacggccctcaacgacatgggcaaaatacgtaaggatatccaacagtgggaacccagtaaagggtggaacgactggacacaggtgcctttttgctcccaccatttccacgagctgattatgaaggatggacgagtattggttgtgccatgtcgcaatcaggacgaattaatcggtagagctcggattagccaaggcgccgggtggtctctgagggagaccgcatgcctcggaaaatcgtacgcgcagatgtggtcacttatgtattttcaccgcagagacctgcggctagccgctaacgccatctgtagcgcagtcccgtcccattgggtgcccacaagtaggacaacctggtctatacacgctaagcatgaatggatgactaccgaggatatgctgacagtgtggaatcgagtctggatccgtgagaacccttggatggaagacaagacgccagttgagagctgggaagagattccctacctcggcaaaagagaagatcagtggtgcggttccttgatcgggctgacctcacgcgccacttgggcaaagaatattcaggccgcgatcaaccaagtgcggagtcttataggaaatgaggagtatacagactacatgccttctatgaaaaggttcagacgcgaagaggaagaggctggcgtactgtggtga

SEQ ID NO: 14448 - RNA, 9876 nt, synthetic construct
  misc_feature 1..9876: note = derived and/or modified CDS sequence (opt3) from DENV-2__JF730048__SS-prME
  source 1..9876: mol_type = other RNA
agcgcaggaatgatcattatgctgatacccaccgtgatggctttccacctcactactagaaacggggagcctcatatgatcgtcggcattcaggaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggctctcattttcatcctgctgactgcagtggccccatctatgacaatgcgctgcatagggatttcgaacagagattttgttgaaggagtgtcaggtggcagctgggtcgacatcgtgctcgagcacgggagttgtgtaaccactatggctaagaataagcccacattagatttcgaactgattaaaaccgaggccaagcagcctgcgacgcttaggaaatattgcatcgaagcaaagttgaccaacacaactaccgagtcccggtgtccaacacaaggagagccctctctgaaagaggaacaggacaagcgctttgtttgcaagcatagcatggtggatcgaggctggggtaatgggtgtggactattcggcaaaggcgggatcgtcacttgcgccatgtttacctgcaagaaaaacatggaaggaaagattgtgcagcctgagaatctcgaatacacaatagtggtcaccccacactccggtgaggagcatgctgttggcaacgacactgggaaacacggaaaggaaatcaaagtgacgccgcagtcaagtattacagaggccgaactgaccggctatggtactgtaaccatggagtgtagccccagaacagggcttgatttcaatgaaatggtgctgttgcaaatggagtctaaggcatggctcgtccacaggcagtggtttctggacttacctctgccatggctccccggcgctgataagcagggatccaactggatccagaaagagacccttgtgactttcaagaatcctcatgccaaaaagcaagacgttgtggtcctgggctcacaggaaggggcgatgcacacagccttgacgggagcaaccgagatacagatgagcagtggtaacctactgtttactggccatctcaaatgccggctgcgtatggacaaacttcaactgaaggggatgtcttactccatgtgtacaggaaaattcaaggtggtaaaagaaattgctgagacccagcacggcacaatcgttatccgcgtgcagtatgagggtgatgggagcccatgcaagattcccttcgaaatcatggacttggagaaaagatacgtcctcggcaggctgattactgtgaatccgatagtcaccgaaaaggattcgcctgtgaacatcgaggccgaacccccatttggagactcttacattatcatcggcgttgagcctgggcagttaaagctgaactggttcaaaaagggatcctcaattggtcaaatgtttgagacgaccatgcggggcgctaaacgaatggccatactaggggatacagcatgggacttcggaagtctcggcggtgtgtttactagcatcgggaaggccctgcatcaggtattcggcgctatttatggagcggcattttccggcgtctcttggaccatgaaaatccttattggggtgatcataacatggatcggaatgaatagccgctcaacaagtttgtccgttagcctggtgctcgtcggcattgtgaccctgtaccttggtgtaatggtgcaggccgattctgggtgtgttgtctcatggaagaacaaggaactgaaatgcggaagtggcatcttcattacggacaatgtgcacacatggaccgagcagtataagtttcaacccgaaagcccatccaaattggcttctgccatccagaaggcacaggaggaaggtatatgtggcattagatcggtgactaggctcgagaacctgatgtggaaacagatcacacccgagttaaatcacattctggccgaaaacgaggtcaagctaaccatcatgactggggatataaaaggaatcatgcaagctggcaagcggagcctccgccctcagccaaccgaactgaagtactcctggaaaacatgggggaaggccaaaatgctttcaacggagagtcataatcagaccttcttgattgacggaccggaaactgcagagtgccccaacacaaatagagcgtggaactctctggaggttgaagattatggctttggtgtgttcaccacaaatatctggctcaagctgaaagagaagcaggacgctttttgtgacagcaagttaatgtccgccgcaattaaagataacagggccgtgcacgctgacatggggtactggatcgaatcagccctgaatgatacttggaagatagagaaagccagcttcattgaggtaaagaactgccattggcctaaatctcacaccctttggtccaatggagtcttggaaagtgagatgatcatcccaaagaacctcgctggccccgtgagccaacacaactatcgtcctggttaccatacgcagacagccggcccatggcacctggggaagctagaaatggacttcgatttttgtgacggaaccactgttattgtgaccgaggattgcggcaatcgggggccctctctgcgaacaactaccgcgtccggaaaactcatcacagaatggtgctgtagatcatgcacgctgccgcctcttaggtaccgcggcgaggacggttgttggtatgggatggagattcggccattgaaggaaaaagaggaaaacctggtcaatagtttagtgaccgccggacatggccaggttgataacttcagcctcggtgtgctgggcatggctctttttctggaggaaatgttgagaactagggtagggacaaagcacgcaatactcctggtcgccgtgtcgttcgtgaccctaatcactggaaatatgtcctttaaagacctgggccgcgtcgttgtgatggtagggacaaccatgacggatgacattggaatgggcgtgacttacctcgctctgcttgccgcattcaaggtccgacccacctttgcggccggtttgctgttacggaagctcacatctaaagagctgatgatgaccactatcgggattgtgcttctgagccaatcaacaatccctgagaccatactagaactcacagatgctctggccttgggaatgatggttctgaagatcgtgcgtgacatggagaaatatcagttagcagtcactattatggctatcctctgcgtgcccaacgccgttattctgcagaatgcatggaaggtgagttgtaccatccttgccgtcgtatccgtgtctccactgttgctcacgagctcccagcaaaagactgactggatacctctggctctaaccattaagggcctgaaccccactgcgatcttccttaccacactctcaagaactaataaaaagaggagctggccactgaacgaagccatcatggcagttggcatggtgagtattttggcttcttccctgttaaagaatgatataccgatgaccgggcctctcgtcgccggaggtctgcttacggtgtgctacgtactgacaggccgcagcgccgacttggagctcgaacgggctaccgatgtgaaatgggaggaccaggcagagatctcggggtcatctcccattctgagtatcactatttccgaagatggaagcatgtctatcaagaacgaggaagaggagcagacactaaccatactgatcagaactggccttctcgtcattagcggtctgtttccagtttccatccccattacagccgcggcttggtatttgtgggaagtgaaaaagcagagggccggggtgttatgggacgtcccttcaccaccccctatgggaaaagcagagctggaagatggcgcctaccgaatcaagcaaaagggcatactcgggtatagtcagattggagctggtgtgtacaaagagggcaccttccatacgatgtggcacgttactcgcggggcagtactgatgcacaagggaaaacggatcgaaccgagctgggccgacgtgaagaaagatcttatctcttacggcggtgggtggaagctggagggagagtggaaggaaggcgaggaagtccaggtgttggcgctagagccaggcaaaaatcccagagctgttcagaccaagcctgggctgtttaaaacaaacaccggaacaattggtgccgtgtccctcgacttctcaccaggcacaagtgggagccccatcatagataagaaaggaaaggtcgtgggcctgtatggtaatggggtagtcaccaggtccggagcatacgtgtctgccattgctcaaacggaaaagtcgatcgaggacaaccctgagattgaagatgacatctttcgtaaacgccggcttacaataatggacttacatccgggcgccggcaagactaaaagatatctgcccgcaattgttagggaggctatcaagcgagggctccggaccttgatcctggccccaacacgcgtggtcgcggccgaaatggaggaagcactcagaggactgcctattaggtaccagacccccgctatccgggccgagcacactggtcgagagattgtggatcttatgtgtcatgctaccttcacaatgagactgttgagcccagttcgcgtgcctaactataatctaataatcatggacgaagcacacttcacggatcccgcctcaattgccgctaggggctacatctccactcgtgtcgagatgggggaagcggcaggaatctttatgaccgccacaccaccgggcagtcgggactctttccctcagagcaacgctcccattatagatgaggagagagaaatcccagagaggtcctggaataccggtcatgaatgggtgactgactttaaagggaagacagtatggttcgtgccctcaattaaggccggaaacgatatcgcagcctgcctgcgcaaaaatggcaagaaagttattcaactctctcgaaagacctttgacagcgagtatgtcaaaacgagaactaacgattgggacttcgtggtgacaaccgatatcagtgaaatgggcgctaattttaaggcggagcgggtcatagaccctaggcgctgtatgaaaccagtaatcttaaccgacggggaggaacgtgtgattctggccggacccatgcctgttactcactccagcgcagctcagagacggggtaggatcggccgcaacccgaagaatgagaacgatcagtacatttacatgggggaaccacttgagaatgacgaagattgcgcccactggaaggaggcaaaaatgctgctcgacaacatcaatacacccgagggaataattccttctatgttcgaacccgagcgagaaaaggtggatgccatcgacggcgagtatagattgcggggtgaagctaggaaaacctttgtcgatctgatgcgcagaggggacctcccagtgtggctggcctacaaggttgcggcagagggcattaactatgccgataggcggtggtgtttcgacggaatcaaaaataaccagatacttgaggaaaacgtggaggtcgaaatctggacaaaggagggcgagcgtaagaaactaaagcctcgctggctggatgctcgaatttactcagaccccttggccttaaaagaatttaaggagttcgctgcagggagaaaatccctgactctcaatctgatcacggaaatgggaaggcttccaaccttcatgacacaaaagactcgggatgccctggacaacctcgctgtgttgcataccgccgaggcgggtggacgcgcatataatcacgccctgagtgaactacctgagacactggagaccctccttctgttaactttgctggctacggtaaccgggggaatttttctcttcctgatgagcggcagaggtatcgggaagatgacacttggcatgtgctgcataattactgcctcgatcctgctctggtacgcacagatccagccgcattggattgctgcctctatcatattggaatttttcctgattgtgttactaatccccgagccagaaaaacagaggacccctcaagacaaccagctgacatatgttgtcattgcaatcctcaccgtggtggccgctactatggcgaatgagatgggatttcttgaaaagactaaaaaggatctgggcttggggtccatagccacgcagcagcccgagagcaacatcctggacattgatctccggccagcatcagcttggaccctgtacgccgtcgccactacattcgttacccctatgcttcgacacagtatcgaaaattcttccgtgaacgtaagcctcaccgcaattgctaatcaagccacagtgctgatgggattgggtaaaggctggcccctgtcaaagatggacatcggggtcccgttactagcgattggatgttacagtcaggtgaacccaatcactctgacggctgccctccttctgttggttgcacactatgccataattggccctggtctgcaggctaaggcaaccagagaagcccagaaacgcgcggctgccgggatcatgaagaatcccacagtggatggcatcactgtcattgacctcgatccaataccctacgaccctaaatttgagaagcaactgggacaggtaatgcttttaatcctgtgcgtgacccaggttctcatgatgaggacaacctgggcattgtgtgaagccctgactctagctacgggcccgattagcacactgtgggaggggaaccccggacggttctggaataccactatcgccgtgtccatggcaaacatttttcgtggctcttatctcgctggtgccgggcttctgttcagcatcatgaaaaataccacaaacactagaaggggaaccggcaatataggtgaaacattgggcgagaagtggaaatcccgcctgaacgcgctcgggaagtcagagtttcaaacgtacaagaaatctggaatccaggaagtcgatcggaccctggccaaggagggcattaaacgaggggaaactgaccatcacgcagtgagtagaggatcggctaagttaaggtggttcgtcgagcgcaacatggtgacaccagagggcaaagttgtggatcttggttgcgggcggggaggctggagctattactgtggtggcctgaagaatgtaagagaagtgaaggggctcaccaaaggaggccctgggcatgaggaacccatccctatgtccacttatggatggaacctagtccgtctgcagtctggcgttgacgtgtttttcattccacccgagaagtgcgatacattgctgtgtgacatcggtgaatcaagccctaatccaaccgtcgaggccgggaggacgctccgggtgcttaacctggtagagaattggttgaacaataacacccagttctgcataaaagtgctgaatccctacatgccgtccgttattgaaaagatggaggcactccaacgcaaatacggaggcgctttagtgcgaaaccctctgagtagaaattctacacacgaaatgtattgggtcagcaacgcctcaggcaatatcgtgtccagtgtcaacatgatcagcaggatgcttattaatcggtttactatgcgccataagaaggccacctacgagccagacgtggatctggggtctggaacaagaaacataggtatcgaatccgagattcccaacctagacatcattggcaaaaggatcgagaagataaaacaggaacacgagacttcatggcactatgatcaggaccatccttacaagacctgggcgtatcacgggagctacgaaacaaaacagaccggatcggcttctagtatggttaatggcgtagtgcgactcctgactaagccatgggatgtcttgcccacggtgacacaaatggcaatgaccgacactaccccgttcggtcagcagcgggtttttaaggagaaagtggatacacgtacgcaggaacctaaggaggggaccaaaaagctgatgaaaatcactgccgagtggctctggaaggaacttggcaaaaagaagacacccagaatgtgtacccgcgaggagttcactaggaaagtccggtccaacgctgccctgggcgcaatttttacagacgagaataagtggaaaagcgccagagaggctgtggaagattcacgcttctgggagttagtagacaaggaaaggaacctgcatttggagggcaaatgcgaaacctgtgtgtataatatgatggggaagcgagagaagaaactcggagagtttggtaaggcgaaaggctcccgggccatctggtacatgtggctgggggcaagattcctagaatttgaggctcttggattcctgaacgaagatcactggttttctagggagaatagcctcagtggcgttgaaggtgaggggctgcacaagttgggatacattctgcgcgacgtctccaaaaaggagggcggcgccatgtatgcagacgatacagccgggtgggacactcgtatcaccctcgaagatcttaagaacgaggaaatggtgacgaatcatatggagggagaacacaaaaagctggctgaggccattttcaaattaacctaccaaaacaaggtggtccgggttcagagaccaacacctaggggtactgtgatggacataatcagccgccgagatcagcggggctctgggcaagtaggaacctatggcctgaatacatttactaacatggaggcgcagttgattagacagatggaaggtgagggggtgttcaaaaatatccagcatctcaccgcaacggaagaggtcgccgtgaagaactggctggctagggttggacgcgagagactatcacggatggccatcagtggcgacgattgcgtggtcaagccccttgacgataggttcgcaaatgctctgacagccctcaacgacatgggcaaaattcgtaaggatatacaacagtgggaaccatccaaagggtggaacgactggacccaggtgcccttttgcagccaccatttccacgagctgatcatgaaggatggacgagtattggttgtgccttgtcgcaatcaggacgaattaattggtagagctcggatctctcaaggcgccgggtggtcgctgagggagactgcatgcctcggaaaatcatacgcgcagatgtggagccttatgtattttcaccgcagagacctgcggctagccgctaacgccatttgttccgcagtcccaagtcattgggtgccgacatctaggaccacttggagcatccacgctaagcatgaatggatgaccacagaggatatgctgacggtgtggaatcgagtctggatacgtgagaacccctggatggaagacaagacccctgttgagtcctgggaagagatcccatacctcggcaaaagagaagatcagtggtgcggttcattgattgggctgacaagtcgcgccacatgggcaaagaatatccaggccgcgattaaccaagtgcggtctcttatcggaaatgaggagtataccgactacatgcccagcatgaaaaggttcagacgcgaagaggaagaggctggcgtactgtggtga

SEQ ID NO: 14449 - RNA, 9876 nt, synthetic construct
  misc_feature 1..9876: note = derived and/or modified CDS sequence (opt3) from DENV-2__KF955402__SS-prME
  source 1..9876: mol_type = other RNA
agcgccggaatgatcattatgctgataccaaccgtgatggctttccacctcactactcggaacggggagcctcatatgatcgtcggtattcaagaaaagggaaaatcccttctgtttaagacggaggacggcgttaatatgtgcaccttgatggcaatggatttaggggaactgtgtgaggacacgatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccacatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagtgtttgtcgaaggagtgtcaggtggcagctgggtagatatcgttctcgagcacgggagttgtgtgaccactatggccaagaataagcccacattagacttcgaactgattaaaaccgaggctaagcagcctgccacgcttaggaaatattgcatcgaagcgaagttgaccaacacaactaccgagtcccggtgtccaacacaaggagagccctctctgaaagaggaacaggataagcgctttgtctgcaagcatagcatggtggaccgaggctggggtaatgggtgtggactattcggcaaaggcgggatcgtgacttgcgcaatgtttacctgcaagaaaaacatggaaggaaagattgtccagcctgagaatctcgaatacacaatagttgtgaccccacactccggtgaggagcatgccgtaggcaacgatactgggaaacacggaatggaaatcaaggtgacgccgcagtcaagtattacagaggctgaactgaccggctatggtactgtcaccatggagtgtagccccagaacagggcttgacttcaatgaaatggtgctgttgcaaatggagaacaaagcctggctcgttcacaggcagtggtttctggatttacctctgccatggctccccggcgcagacaagcaggagtctaattggatccagaaggaaacccttgtgactttcaaaaaccctcatgctaagaaacaagatgtcgtggtactgggatcccaggagggcgccatgcacacagcgttgacgggggccaccgaaatacagatgtcaagcggaaatctactgtttactggtcatctcaagtgccggctgcgtatggacaaacttcaactgaagggcatgagttactctatgtgtacagggaagttcaaagttgtgaaggagattgcagagacccagcacggaacaatcgtcatccgcgtgcagtatgaaggcgacggttccccatgcaaaattcccttcgagatcatggatttggaaaagagatacgtcctcgggaggctgattactgtgaacccgatagttaccgagaaagacagccctgtgaacatcgaagctgagcccccatttggcgattcgtacattatcatcggagtagagcctggccagttaaagctgaattggttcaagaaagggtcttccattggacaaatgtttgaaacgaccatgcggggtgccaagcgaatggctatactaggcgacacagcctgggatttcgggtcactcggaggcgtctttacaagtatcggtaaagcactgcatcaggtgttcggggccatttatggcgttgcttttagcggagtgtcctggaccatgaagatccttattggcgtcatcataacatggatcgggatgaactctcgcagcacttcattgagtgtgtccctggtactcgtgggaattgttaccctgtaccttggcgtcatggtgcaggcggacagcggttgtgtggtctcttggaaaaataaggagctgaagtgcgggtcaggaatcttcattacggataacgttcacacatggaccgaacagtataaatttcaacccgagagtccaagcaagttggcatccgccatccagaaagctcaggaagagggcatatgtggtattagatctgtgactaggctcgagaatctgatgtggaagcagatcacacccgaattaaaccacattctggccgagaatgaagtgaaactaaccatcatgactggcgacataaaggggatcatgcaagcaggaaaacggtcgctccgccctcagccaaccgagctgaagtacagctggaagacatggggcaaagccaagatgctttccacggaatcatataaccagaccttcttgattgatgggccggagactgctgagtgccccaatacaaacagagcctggaatagtctggaagtagaggactacggatttggcgtcttcaccacaaacatctggctcaaactgaaggaaaaacaggatgcattttgtgactctaagttaatgagcgcggctattaaggacaatagggccgtgcatgcagatatgggttattggatcgagtccgccctgaacgacacttggaaaatagagaaggcttcattcattgaagttaaaaattgccactggcctaagagccataccctttggtctaacggggtgttggagtccgaaatgatcatccccaagaacctcgccggacccgtcagtcaacacaattaccgtcctggctaccacacgcagattgcaggtccatggcatctgggcaagctagagatggatttcgacttttgtgatgggacaaccgtgatcgttactgaagactgcggaaaccggggccccagcctgcgaaccacaactgcttctgggaagctcattaccgagtggtgctgtagatcctgcacactgccgcctcttaggtatcgcggagaggatggctgttggtacggtatggaaatacggccattgaaagagaaggaagagaatctggtgaactcattagtaacggccgggcacggacaggtcgacaatttcagtctcggcgtgctgggtatggcgctttttctggaagagatgttgagaaccagggtgggcactaaacatgccatcctcctggtcgctgttagcttcgtgacactaattaccgggaacatgtcgtttaaggatctgggacgcgtagtggtcatggtgggcgcaactatggccgacgatatcgggatgggagttacatatctcgctctgcttgccgcattcaaagtgcgacccacctttgcggccggcttgctgttacggaagctcacgtccaaggagctgatgatgactaccattggtatcgtccttctgtctcaaagcacaatacctgaaaccgtgctagagctcactgacgctctggccttggggatgatggttctgaaaatcgtgcgtaatatggaaaagtaccagttagcagtcacaattatggctatcctctgcgtacccaacgccgtgattctgcagaatgcatggaaagtttcatgtaccatccttgccgtggtcagtgtgtccccactgttgctcacatctagccagcaaaagactgattggatacctctggctctaaccattaaaggactgaaccccacggcgatcttccttacaaccctctccagaactaataagaaaaggtcatggccactgaacgaggccatcatggcagtaggcatggtgagcattttggctagttctctgttaaagaatgacataccgatgaccggccctctcgtcgccgggggactgcttacagtttgctatgtgctgactggtcgctccgccgacttggaactcgagcgggctaccgatgtgaagtgggaggaccaggcagaaatcagcggctcgtcacccattctgtctatcacgattagtgaggatgggtccatgagcatcaaaaacgaagaggaggaacagacactaaccatactgatcagaactggacttctcgtcatttctggcctgtttccaatcagcattcccatcacagccgcggcttggtacttgtgggaggtgaagaaacagagggccggtgttttatgggacgtaccttccccaccccctatggggaaggcagaactggaggatggagcctatcgaataaaacaaaagggcattctcggctactcacagatcggggctggagtgtacaaggaaggtaccttccacactatgtggcatgtcacacgcggcgcagtgctgatgcacaaagggaagcggatcgagccgagttgggccgacgttaaaaaggatcttattagctatggaggcggttggaaactggagggggaatggaaggagggagaagaggtgcaggtcttggcgctagaaccaggcaagaatcccagagctgtgcagaccaaacctggcctgtttaagacgaacactgggaccatcggagccgtatctctcgacttctccccaggtacatcaggcagtcccataattgataaaaaggggaaagtcgtgggactgtacggcaacggtgttgtgaccaggagcggggcatatgtctccgccatcgctcaaacagagaagtctattgaggacaatcctgaaatcgaggatgacatatttcgtaagcgccggcttactattatggatttacacccgggagccggcaaaaccaagagatacctgcccgcaatcgtgagggaagctatcaaacgaggcctccggacgttgattctggccccaacacgcgttgtggcggccgagatggaagaggcactcagagggctgcctatcaggtatcagactcccgctattcgggccgagcataccggacgagaaatagtcgaccttatgtgtcacgctacattcaccatgagactgttgtcgccagtgcgcgtacctaactacaatctaatcattatggacgaggcacatttcactgatcccgccagcatcgccgctaggggttatatctcaacccgtgtggaaatgggcgaggcggcagggatttttatgacagccacgccaccgggatcccgggaccctttcccccagagtaacgctccaataatcgatgaggaaagagagattcccgaaaggtcttggaatagcggccacgagtgggttactgactttaagggtaaaaccgtctggttcgtgccttccatcaaggccgggaacgatattgcagcctgcctgcgcaagaatggcaagaaggtgatccaactctcacgaaaaacatttgactctgaatacgtcaagaccagaactaacgattgggacttcgtagtgacaaccgatataagcgagatgggcgctaattttaaagcggagcgggttatcgacccaaggcgctgtatgaagcccgtgattttaacggatggcgaagaacgtgtcatcctggccgggcctatgccggtgactcatagttccgcagctcagagacggggaaggattggtcgcaaccccaaaaatgaaaacgaccagtacatctatatgggcgagccccttgaaaatgacgaggattgcgcccactggaaggaggcaaagatgctgctcgacaacataaatacacctgaagggattatccccagcatgttcgagccagaacgagagaaagttgatgccattgacggagaatacagattgcggggcgaggctaggaagacctttgtggatctgatgcgcagaggtgacctccctgtctggctggcctataaagtggcggcagaggggatcaactacgccgataggcggtggtgtttcgacggcataaagaacaatcagatccttgaagagaacgtagaagtggagatttggaccaaagagggagaacgtaagaagctaaaaccccgctggctggatgctcgaatctattctgacccattggccttaaaggagtttaaagagttcgctgcaggcagaaagtcactgactctcaatctgattacagagatggggaggcttcctaccttcatgacacagaaaactcgggatgccctggacaacctcgctgttttgcacacggccgaagcaggaggtcgcgcgtacaatcatgccctgtccgagctaccggagaccctggaaacactccttctgttaactttgctggctaccgtcacaggcgggatctttctcttcctgatgagtggaagaggcataggtaagatgacccttgggatgtgctgcattatcactgccagcatcctgctctggtatgcacagattcagccccactggatcgctgcctcgataattttggagtttttcctgatcgtgttactaattccagaacctgagaagcagaggacgccccaagataaccagctgacctacgtggtcatcgcaatactcacagttgtggccgctactatggcgaatgaaatgggctttcttgagaaaaccaagaaagacctgggattgggctctatcgccacacagcagccagagtccaacattctggacatcgatctccggcctgcaagcgcttggaccctgtacgccgtagccactacattcgtgacgcccatgcttcgacattcaattgaaaatagttctgtcaacgtgtccctcaccgcaatcgctaatcaagccactgttctgatggggttgggaaagggttggccgctgagcaaaatggacattggcgtgccattactagcgatcgggtgttattcacaggtcaaccctataacactgaccgctgccctccttctgttggtagcacactacgccattatcggacccggcctgcaggctaaggcaaccagagaggcccagaagcgcgcggctgccggtatcatgaaaaatccaacagtggatgggattactgttatagacctcgatcccatcccttatgacccgaagtttgaaaaacaactgggccaggtgatgcttttaattctgtgcgtcacacaggtgctcatgatgaggaccacatgggcattgtgtgaggccctgactctagctaccggacccatcagtacactgtgggaaggcaacccagggcggttctggaataccactattgccgtcagcatggcaaacatctttcgtggatcctacctcgctggcgccggtcttctgttctctataatgaagaatacgacaaacaccagaagggggactggaaacatcggcgagaccttgggtgagaaatggaaaagccgcctgaatgcgctcggcaaatccgaatttcaaatttataagaagtcagggatccaggaggtggatcggacactggccaaagaaggaattaagcgaggcgagactgaccaccatgcagtttctagagggagtgctaaattaaggtggttcgtggagcgcaacatggtaacccctgaaggaaaggtggtcgatcttggctgcggtagagggggatggtcgtactattgtggcggtctgaaaaatgttagagaggtgaagggcctcacaaaagggggacccggccacgaggaacctatcccaatgagcacgtacgggtggaacctagtccgtctgcagtccggagtggacgtatttttcataccccctgaaaaatgcgataccttgctgtgtgacattggcgagtcttcaccaaatcccactgtggaggccggtaggacactccgggttcttaacctggtggaaaattggttgaacaataacacccagttctgcatcaaggtcctgaatccgtacatgcctagcgtgatcgagaaaatggaagcactccaacgcaagtatgggggagctttagtccgaaacccactgtccagaaatagtactcatgagatgtactgggtgtctaacgccagcggcaatattgtttcatccgtaaacatgataagtaggatgcttatcaaccggtttacaatgcgccacaaaaaggccacctatgaacccgatgtggacctgggcagcgggacgagaaatattggaatcgagtctgagacccctaacctagacattatcggtaagaggatagagaaaatcaaggaggaacatgagacatcctggcactacgatcaggaccacccatataaaacttgggcgtaccatggctcatatgaaaccaagcagacagggagcgcttcgtctatggtcaatggagtggttcgactcctgactaaaccctgggatgtgttgccgaccgtcacacagatggcaatgaccgacactacgcctttcggccaacagcgggtgtttaaggagaaggtagatacacgtacccaggagcccaaagaaggtactaagaaactgatgaagattaccgccgagtggctctggaaagaacttgggaagaaaaagacaccaagaatgtgtacgcgcgaggagttcaccaggaaggtgcggagtaacgctgccctgggagcaatctttactgacgaaaataaatggaagtccgccagagaggctgttgaagatagccgcttctgggagttagtcgacaaagaaaggaacctgcacttggagggcaagtgcgagacatgtgtgtacaatatgatgggcaaacgagaaaagaagctcggggagtttggaaaagcgaagggttcacgggccatttggtacatgtggctgggcgcaagattcctagaatttgaggctcttgggttcctgaacgaagatcattggttttccagggaaaattctctcagcggagtggagggcgaaggtctgcacaaattggggtatatcctgcgcgacgtcagtaagaaagagggaggcgccatgtacgcagatgacaccgccggctgggacactcgtattacactcgaagatcttaagaacgaggaaatggttaccaatcacatggagggggagcataagaaactggctgaagccatattcaagttaacatatcagaacaaagtggtacgggtgcaaagacctactcccaggggaaccgtcatggacatcatttcccgccgagatcagcggggtagcggccaggtggggacgtacggactgaatacctttacaaacatggaggcgcaattgatcagacagatggaaggcgagggtgttttcaagaatatccagcacctcactgtgaccgaggaagcagccgtccagaactggctggctagggtggggcgcgagagactatctcggatggccatttcaggagacgattgcgtagttaaaccacttgacgataggttcgcaaacgctctgacagccctcaatgacatgggcaagatacgtaaggatatccaacagtgggaacccagtaaaggctggaacgactggactcaggtgcctttttgctcccatcacttccatgagctgattatgaaggatgggcgagtcttggtggtgccatgtcgcaatcaggacgaattaatcggtagagctcggattagccaaggagccggctggtctctgagggagaccgcatgcctcgggaaatcgtatgcgcagatgtggtcacttatgtactttcaccgcagagatctgcggctagccgctaacgccatctgtagcgcagtcccgtcccactgggttcccacgagtaggacaacctggtctatacatgctaagcacgagtggatgactacagaagacatgctgaccgtgtggaatcgagtatggatccgtgagaacccttggatggaagacaaaactccagtggagagctgggaagagattccctatctcggaaagagagaggatcagtggtgcggctccttgatcggtctgacctcacgcgccacatgggcaaagaatattcaggccgcgatcaaccaagtccggagtcttatagggaatgaagagtacacggactacatgccttctatgaaaaggttcagacgcgaagaggaagaggctggagtgctgtggtga

SEQ ID NO: 14450 - RNA, 9876 nt, synthetic construct
  misc_feature 1..9876: note = derived and/or modified CDS sequence (opt3) from DENV-2__FJ898460__SS-prME
  source 1..9876: mol_type = other RNA
accgccggcgtgatcgtcatgctgattcccacagctatagcattccacctcactacgagaaacggggagcctcatatgatcgttggaaggcaggaaaagggtaaaagccttctgtttaagaccgaggacggcgtgaatatgtgcacattgatggccattgatttaggggaactgtgtgaggacactatcacctacaaatgcccactactccggcaaaacgaaccggaggatattgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggatcgagacctggatactgcggcatcctggcttcacaatcatggccgcaattttggcctacaccatcggcacgactcactttcagcgcgctctcattttcatcctgctgacagcagtggccccatccatgaccatgagatgcatagggatttctaacagggattttgtcgaaggagtgtcgggtggctcatgggtagacatcgttctcgagcacgggagctgtgtgactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggattgtgacctgcgccatgtttacatgcaaaaagaatatggaaggaaaagtggtccagcctgagaacctcgaatacaccatagttatcactccacacagcggtgaggagcatgctgtgggcaatgacacggggaagcacggaaaagaaattaagatcacaccgcagtcctcaataaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggattcagaaggagacacttgtgacgttcaagaaccctcatgccaaaaagcaagacgttgtggtcctgggctctcaggaaggggcgatgcacaccgccttgactggagcaacagagatccagatgtcctcaggtaatctactgtttaccggccatctcaaatgccgtctgcgcatggataagcttcaactgaaagggatgagctacagtatgtgtacaggaaagttcaagatcgtgaaagaaattgctgagactcagcacggcaccatcgtaattagagttcagtatgagggtgacgggtctccatgcaagatacccttcgaaatcacggatttggagaaaaggcatgtgctcggccggctgattaccgtcaacccgatcgtgacagaaaaggactcccctgtcaacatcgaggccgaacccccatttggagatagctacattataatcggcgtggagcctgggcagttaaaactgaattggttcaagaagggatcgtctattggtcaaatgtttgagactaccatgcgaggcgctaaacgcatggccatcctaggggacacagcatgggatttcggatccctcggcggtgtttttacttcaattgggaaggccctgcaccaggtgttcggcgctatctacggagcggcatttaacggcgtaagttggaccatgaaaatacttatcggggtcattatcacgtggattggaatgaatagcagatccacatctttgagcgtgtcactggttctcgtgggcgtcgtgaccctgtatcttggtgccatggtacaggctgacagtgggtgtgtggtttcctggaagaacaaagaactgaagtgcggaagcggcatcttcataactgataatgtccacacatggaccgagcagtacaagtttcaacccgaatctccatcaaaattggccagtgcaattcagaaggcccatgaggaaggtatctgtggcattaggagcgtgactcggctcgagaacctgatgtggaaacagatcacccccgagttaaatcacatactgtccgaaaacgaggtgaagctaacaatcatgacgggggacattaaaggaatcatgcaggctggcaagcgctctctcagacctcaaccaaccgaactgaaatattcgtggaagacttgggggaaggccaaaatgcttagcacagagtcccataatcagaccttcttgattgatggaccggaaacagcagagtgccccaacactaatagggcgtggaactcactggaggtcgaagactacggctttggtgttttcagtaccaatatctggctcaagctgcgtgagaaacaggacgtgttttgtgattctaagttaatgagcgctgccataaaagacaaccgggcagtgcacgccgatatggggtattggattgaatccgctctgaatgacacgtggaagatggagaaggcctcattcatcgaggtaaaaagctgccactggcctaagtctcatacactttggtccaacggagtcttggaaagtgagatgatcattccaaaaagcttcgcaggccccgtgtctcagcacaactaccgacctggttatcatacccaaactgctggcccatggcacctcgggaagctggaaatggattttgacttctgtgagggaaccacagttgtggtcactgaagattgcggcaatagagggccctccctaaggaccacaacggcctcaggaaaactgatcaccgagtggtgctgtcgcagttgcactctcccgcctctgcggtacagaggcgaggacggttgttggtacgggatggaaattaggccacttaaggagaaggaagagaacttggtgaatagcctggttacagcgggacatggccagatagataacttttcgttaggtgtgctcggcatggccctgttccttgaagagatgctgcgcacccgagtagggactaaacacgctatcttgctcgtcgcagtgtcctttgtgacactgattaccggaaatatgtctttccgggacctaggccgtgtcatggttatggtgggggccacgatgactgatgacatcggaatgggcgtaacctatctggctctcctggccgcatttaaggtgagacccacattcgcggccggtcttttgctgaggaaattaaccagcaaggagctcatgatggctactattgggatcgccctgctttcacagagtacaatgcctgaaaccatactggagctaacagatgcactcgctctgggaatgatggtcttgaaaatcgtgcgcaacatggaaaagtaccaactggccgttactattatggcaatctcctgcgtgcccaatgccgtcattttacagaacgcttggaaggtgtcttgtaccatcctcgcggccgttagcgtgtccccactgcttctgacgtcaagccagcagaaagcagactggatacctttggctctcacaattaagggcctgaatcccaccgccatctttctaactaccctgagtcggacatctaaaaagagatcctggccacttaacgaggccatcatggctgtcggcatggtaagcattctcgcatcgtcactgttgaaaaatgacataccgatgactgggcctctggtggccggaggtttactcaccgtttgctatgtgctgacgggcaggtctgcggatcttgaactggagcgagctgccgacgtcaagtgggaggatcaagcagaaatcagtgggtccagccccattttgtctatcacaattagcgaggacggatccatgtcaatcaaaaacgaagaggaggaacagaccctcactatactgatccgcacaggcctactggtgattagtggtgtattcccagtgagcatccccattaccgccgctgcatggtacctttgggaggtcaagaagcagcgggccggggttctctgggatgtgccttctccaccccctgtgggaaaagcggaactggaggacggcgcttatagaatcaagcagaggggcatattggggtactcccaaattggagccggtgtctataaagaaggcacttttcacacaatgtggcatgtgacccgtggggcagttttaatgcaccgcggaaagcggatcgagccgtcatgggccgatgtaaaaaaggacctgatcagttacggcggtgggtggaagctcgagggagaatggaaagagggcgaagaggtgcaggtcctggctcttgaaccaggcaagaatcccagagccgtgcagacgaaacctgggattttcaagactaacaccggaacaatcggtgcagttagcctggatttttccccaggcacctctgggtcgcccatagtggacaggaaaggaaaggtcgtgggcttgtacggtaatggggtagtcacacgaagcggagcttatgtgtcagccattgcgcagactgagaagtccatcgaggataaccctgaaattgaggacgatatcttccggaaaaagcgcctaaccataatggacctgcatccgggcgccggcaaaacgaagagatacctccccgcaattgttagggaagctatcaaacgggggctgcgaacacttatcttagccccaactagagtggtcgctgcagagatggaagaggccctgcgcggactccctattaggtatcaaacccccgccatccgtgctgagcacacaggtcgggaaattgtggacttgatgtgtcatgcgaccttcactatgagactgctcagtccagttagggtgcctaactacaatctgataatcatggatgaggcacactttaccgaccccgcctctattgctgcccgcggctatatcagcacacgagtcgaaatgggggaggcagccggaatcttcatgacggctactccaccgggctccagagatccttttccccagtcaaacgcgccaattatggacgaggaacgggagatacccgaaaggtcttggaatagcggtcacgagtgggtgaccgatttcaaggggaagacagtatggtttgtgcctagtatcaaagccggaaacgacattgcagcttgccttcgcaagaatggcaaaaaggttatccagctgtcccgtaaaaccttcgatagcgaatacgtcaagactagagccaacgactgggattttgtggtgacaaccgacatttctgagatgggcgcaaatttcaaggccgagcgggtcatcgatccaaggcgctgtatgaaacccgtaatattgacggacggggaagagcgagtgatcctagctggacctatgccggttactcattcatccgccgcgcaaagacggggtaggattggccgcaacccaaagaatgaaaacgaccagtatatctacatgggggagcccctggaaaatgatgaggactgcgcacactggaaagaggccaagatgctcttagataacattaatacacctgaaggaatcatacccagtatgtttgagccagaaagagagaaagtggacgctattgatggcgaatacaggctgcggggtgaggcccgtaagaccttcgtcgaccttatgcgccgaggggatctgcctgtgtggctcgcttataaagttgcagccgagggcatcaactacgctgacagaaagtggtgttttgatggaattaagaataaccagatcttggaagagaacgtggaagtcgagatatggaccaaagagggcgaaaggaagaaactgaagccccggtggctcgacgcccgcatctatagcgatccactggcacttaaagagttcaaggaattcgcggccgggagaaagtcgctaactctgaatttgattacagagatgggaaggttacctacctttatgacacagaaagctcggaacgccctggacaatctcgcagtgctgcatactgctgaagccggtggccgagcatacaaccacgccctttctgagctgccggagacgctcgaaaccttgctgctactgacactccttgctactgtaaccgggggaatcttcctgtttttaatgtccggcaagggtattgggaaaatgacattgggcatgtgctgcatcataaccgcgagcattctgctctggtatgcccaaatccagccccactggatcgcagcttcaattatcctggagttctttcttatagtgctgctcattccagaacctgagaagcagagaactccccaggataatcaattgacgtacgttgtcatcgccattctgaccgtggtggccgcaacaatggctaacgaaatgggattcttagagaaaactaagaaggacctaggcctggggagtatcaccacacaggagtctgaatccaatatactcgacatcgatcttcgcccagccagcgcgtggaccctgtatgctgtcgccactacatttgttacgcctatgttgaggcattcaattgagaacagtagcgtgaatgtatccctgaccgcaatcgccaaccaggctactgtgctcatgggactgggtaaaggctggcccctttctaagatggacattggggtcccgctcctggcaatcggatgttacagccaggtgaatccaattacattgaccgccgcgctgttactactggttgctcactacgccatcataggccctggtctccaagcaaaagccacccgggaagctcagaagcgtgccgcagctgggattatgaaaaaccccacagtggatggcatcactgtcatcgaccttgagccaattccctatgatcctaagttcgaaaagcagctgggacaggtaatgttgctgatactctgcgtgacgcaagttctgatgatgagaaccacatgggccctttgtgaggcgttaactctggccaccggcccgatctccacactctgggaggggaatcccggaaggttttggaacaccactattgcagtgtcaatggctaatatcttccgcggctcttacttggccggtgcagggctgctatttagtattatgaaaaacacgacaaatacccggcgaggaactggcaacatcggtgaaaccctgggcgagaagtggaaatcgagactcaacgctcttgggaagagcgaattccagatatataaaaagtccggaatccaggaggtcgacaggacactggccaaagagggcattaagcgcggggaaactgatcatcacgccgtgtctcggggatcagcgaagttgagatggtttgtcgagcgtaatatggtgaccccagaaggcaaagttgtggacctgggttgcgggaggggaggctggagctactattgtggtggcctcaagaacgtacgggaggtgaaagggctgacaaagggaggccctgggcatgaagagcccgtccctatgtccacgtacggatggaatttagttcgccttcaaagtggcgtggatgtcttcttcaccccacccgagaaatgcgacactctgctctgtgatatcggtgaatctagccctaacccaacaattgaggctgggcgaaccctaagagtgctgaatttggtagaaaactggctgaataacaatactcagttttgcatcaaggtgctcaacccctatatgccgtcagttatagagaagatggaaacacttcagaggaaatacggaggcgcactggtgcggaatcctttgtcccgcaacagtacccacgagatgtactgggtcagcaatgccacgggcaacattgtgtcttccgtcaatatgatctcaagaatgctgatcaacaggttcaccatgaagcacaaaaaggctacatatgagccagacgtggatctcgggagcggaactcgaaacattggtatagaatcggagacccccaatttagacatcattggcaaacggatcgaaaagattaagcaggagcatgaaacatcttggcactacgaccaagatcatccttataaaacttgggcctaccacgggagttatgagaccaagcagacaggatccgcaagctcaatggttaacggcgtagtgcgtctgcttaccaaaccatgggacgtcgtgcccatggttactcagatggccatgacggatacaaccccgtttggtcagcaaagagtgttcaaggagaaagtcgacactcgcacccaggaacctaaggaggggacaaagaaactgatgaagatcacggctgaatggctatggaaagagctcggaaagaaaaagacccccaggatgtgtactcgggaggaatttacaaaaaaggtgagatccaatgcggccctgggcgcaatattcaccgatgagaacaagtggaaatctgctcgcgaagccgtagaggacggcaggttttgggaattggtggatcgagagcggaatctgcacctcgaggggaagtgcgaaacttgtgtttacaacatgatgggaaaaagagagaagaaacttggtgaattcggcaaggcaaaggggagcagggccatctggtatatgtggctgggagctcgctttttagagttcgaagccctgggctttttgaatgaggaccattggttcagtcgtggtaactccctcagcggggtcgagggagaaggcctgcaccggctaggctacattcttagagaggtggggaaaaaggaaggaggtgcgatgtacgcagatgacacagccggctgggataccaggatcacactggaggacctcaaaaatgaagagatggtgactaaccatatgaagggggagcacaaaaagctggctgaagccatttttaagttgacctatcagaataaagtcgttcgcgtgcagcgaccaacgcctcggggaaccgtaatggacatcatttctagaagggatcaacgcggctcaggtcaggtggggacatacggactgaacactttcaccaatatggaggcacagctcataagacaaatggaaggcgagggcatcttcaagagtattcagcatcttacagctactgaggaaatcgccgtccagaactggctggctcgggtggggagggagcgtttatcccgaatggccatcagcggagacgattgcgttgtgaaacccattgacgatcgctttgcatctgcgctgaccgccttgaatgacatgggtaaggtcagaaaagatatacagcaatgggaaccatcgcggggctggaacgactggacgcaggtgcccttctgctcacaccactttcatgagctcgtaatgaaggatgggagggttctggtggtcccttgtcgcaaccaggacgaactaatcggaagagctcggattagccagggcgccggttggtcccttaaggagacagcatgcctggggaaaagttatgctcaaatgtggaccctcatgtacttccacaggcgagatctgcgtttggccgcaaatgccatctgttctgcggtgccaagccattgggtgccgacttccagaacaacctggtcaattcacgctaagcacgagtggatgactaccgaagacatgttagccgtctggaaccgcgtttggatccaggagaatccctggatggaagataaaacacctgtggagagttgggaagaggtaccatatctgggaaagcgggaggaccagtggtgcggctctctcataggccttacgagcagggcaacctgggccaaaaacatccagactgctattaatcaagtgagatccctgatcgggaacgaagagtacacagactatatgccctcaatgaagcgctttcggagggaagaggaagaggccggagtcctatggtga
